United States Patent 11,446,398 (REGULATED BIOCIRCUIT SYSTEMS) - sequence listing, part 65

SEQ ID NO: 162716 - DNA, 3080 bp, Homo sapiens
  Payload ID: 12062
  Gene Symbol: ORC1
  Gene Name: origin recognition complex, subunit 1
  Uniprot ID: Q13415
  ENST ID: ENST00000371566
  CDS Start-End: 145-2730
ctttggtcctggctttcggcccgtagttgtagaaggagccctgctggtgcaggttagaggtgccgcatcccccggagctctcgaagtggaggcggtaggaaacggagggcttgcggctagccggaggaagctttggagccggccatggcacactaccccacaaggctgaagaccagaaaaacttattcatgggttggcaggcccttgttggatcgaaaactgcactaccaaacctatagagaaatgtgtgtgaaaacagaaggttgttccaccgagattcacatccagattggacagtttgtgttgattgaaggggatgatgatgaaaacccgtatgttgctaaattgcttgagttgttcgaagatgactctgatcctcctcctaagaaacgtgctcgagtacagtggtttgtccgattctgtgaagtccctgcctgtaaacggcatttgttgggccggaagcctggtgcacaggaaatattctggtatgattacccggcctgtgacagcaacattaatgcggagaccatcattggccttgttcgggtgatacctttagccccaaaggatgtggtaccgacgaatctgaaaaatgagaagacactctttgtgaaactatcctggaatgagaagaaattcaggccactttcctcagaactatttgcggagttgaataaaccacaagagagtgcagccaagtgccagaaacccgtgagagccaagagtaagagtgcagagagcccttcttggaccccagcagaacatgtggccaaaaggattgaatcaaggcactccgcctccaaatctcgccaaactcctacccatcctcttaccccaagagccagaaagaggctggagcttggcaacttaggtaaccctcagatgtcccagcagacttcatgtgcctccttggattctccaggaagaataaaacggaaagtggccttctcggagatcacctcaccttctaagagatctcagcctgataaacttcaaaccttgtctccagctctgaaagccccagagaaaaccagagagactggactctcttatactgaggatgacaagaaggcttcacctgaacatcgcataatcctgagaacccgaattgcagcttcgaaaaccatagacattagagaggagagaacacttacccctatcagtgggggacagagatcttcagtggtgccatccgtgattctgaaaccagaaaacatcaaaaagagggatgcaaaagaagcaaaagcccagaatgaagcgacctctactccccatcgtatccgcagaaagagttctgtcttgactatgaatcggattaggcagcagcttcggtttctaggtaatagtaaaagtgaccaagaagagaaagagattctgccagcagcagagatttcagactctagcagtgacgaagaagaggcttccacaccgccccttccaaggagagcacccagaactgtgtccaggaacctgcgatcttccttgaagtcatccttacataccctcacgaaggtgccaaagaagagtctcaagcctagaacgccacgttgtgccgctcctcagatccgtagtcgaagcctggctgcccaggagccagccagtgtgctggaggaagcccgactgaggctgcatgtttctgctgtacctgagtctcttccctgtcgggaacaggaattccaagacatctacaattttgtggaaagcaaactccttgaccataccggagggtgcatgtacatctccggtgtccctgggacagggaagactgccactgttcatgaagtgatacgctgcctgcagcaggcagcccaagccaatgatgttcctccctttcaatacattgaggtcaatggcatgaagctgacggagccccaccaagtctatgtgcaaatcttgcagaagctaacaggccaaaaagcaacagccaaccatgcggcagaactgctggcaaagcaattctgcacccgagggtcacctcaggaaaccaccgtcctgcttgtggatgagctcgaccttctgtggactcacaaacaagacataatgtacaatctctttgactggcccactcataaggaggcccggcttgtggtcctggcaattgccaacacaatggacctgccagagcgaatcatgatgaaccgggtgtccagccgactgggtcttaccaggatgtgcttccagccctatacatatagccagctgcagcagatcctaaggtcccggctcaagcatctaaaggcctttgaagatgatgccatccagctggtagccaggaaggtagcagcactgtctggagatgcacgacggtgcctggacatctgcaggcgtgccacagagatctgtgagttctcccagcagaagcctgactcccctggcctggtcaccatagcccactcaatggaagctgtggatgagatgttttcatcatcatacatcacggccatcaaaaattcctctgttctggaacagagcttcctgagagccatcctcgcagagttccgtcgatcaggactggaggaagccacgtttcaacagatatatagtcaacatgtggcactgtgcagaatggagggactgccgtaccccaccatgtcagagaccatggccgtgtgttctcacctgggctcctgtcgcctcctgcttgtggagcccagcaggaacgatctgctccttcgggtgcggctcaacgtcagccaggatgatgtgctgtatgcgctgaaagacgagtaaaggggcttcacaagttaaaagactggggtcttgctgggttttgttttttgagacagggtcttgctctgtcgcccaggctggagtgcagtggcacgatcatggctcactgcagccttgacttctcaggcttaggtgaccccccaacctcatcctcccaggtggctgaaactacaggcacatgccaccatgcccagctgattttttgtagagacagggcttcaccatgttgccaagctagtctacaaagcatctgattttggaagtacatggaattgttgtaacaaagtatattgaatggaaatggctctcatgtattttggaattttccattaaataatttgctttttcct

SEQ ID NO: 162717 - DNA, 3157 bp, Homo sapiens
  Payload ID: 12062
  Gene Symbol: ORC1
  Gene Name: origin recognition complex, subunit 1
  Uniprot ID: Q13415
  ENST ID: ENST00000371568
  CDS Start-End: 220-2805
cggggccacgccgattggcgcgaagttttcttttctccttccaccttcttttcatttctagtgagacacacgctttggtcctggctttcggcccgtagttgtagaaggagccctgctggtgcaggttagaggtgccgcatcccccggagctctcgaagtggaggcggtaggaaacggagggcttgcggctagccggaggaagctttggagccggaagccatggcacactaccccacaaggctgaagaccagaaaaacttattcatgggttggcaggcccttgttggatcgaaaactgcactaccaaacctatagagaaatgtgtgtgaaaacagaaggttgttccaccgagattcacatccagattggacagtttgtgttgattgaaggggatgatgatgaaaacccgtatgttgctaaattgcttgagttgttcgaagatgactctgatcctcctcctaagaaacgtgctcgagtacagtggtttgtccgattctgtgaagtccctgcctgtaaacggcatttgttgggccggaagcctggtgcacaggaaatattctggtatgattacccggcctgtgacagcaacattaatgcggagaccatcattggccttgttcgggtgatacctttagccccaaaggatgtggtaccgacgaatctgaaaaatgagaagacactctttgtgaaactatcctggaatgagaagaaattcaggccactttcctcagaactatttgcggagttgaataaaccacaagagagtgcagccaagtgccagaaacccgtgagagccaagagtaagagtgcagagagcccttcttggaccccagcagaacatgtggccaaaaggattgaatcaaggcactccgcctccaaatctcgccaaactcctacccatcctcttaccccaagagccagaaagaggctggagcttggcaacttaggtaaccctcagatgtcccagcagacttcatgtgcctccttggattctccaggaagaataaaacggaaagtggccttctcggagatcacctcaccttctaagagatctcagcctgataaacttcaaaccttgtctccagctctgaaagccccagagaaaaccagagagactggactctcttatactgaggatgacaagaaggcttcacctgaacatcgcataatcctgagaacccgaattgcagcttcgaaaaccatagacattagagaggagagaacacttacccctatcagtgggggacagagatcttcagtggtgccatccgtgattctgaaaccagaaaacatcaaaaagagggatgcaaaagaagcaaaagcccagaatgaagcgacctctactccccatcgtatccgcagaaagagttctgtcttgactatgaatcggattaggcagcagcttcggtttctaggtaatagtaaaagtgaccaagaagagaaagagattctgccagcagcagagatttcagactctagcagtgacgaagaagaggcttccacaccgccccttccaaggagagcacccagaactgtgtccaggaacctgcgatcttccttgaagtcatccttacataccctcacgaaggtgccaaagaagagtctcaagcctagaacgccacgttgtgccgctcctcagatccgtagtcgaagcctggctgcccaggagccagccagtgtgctggaggaagcccgactgaggctgcatgtttctgctgtacctgagtctcttccctgtcgggaacaggaattccaagacatctacaattttgtggaaagcaaactccttgaccataccggagggtgcatgtacatctccggtgtccctgggacagggaagactgccactgttcatgaagtgatacgctgcctgcagcaggcagcccaagccaatgatgttcctccctttcaatacattgaggtcaatggcatgaagctgacggagccccaccaagtctatgtgcaaatcttgcagaagctaacaggccaaaaagcaacagccaaccatgcggcagaactgctggcaaagcaattctgcacccgagggtcacctcaggaaaccaccgtcctgcttgtggatgagctcgaccttctgtggactcacaaacaagacataatgtacaatctctttgactggcccactcataaggaggcccggcttgtggtcctggcaattgccaacacaatggacctgccagagcgaatcatgatgaaccgggtgtccagccgactgggtcttaccaggatgtgcttccagccctatacatatagccagctgcagcagatcctaaggtcccggctcaagcatctaaaggcctttgaagatgatgccatccagctggtagccaggaaggtagcagcactgtctggagatgcacgacggtgcctggacatctgcaggcgtgccacagagatctgtgagttctcccagcagaagcctgactcccctggcctggtcaccatagcccactcaatggaagctgtggatgagatgttttcatcatcatacatcacggccatcaaaaattcctctgttctggaacagagcttcctgagagccatcctcgcagagttccgtcgatcaggactggaggaagccacgtttcaacagatatatagtcaacatgtggcactgtgcagaatggagggactgccgtaccccaccatgtcagagaccatggccgtgtgttctcacctgggctcctgtcgcctcctgcttgtggagcccagcaggaacgatctgctccttcgggtgcggctcaacgtcagccaggatgatgtgctgtatgcgctgaaagacgagtaaaggggcttcacaagttaaaagactggggtcttgctgggttttgttttttgagacagggtcttgctctgtcgcccaggctggagtgcagtggcacgatcatggctcactgcagccttgacttctcaggcttaggtgaccccccaacctcatcctcccaggtggctgaaactacaggcacatgccaccatgcccagctgattttttgtagagacagggcttcaccatgttgccaagctagtctacaaagcatctgattttggaagtacatggaattgttgtaacaaagtatattgaatggaaatggctctcatgtattttggaattttccattaaataatttgctttttcctga

SEQ ID NO: 162718 - DNA, 4312 bp, Homo sapiens
  Payload ID: 12063
  Gene Symbol: ORC2
  Gene Name: origin recognition complex, subunit 2
  Uniprot ID: Q13416
  ENST ID: ENST00000234296
  CDS Start-End: 251-1984
gtgccgcacgcaggcttcccatcccccagctggcctccggtgctccttacctccccggtggtcgggcgcgaattactggaaattggcttttcccgttggggccgaaggtaccttccctgcggcggcgactcagcggggtgtcgttcggccggcgtgacgcagccggatcggcgccagacggaaacctagcggtgactgtatctgaattttgcagctgcagaatgtgtagtaccttaaaaggttggcaacaatgagtaaaccagaattaaaggaagacaagatgctggaggttcactttgtgggagatgatgatgttcttaatcacattctagatagagaaggaggagctaaattgaagaaggagcgagcgcagcttttggtcaaccccaaaaaaataataaagaagccagaatatgatttggaggaagatgaccaggaggtcttaaaagatcagaactatgtggaaattatgggaagagatgttcaagaatcattgaaaaatggctctgctacaggtggtggaaataaagtttattcttttcagaatagaaaacactctgaaaagatggctaaattagcttcagaactagcaaaaacaccacaaaaaagtgtttcattcagtttgaagaatgatcctgagattacgataaacgttcctcaaagtagcaagggccattctgcttcagacaaggttcaaccgaagaacaatgacaaaagtgaatttctgtcaacagcacctcgtagtctaagaaaaagattaatagttccaaggtctcattctgacagtgaaagcgaatattctgcttccaactcagaggatgatgaaggggttgcacaggaacatgaagaggacactaatgcagtcatattcagccaaaagattcaagctcagaatagagtagtttcagctcctgttggcaaagaaacaccttctaagagaatgaaaagagataaaacaagtgacttagtagaagaatattttgaagctcacagcagttcaaaagttttaacctctgatagaacactgcagaagctaaagagagctaaactggatcagcaaactttgcgtaacttattgagcaaggtttccccttccttttctgccgaacttaaacaactaaatcaacagtatgaaaaattatttcataaatggatgctgcaattacaccttgggttcaacattgtgctttatggtttgggttctaagagagatttactagaaaggtttcgaaccactatgctgcaagattccattcacgttgtcatcaatggcttctttcctggaatcagtgtgaaatcagtcctgaattctataacagaagaagtcctcgatcatatgggtactttccgcagtatactggatcagctagactggatagtaaacaaatttaaagaagattcttctttagaactcttccttctcatccacaatttggatagccagatgttgagaggagagaagagccagcaaatcattggtcagttgtcatctttgcataacatttaccttatagcatccattgaccacctcaatgctcctctcatgtgggatcatgcaaagcagagtctttttaactggctctggtatgaaactactacatacagtccttatactgaagaaacctcctatgagaactctcttctggtaaagcagtctggatccctgccacttagctcccttactcatgtcttacgaagccttacccctaatgcaaggggaattttcaggctactaataaaataccagctggacaaccaggataacccttcttacattggcctttcttttcaagatttttaccagcagtgtcgggaggcattcctcgtcaatagtgatctgacactccgggcccagttaactgaatttagggaccacaagcttataagaacaaagaagggaactgatggagtagagtatttattaattcctgttgataatggaacattgactgatttcttggaaaaggaagaagaggaggcttgaagctttcctttattcttgaatctcccatggaagggttgtaccccagctgccactcctctagttgaaagtgttgtgtttacatctgacattaaattatttttccagcatacaagatttaaatttgggaagggggggatgtcctcaattagaactttttgatcagcctggctggtaccgtctagtactatgcagcggtcctcaagttggagaaaatgtgcctttcattcattacctctctggagacttcttgctggaatgaacagtgtgctcagggactatttggaactggatgtttttgaattattttatacttagagatattctgaattttttgagggccttttaacactccccgagctgattgtttgcaagtgtgtttgttccagagtgtggaagtataaagacatgggcatcacgtaaattggttttgtttgctattctgtgtgtcagaaccaacgagtgtaatggagagggcaggtcatctcttattgtttctaaaacaacttaaaaggtgtagattgggaagaggtgagtgatccagctttctccttttggattgaggctatgtacttggtgggggcaggggagggaatatattataatactattcagttgggataatgggaaaaacagagtatatagggtatctacccagcctagaaagcacaggaacaatacgtcatatatttggaacagttattgtctgtgccatgaccttcatgataccagtgagaagccaggctagagaaataaaatcctgaattacattttagtaattgttttcaagacaacaaaaaataaaacatttcattattcttgtatattgacatatttttcttttcttgaacaacatgcaggtgagtagcatattaatggctggctgtaaattaattttgattcctctgtcaagtagacctaaaactcactgtaagatatttcagttttttccttaaagtgatgatttcaaacctcctgaatatttgcgcgagacttttttcttaggaaagaaaaaaggctcaccttggctactgttgtcagcttacagtcatcacataccccctgaaatatttgacacttggaaatgaagttcttcctgaaaatatcactgcaataaaatacgtactacgtcagcatttctcactcatttcttatcttgtaaacctctttcatgaaaatatttccaaaaatccttggaatttttaaataatttttcttgtggcatataattaagtaattttggccaggcataatggcttatgcctgtaatcacaacactttgggaggccaaggcaggaggatctctggagcccaggagtttaagaacagcctgggcaacatagtgagaccttgtctctacaaaaaatttaaaaaatcatccgggcatggtggcccatgcctatagtcctagctgctgtggaggctgaggcaggaggatcgcttgagcccaggggttcaagattacagtgagctatgattgtgccactgcacttcagtctgggtgcagagcaagaccttgtctttttttttttttaaatcatttttttaaaaagtaattttatgttaagtccatgggcttagtctttttttttttttttttttttttagatggaattgcactgtcatccagtctagagtgcagtggcgtgatctaagcttacagcagcctccacctcctgggttcaagtgattcttgtgcctcagcctcctgagctgggactacaggcacacgccaccacgcctggctagtttttgaatttttagcagagatggggtttcaccatgttggccaggctggtctcgaattcctgacctcaagtgatcctgcctcggcctcccaaagtactgggatcaggggtgagccactatgcctggccaagggcttagtcttaaatataacctctagtcaaaatgtttaaacaaatttgtacataaatgtgatttaaaaaaatttttttaatagtaccaaaggatattcagtgaaagtgagtttcctgcccactccctgatccacccagttctttaggcaaccactgatagcattttcttaagtattcttccagatatcgtctatgcatatgtaaaagtatctgtctttctccttttaaaaacacaattggtaatatatcatacttgctggtttgcaccttgctttttttgcttaatatatctagtttataatgacctaatgtgcaaatttttgcatctgccctaaatatctactggtttatttttataatttttgtgtctatactatttgcaagcagtatgtgtcagtagactttattattaataaataaaaagccaatttggatagaatcactttataaa

SEQ ID NO: 162719 - DNA, 546 bp, Homo sapiens
  Payload ID: 12063
  Gene Symbol: ORC2
  Gene Name: origin recognition complex, subunit 2
  ENST ID: ENST00000410039
  CDS Start-End: 219-546
aagtcgcgcatctcaggactttccctcggcacttggggcatggtctttgcgcctcgctgccccccgcaggctgcccgggggctcgagaacccttactggtggagcgcagccaactggccagaggctggaggcgcaggccaaagtcctttaagacttgaggtgactgtatctgaattttgcagctgcagaatgtgtagtaccttaaaaggttggcaacaatgagtaaaccagaattaaaggaagacaagatgctggaggttcactttgtgggagatgatgatgttcttaatcacattctagatagagaaggaggagctaaattgaagaaggagcgagcgcagcttttggtcaaccccaaaaaaataataaagaagccagaatatgatttggaggaagatgaccaggaggtcttaaaagatcagaactatgtggaaattatgggaagagatgttcaagaatcattgaaaaatggctctgctacaggtggtggaaataaagtttattcttttcagaatagaaaacactctgaaaagatggctaaattag

SEQ ID NO: 162720 - DNA, 486 bp, Homo sapiens
  Payload ID: 12063
  Gene Symbol: ORC2
  Gene Name: origin recognition complex, subunit 2
  ENST ID: ENST00000457595
  CDS Start-End: 270-486
agaggctggaggcgcaggccaaagtcctttaagacttgaggtgagaggctcactctgggaggacctttcgttagtctgccccgcagttataggccttttgtgcaagggacgcctgatactaacctacctgattcccagcttacgaagccctctggttggaaaaggagaactgtgaagatgtgtaacgacagtggtaaagtgccctgtgaggtgactgtatctgaattttgcagctgcagaatgtgtagtaccttaaaaggttggcaacaatgagtaaaccagaattaaaggaagacaagatgctggaggttcactttgtgggagatgatgatgttcttaatcacattctagatagagaaggaggagctaaattgaagaaggagcgagcgcagcttttggtcaaccccaaaaaaataataaagaagccagaatatgatttggaggaagatgaccaggaggtcttaaaagatcagaactatgtggaaa

SEQ ID NO: 162721 - DNA, 2501 bp, Homo sapiens
  Payload ID: 12064
  Gene Symbol: ORC3
  Gene Name: origin recognition complex, subunit 3
  Uniprot ID: Q9UBD5
  ENST ID: ENST00000257789
  CDS Start-End: 35-2173
gagtgcatctggaatacgcagagtcagtaagaccatggctacgtcctcgatgtctaagggttgctttgtttttaagccaaactccaaaaagagaaagatctctctgccaatagaggactattttaacaaagggaaaaatgagcctgaggacagtaagcttcgattcgaaacttatcagttgatatggcagcagatgaaatctgaaaatgagcgactacaagaggaattaaataaaaacttgtttgacaatctgattgaatttctgcaaaaatcacattctggattccagaagaattcaagagacttgggcggtcaaataaaactcagagaaattccaactgctgctcttgttcttggtgtgaatgtcacagatcatgatttgacattcggaagtctaacagaggcccttcagaataatgtcacaccatatgtagtctcattgcaagctaaagattgtccagatatgaaacattttttgcaaaagttgatctcacagttgatggactgctgtgtagatataaaatccaaagaggaggaaagtgttcacgtcacccaaagaaagacacattattcaatggattcactttccagttggtatatgactgtcacacagaagacggacccaaaaatgctaagcaaaaaaaggactacttctagccaatggcagtctcctcctgttgtcgttatcttgaaggatatggaaagctttgccacaaaagtactacaagacttcataattatcagcagtcaacatctccatgaatttccactaatactcatttttggaatagccacatctcctattatcatccaccgattgcttcctcatgcagtatcatctctattgtgcatagaactgttccaatctttgtcttgtaaggagcacctgactacggtactcgataagctacttcttacaactcagtttccctttaaaataaatgaaaaagtattacaggttctgaccaacatctttttgtatcatgatttctcagttcaaaactttataaaaggacttcagctttctctattagagcatttctattcccagcccttaagtgtcctgtgctgtaatcttccagaagccaaaagaagaataaattttttatcaaataatcaatgtgaaaacatccgacgtctaccatcttttaggaggtacgtggaaaagcaagcttcagaaaagcaagttgcgctcttgaccaatgagagatatttgaaggaggaaacacaattattactagaaaacctgcatgtttatcatatgaattacttcctggttttgagatgtcttcataagttcacctcttctcttcccaagtatccactaggtcgacagatcagagagttgtactgtacatgtttagaaaagaacatatgggattcagaggagtatgcatcagtcttgcagctgctgaggatgttggcaaaggatgaactgatgaccatacttgagaaatgtttcaaggtttttaagtcttattgtgaaaaccaccttggcagcacagctaagagaatagaggagttcctggcccagtttcagagcctcgatgcagaaaccaaagaggaagaagatgcttctgggtcacagccaaaggggcttcagaagacagacctctatcatcttcagaagtccttattggaaatgaaggagttaagaagaagtaagaagcaaaccaaatttgaagtactcagagaaaatgttgtgaacttcattgactgtctagtgagagaataccttctgcctcctgagacacagcctctccatgaggtggtgtacttcagtgctgcccatgcccttcgtgagcatttaaatgctgctccgcgaattgccctccatactgcactcaacaatccttactattatctcaagaatgaagcactgaaaagcgaagaaggctgcattccgaatatcgccccagacatctgcatagcatacaaactgcacctagagtgtagcaggctcatcaacctcgtggactggtcagaggcttttgcaacagttgtgacagctgctgaaaaaatggatgcaaattctgcaacctcagaagaaatgaatgaaattatccatgctcggtttattagagctgtttctgaactagaacttttaggatttataaaacctaccaaacagaagactgaccatgtggcaagactaacatggggaggctgctagaaagcaaataagcaaagccagaactatcacatttagcttaagagaaaaaggtgaccagtcatatttacatatattagaggagcctgttttgttgagaagataaatgtgtaacccccattgatgtttaaccagaaaagtacattgctaaccccaaacaggcatgtatcaaaacacctgtggagtactttagactccaacaaataataatgtaactaaaactgctcacacattttactgtactttccaaagtcattactaaattgtgagtaaatcattcttgaacttagagtatgtaaatgtaataaattccgttatccaggagtataaa

SEQ ID NO: 162722 - DNA, 2512 bp, Homo sapiens
  Payload ID: 12064
  Gene Symbol: ORC3
  Gene Name: origin recognition complex, subunit 3
  Uniprot ID: Q9UBD5
  ENST ID: ENST00000392844
  CDS Start-End: 49-2184
gcgcgggaaatcccgagtgcatctggaatacgcagagtcagtaagaccatggctacgtcctcgatgtctaagggttgctttgtttttaagccaaactccaaaaagagaaagatctctctgccaatagaggactattttaacaaagggaaaaatgagcctgaggacagtaagcttcgattcgaaacttatcagttgatatggcagcagatgaaatctgaaaatgagcgactacaagaggaattaaataaaaacttgtttgacaatctgattgaatttctgcaaaaatcacattctggattccagaagaattcaagagacttgggcggtcaaataaaactcagagaaattccaactgctgctcttgttcttggtgtgaatgtcacagatcatgatttgacattcggaagtctaacagaggcccttcagaataatgtcacaccatatgtagtctcattgcaagctaaagattgtccagatatgaaacattttttgcaaaagttgatctcacagttgatggactgctgtgtagatataaaatccaaagaggaggaaagtgttcacgtcacccaaagaaagacacattattcaatggattcactttccagttggtatatgactgtcacacagaagacggacccaaaaatgctaagcaaaaaaaggactacttctagccaatggcagtctcctcctgttgtcgttatcttgaaggatatggaaagctttgccacaaaagtactacaagacttcataattatcagcagtcaacatctccatgaatttccactaatactcatttttggaatagccacatctcctattatcatccaccgattgcttcctcatgcagtatcatctctattgtgcatagaactgttccaatctttgtcttgtaaggagcacctgactacggtactcgataagctacttcttacaactcagtttccctttaaaataaatgaaaaagtattacaggttctgaccaacatctttttgtatcatgatttctcagttcaaaactttataaaaggacttcagctttctctattagagcatttctattcccagcccttaagtgtcctgtgctgtaatcttccagaagccaaaagaagaataaattttttatcaaataatcaatgtgaaaacatccgacgtctaccatcttttaggaggtacgtggaaaagcaagcttcagaaaagcaagttgcgctcttgaccaatgagagatatttgaaggaggaaacacaattattactagaaaacctgcatgtttatcatatgaattacttcctggttttgagatgtcttcataagttcacctcttctcttcccaagtatccactaggtcgacagatcagagagttgtactgtacatgtttagaaaagaacatatgggattcagaggagtatgcatcagtcttgcagctgctgaggatgttggcaaaggatgaactgatgaccatacttgagaaatgtttcaaggtttttaagtcttattgtgaaaaccaccttggcagcacagctaagagaatagaggagttcctggcccagtttcagagcctcgatgaaaccaaagaggaagaagatgcttctgggtcacagccaaaggggcttcagaagacagacctctatcatcttcagaagtccttattggaaatgaaggagttaagaagaagtaagaagcaaaccaaatttgaagtactcagagaaaatgttgtgaacttcattgactgtctagtgagagaataccttctgcctcctgagacacagcctctccatgaggtggtgtacttcagtgctgcccatgcccttcgtgagcatttaaatgctgctccgcgaattgccctccatactgcactcaacaatccttactattatctcaagaatgaagcactgaaaagcgaagaaggctgcattccgaatatcgccccagacatctgcatagcatacaaactgcacctagagtgtagcaggctcatcaacctcgtggactggtcagaggcttttgcaacagttgtgacagctgctgaaaaaatggatgcaaattctgcaacctcagaagaaatgaatgaaattatccatgctcggtttattagagctgtttctgaactagaacttttaggatttataaaacctaccaaacagaagactgaccatgtggcaagactaacatggggaggctgctagaaagcaaataagcaaagccagaactatcacatttagcttaagagaaaaaggtgaccagtcatatttacatatattagaggagcctgttttgttgagaagataaatgtgtaacccccattgatgtttaaccagaaaagtacattgctaaccccaaacaggcatgtatcaaaacacctgtggagtactttagactccaacaaataataatgtaactaaaactgctcacacattttactgtactttccaaagtcattactaaattgtgagtaaatcattcttgaacttagagtatgtaaatgtaataaattccgttatccaggagtataaa

SEQ ID NO: 162723 - DNA, 2470 bp, Homo sapiens
  Payload ID: 12064
  Gene Symbol: ORC3
  Gene Name: origin recognition complex, subunit 3
  Uniprot ID: Q9UBD5
  ENST ID: ENST00000546266
  CDS Start-End: 434-2140
caatcaaggagccgtgtggctcgccactaacctctgccctgcagccgcgagggcgcgcgggaaatcccgagtgcatctggaatacgcagagtcagtaagaccatggctacgtcctcgatgtctaagggttgctttgtttttaagccaaactccaaaaagagaaagatctctctgccaatagcgactacaagaggaattaaataaaaacttgtttgacaatctgattgaatttctgcaaaaatcacattctggattccagaagaattcaagagacttgggcggtcaaataaaactcagagaaattccaactgctgctcttgttcttggtgtgaatgtcacagatcatgatttgacattcggaagtctaacagaggcccttcagaataatgtcacaccatatgtagtctcattgcaagctaaagattgtccagatatgaaacattttttgcaaaagttgatctcacagttgatggactgctgtgtagatataaaatccaaagaggaggaaagtgttcacgtcacccaaagaaagacacattattcaatggattcactttccagttggtatatgactgtcacacagaagacggacccaaaaatgctaagcaaaaaaaggactacttctagccaatggcagtctcctcctgttgtcgttatcttgaaggatatggaaagctttgccacaaaagtactacaagacttcataattatcagcagtcaacatctccatgaatttccactaatactcatttttggaatagccacatctcctattatcatccaccgattgcttcctcatgcagtatcatctctattgtgcatagaactgttccaatctttgtcttgtaaggagcacctgactacggtactcgataagctacttcttacaactcagtttccctttaaaataaatgaaaaagtattacaggttctgaccaacatctttttgtatcatgatttctcagttcaaaactttataaaaggacttcagctttctctattagagcatttctattcccagcccttaagtgtcctgtgctgtaatcttccagaagccaaaagaagaataaattttttatcaaataatcaatgtgaaaacatccgacgtctaccatcttttaggaggtacgtggaaaagcaagcttcagaaaagcaagttgcgctcttgaccaatgagagatatttgaaggaggaaacacaattattactagaaaacctgcatgtttatcatatgaattacttcctggttttgagatgtcttcataagttcacctcttctcttcccaagtatccactaggtcgacagatcagagagttgtactgtacatgtttagaaaagaacatatgggattcagaggagtatgcatcagtcttgcagctgctgaggatgttggcaaaggatgaactgatgaccatacttgagaaatgtttcaaggtttttaagtcttattgtgaaaaccaccttggcagcacagctaagagaatagaggagttcctggcccagtttcagagcctcgatgaaaccaaagaggaagaagatgcttctgggtcacagccaaaggggcttcagaagacagacctctatcatcttcagaagtccttattggaaatgaaggagttaagaagaagtaagaagcaaaccaaatttgaagtactcagagaaaatgttgtgaacttcattgactgtctagtgagagaataccttctgcctcctgagacacagcctctccatgaggtggtgtacttcagtgctgcccatgcccttcgtgagcatttaaatgctgctccgcgaattgccctccatactgcactcaacaatccttactattatctcaagaatgaagcactgaaaagcgaagaaggctgcattccgaatatcgccccagacatctgcatagcatacaaactgcacctagagtgtagcaggctcatcaacctcgtggactggtcagaggcttttgcaacagttgtgacagctgctgaaaaaatggatgcaaattctgcaacctcagaagaaatgaatgaaattatccatgctcggtttattagagctgtttctgaactagaacttttaggatttataaaacctaccaaacagaagactgaccatgtggcaagactaacatggggaggctgctagaaagcaaataagcaaagccagaactatcacatttagcttaagagaaaaaggtgaccagtcatatttacatatattagaggagcctgttttgttgagaagataaatgtgtaacccccattgatgtttaaccagaaaagtacattgctaaccccaaacaggcatgtatcaaaacacctgtggagtactttagactccaacaaataataatgtaactaaaactgctcacacattttactgtactttccaaagtcattactaaattgtgagtaaatcattcttgaacttagagtatgtaaatgtaataaattccgttatccaggagtataaatt

SEQ ID NO: 162724 - DNA, 562 bp, Homo sapiens
  Payload ID: 12064
  Gene Symbol: ORC3
  Gene Name: origin recognition complex, subunit 3
  ENST ID: ENST00000508875
  CDS Start-End: 465-562
ctgggaggcagaggttgcggtgagccgagatcacgccattgcaccctagcctgagcaacaagagcaaaactgcgtctcaaagaaaaaacaaaaaaagaataagaggactaataactatttgaatccctggcagtttacatctgagtaccttctccaagtgacacattaagagttatgactaatgaagtttgcttccaaagttatatgaaataatgccctcttttttggtctcctggataataggctaggtttggccttccttgatattcagttatttggagctcaaagtggacaagagctgttgctgcccctatcctgggaagctaatccttcacatgctgctaacttgggttagatcttctgccagcagaacctcacccgtctttcccctccaagcaagtcagtgccggtgattccttggacaccagaaatgctaatcttgtctatttgaataggcctaaaggatgttggcaaaggatgaactgatgaccatacttgagaaatgtttcaaggtttttaagtcttattgtgaaaaccaccttggcagcacagctaagagaat

SEQ ID NO: 162725 - DNA, 6598 bp, Homo sapiens
  Payload ID: 12065
  Gene Symbol: ORC4
  Gene Name: origin recognition complex, subunit 4
  Uniprot ID: O43929
  ENST ID: ENST00000264169
  CDS Start-End: 175-1485
gaggaggaggcgaaggaggaggaggagagctggggaagtggctgctcctgggtgtagtgagatgtctccagccagggccaagcagcagcagtagcagcagcagcagtagcagcagcagcagcaacagcagcagcagcagcaacagcagcagcaaagggatttgaatttgttgaaatgagcagtcgtaaatcaaagagtaacagcttaattcacacagagtgcctttcacaggtacaaagaattttacgtgaaagattttgtcgtcagagtccacatagtaacctatttggagtgcaagtacaatacaaacacttaagtgagctgctgaaaagaactgctctccatggagagagtaactctgtccttattatcggaccccgaggatcaggaaaaactatgttaataaatcatgctttgaaagaactcatggaaatagaagaagtgagtgaaaatgtattacaagttcacttaaatggactgctgcagatcaatgacaaaatcgccctaaaggaaatcacaaggcagttaaatctggaaaatgtagttggagataaagtttttggaagctttgctgaaaacctttcatttcttctggaagctttaaaaaaaggtgaccgaactagcagttgcccagtgatcttcatattagatgaatttgatctttttgctcatcataaaaaccaaacacttctctataatctttttgacatttctcagtctgcacagaccccaatagcagttattggtcttacatgtagattggatattttggaactcttagaaaaaagagtgaagtcaagattttctcaccggcagatacacttaatgaattcatttggttttccacagtatgttaaaatatttaaagaacagttatctctacctgcagagtttccagacaaggtttttgctgagaagtggaatgaaaatgttcagtatctctcagaagatagaagtgtgcaagaagtactacagaagcatttcaatatcagcaaaaacctgcggtcattacacatgctattgatgcttgctttaaatcgagtaacagcatcgcacccatttatgactgccgtagatctaatggaagcaagccaactgtgtagcatggactcgaaagcaaatattgtacatggtctatcagtcttggaaatctgtcttataatagcaatgaaacatttaaatgacatctatgaggaagagccatttaattttcaaatggtctataatgagtttcagaagtttgttcaaaggaaagcacattccgtttataattttgaaaaacctgttgtcatgaaggcttttgaacacttgcagcaattagaattaataaagcccatggaaagaacttcaggaaattcacagagagagtaccagctgatgaaactgcttttggataatactcaaattatgaatgctctgcagaaatatcccaactgtcctacagatgtgaggcagtgggcaacatcctcactaagctggttatgaatataaccagtgacttcaactttggcatttcattcatacttctgtagagaacggaaaactattgtccattaacatgatatgctaaacattctataaacattcttgtatttatgtgagacttgcccatctactgtcttggctgtgtcttgccttttaatcatgaacagttacatgatttataatttcactgattgagattactttgtaagtagctgttcagaagaataaaatatgactgttttagggactagaccatgtgcttttttaacacttatatatataatggtctatttgaagagctcacttcaacctaacagctagatgtctttacaaaccttaaaccaaaggagtaaaaaaaacaatggtaagcactgaagtataataagtaacctttggtacagcaggtttgctgcagtgtttttttctgtccacatgcaaattttggattctatcccagacccaggttttctagttcagaagactaaccagcttagtcagaagatggttccatggaagaaaaaggccaaggagtttgaagatttttcttctagacatctcaaaatgtggtactcataccatccacatcagaatcccttgtaggattttctaaaattacagattgttgagcctaccataggtcaaaaggactggaattttccttcttaacaagtatagtcatggcaccacgtaacattttggtcaatgacattgtataaagggtggtctcataagattataccatatttttactgtaccttttctatgtctaaatatacaaatgttttaccattgtgttacagttgcctacagtatgattacagtaacattctgtacagtgctatagctgaagagtaataggctaggctatctgtatagcctaagtgtgtaacaggctatatacatatcatcagggtctgtgtaagtatactctgtgatgttcatacagtgatgaaatcacccaaagacacatttctcagaacgtagccccatcatgaagtgacgtgactaccagagatttctggaaaagcactcccaaaagtaatgagatgtgtatggcaatgttaactgaacctgtttgtattaaaaagtaaatccctatgaggaatgtggaaatgtccgtcaaagcattgtcttttaagtaagttccaagatccatgaattaacagaggcatatatttaaaatgaaatttaatgagcacttagtgacttcatttgttcaagaatatttgatttcctattgtgtgcatgggaggtttacaaaagacagactgtccctatgcttgtgcagcttacaatctatttaactattagaggccctgtgagatgtaggcagttatttacagatgagaaaactaacacagcagtggcaatgctgggaatggccaacaggcttggaattcaactcagtttagcaccaaagccagtgctattaagacctgaagttcaacagtggattccttaccaaatagtttttaaagtatgctctaaggaacaatgttttaatgaaatcttggatacaaagtggaataaaaggtttctgagcataaagtagctcttcagtagttacaacctattcttttgcatacatagcctttccttccctgcaaaaagttaagcctgctaagtattcagatccctgtcatttacttctcagcagtctcattcaagctaaggcttgcatactcaatctgtgccgtagtctacacatttttaggggatatttcaccaaaatacttgacatggtaacatcactattatatactagaagcaagaattttacacttatgctctaagtgatccttttaaaaattttctgaactatttgaggaaagtattatttgtcttaaagggtaacagcctcatgaaatgacttgaggattccaatttcttattagcttaagatgtcacttaaaagctgacagccctcatctgtctcattggctacataagagctgcagaagatccatcaataaccaagtataaagaaagattttaagactaagtaccaattgaggtaaacatgaaaccgttataaagcaaattaaaaaaaaatacattaggaaaagttacacaaatgaagtgtacgcctattatattcccaaggcatttttgtggggaggaacagtgctgcttgttggcctttccatattccctcatacaaaaatgctaaaatctattcgcaagagttttgagctaacttcgtctcttaaattgctttaattgtcatcaataaaaacaaatatgaaaaaccctagtttaaaaagcggttcaagaataatgtaaacttatacatatagcttattttcttcatttactagaggaggaaaaatagaaccaaaaaatgcatgaactcctgcttttcaatctgattacctcaaactgaaaagcaggtgaaaggaggaatatttcagtgtgtttttacatctgaatccaagggatccaagtggcccagcagaaacggaattcttgttaaaatgactgattctcgtgcatgtgaaaggctctggggaatgaatacctgtttggtccaaacttactgtatcataatgctgtatatgttgaaaacgtaatacctgttaatgtcctaatgaatcacgttttgcagaaaacaccgtaagaaacacttcagtctttctgtagtttccatgcatatttcaccatggttcgcactctgatcctcatctggtttagaaagcaattcagtttctttcaaaccaccataacctaagtgctgccccatccttcacctttaccctagaaaatctgagaatccattggtgtgtactgtgtgacacaatgccaacaagcctctggtttctaatactggcaggaccaacacacatactttagtgggaatataatctgtttagacgataatagagggaaatgccataattaacaaatctcccttcactcaccactatcctcattcttgcagttgtcaaggtgtaagcctcactgtaagttacaaagctaccactcccctctttaagaacacatagcttaggattgccttggcgatgtgggctcttttttggttccatatgaacttaagtagttttttccaattctgtgaagaaagtcattggtagcttgatggggatggcattgaatctgtaaattaccttgggcagtatggccattttcacaatattgattcttcctacccaagagcatggaatgttcttccatttgtttgtatcctcttttatttccttgagcagtagcttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagatatacaatcatgtcgtctgcaaacggacaatttgacttcctcttttcctaattgaataccctttatttccttctcctgcctaattgccctggccagaacttccaacactatgttgaatacgagtggtgagagagggcatccctgtcttgtgccagttttcaaagggaatgcttccagtttttgcccattcagtatgatattggctgtgggtttgtcatagatagctcttattattttgaaatacaccccatcaatccctaatttattgagagtttttagcatgaagggttgttgaattttgtcaaaggctttttctgcatctattgagataatcatgtgttttttgtctttggctctgtttatatgctggattacattcattgatttgcgtatattgaaccagccttgcatcccagggatgaagcccacttgatcatggtggataagctttttgatgtgctgctggattcgttttgccagtattttatccagttagaatggcaatcattaaaaagtcaggaaacaacaggtgctggagaggatgtggagaaataggaacactttcacactgttggtgggactgtaaactagttcaaccattgtggaagtcagtgtggcgattcctcagggatctagaactggaaacaccatttgacccagccatcccattactgggtatatacccaaaggactataaatcatgctgctataaagacacatgcacacgtatgtttattgtggcattattcacaatagcaaagacttggaaccaacccaaatgtccaacaatgatagactggattaagaaaacgtggcacatatacaccatggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagatcacatggacacaggaaggggaatatcacactctggggactgttgtggggtggggggatgggggagggatagcattaggagatatacctaatgctagatgacgagttagtgggtgcagcgcaccagcatggcacatgtatacctatgtaactaacctgcacaatgtgcacatgtaccctaaaacttaaagtataaaaaaaaaaaaaaacatagctaaagaaaaactgcatatgcaaatcataccgtattcatttttttatttaacttggggatggaatggggatagcatacattttatttgtacaatatttaacaatcacttatccaaggtggggttttatggggattttaagctttctgttaaatacttgcagaaaaaatagcaagtacgatttgacagtagtacaataacctgtgcccaaaacacaagaaatacagagtaaagcgaaaataactgcttaccaatattctgagaggtaacaaatgggatatgggttgagactgcataaaaaacgtactgctggttgaatatctgaggtaaatgatgttcaatcaagatgctacttgtatcattttgcccataaatggataaataattttatgcatatcataccaaatgttcctaaaaagtaatctttcaaaaaagtataaaagagaaactggaaagt

SEQ ID NO: 162726 - DNA, 6530 bp, Homo sapiens
  Payload ID: 12065
  Gene Symbol: ORC4
  Gene Name: origin recognition complex, subunit 4
  Uniprot ID: O43929
  ENST ID: ENST00000392857
  CDS Start-End: 109-1419
gtccgcagcggcaggtgaagtctagcagaggacgcggccaggcgattcggtgaagcgattcctgcaggcgttggttcccctctttgacctggatttgaatttgttgaaatgagcagtcgtaaatcaaagagtaacagcttaattcacacagagtgcctttcacaggtacaaagaattttacgtgaaagattttgtcgtcagagtccacatagtaacctatttggagtgcaagtacaatacaaacacttaagtgagctgctgaaaagaactgctctccatggagagagtaactctgtccttattatcggaccccgaggatcaggaaaaactatgttaataaatcatgctttgaaagaactcatggaaatagaagaagtgagtgaaaatgtattacaagttcacttaaatggactgctgcagatcaatgacaaaatcgccctaaaggaaatcacaaggcagttaaatctggaaaatgtagttggagataaagtttttggaagctttgctgaaaacctttcatttcttctggaagctttaaaaaaaggtgaccgaactagcagttgcccagtgatcttcatattagatgaatttgatctttttgctcatcataaaaaccaaacacttctctataatctttttgacatttctcagtctgcacagaccccaatagcagttattggtcttacatgtagattggatattttggaactcttagaaaaaagagtgaagtcaagattttctcaccggcagatacacttaatgaattcatttggttttccacagtatgttaaaatatttaaagaacagttatctctacctgcagagtttccagacaaggtttttgctgagaagtggaatgaaaatgttcagtatctctcagaagatagaagtgtgcaagaagtactacagaagcatttcaatatcagcaaaaacctgcggtcattacacatgctattgatgcttgctttaaatcgagtaacagcatcgcacccatttatgactgccgtagatctaatggaagcaagccaactgtgtagcatggactcgaaagcaaatattgtacatggtctatcagtcttggaaatctgtcttataatagcaatgaaacatttaaatgacatctatgaggaagagccatttaattttcaaatggtctataatgagtttcagaagtttgttcaaaggaaagcacattccgtttataattttgaaaaacctgttgtcatgaaggcttttgaacacttgcagcaattagaattaataaagcccatggaaagaacttcaggaaattcacagagagagtaccagctgatgaaactgcttttggataatactcaaattatgaatgctctgcagaaatatcccaactgtcctacagatgtgaggcagtgggcaacatcctcactaagctggttatgaatataaccagtgacttcaactttggcatttcattcatacttctgtagagaacggaaaactattgtccattaacatgatatgctaaacattctataaacattcttgtatttatgtgagacttgcccatctactgtcttggctgtgtcttgccttttaatcatgaacagttacatgatttataatttcactgattgagattactttgtaagtagctgttcagaagaataaaatatgactgttttagggactagaccatgtgcttttttaacacttatatatataatggtctatttgaagagctcacttcaacctaacagctagatgtctttacaaaccttaaaccaaaggagtaaaaaaaacaatggtaagcactgaagtataataagtaacctttggtacagcaggtttgctgcagtgtttttttctgtccacatgcaaattttggattctatcccagacccaggttttctagttcagaagactaaccagcttagtcagaagatggttccatggaagaaaaaggccaaggagtttgaagatttttcttctagacatctcaaaatgtggtactcataccatccacatcagaatcccttgtaggattttctaaaattacagattgttgagcctaccataggtcaaaaggactggaattttccttcttaacaagtatagtcatggcaccacgtaacattttggtcaatgacattgtataaagggtggtctcataagattataccatatttttactgtaccttttctatgtctaaatatacaaatgttttaccattgtgttacagttgcctacagtatgattacagtaacattctgtacagtgctatagctgaagagtaataggctaggctatctgtatagcctaagtgtgtaacaggctatatacatatcatcagggtctgtgtaagtatactctgtgatgttcatacagtgatgaaatcacccaaagacacatttctcagaacgtagccccatcatgaagtgacgtgactaccagagatttctggaaaagcactcccaaaagtaatgagatgtgtatggcaatgttaactgaacctgtttgtattaaaaagtaaatccctatgaggaatgtggaaatgtccgtcaaagcattgtcttttaagtaagttccaagatccatgaattaacagaggcatatatttaaaatgaaatttaatgagcacttagtgacttcatttgttcaagaatatttgatttcctattgtgtgcatgggaggtttacaaaagacagactgtccctatgcttgtgcagcttacaatctatttaactattagaggccctgtgagatgtaggcagttatttacagatgagaaaactaacacagcagtggcaatgctgggaatggccaacaggcttggaattcaactcagtttagcaccaaagccagtgctattaagacctgaagttcaacagtggattccttaccaaatagtttttaaagtatgctctaaggaacaatgttttaatgaaatcttggatacaaagtggaataaaaggtttctgagcataaagtagctcttcagtagttacaacctattcttttgcatacatagcctttccttccctgcaaaaagttaagcctgctaagtattcagatccctgtcatttacttctcagcagtctcattcaagctaaggcttgcatactcaatctgtgccgtagtctacacatttttaggggatatttcaccaaaatacttgacatggtaacatcactattatatactagaagcaagaattttacacttatgctctaagtgatccttttaaaaattttctgaactatttgaggaaagtattatttgtcttaaagggtaacagcctcatgaaatgacttgaggattccaatttcttattagcttaagatgtcacttaaaagctgacagccctcatctgtctcattggctacataagagctgcagaagatccatcaataaccaagtataaagaaagattttaagactaagtaccaattgaggtaaacatgaaaccgttataaagcaaattaaaaaaaaatacattaggaaaagttacacaaatgaagtgtacgcctattatattcccaaggcatttttgtggggaggaacagtgctgcttgttggcctttccatattccctcatacaaaaatgctaaaatctattcgcaagagttttgagctaacttcgtctcttaaattgctttaattgtcatcaataaaaacaaatatgaaaaaccctagtttaaaaagcggttcaagaataatgtaaacttatacatatagcttattttcttcatttactagaggaggaaaaatagaaccaaaaaatgcatgaactcctgcttttcaatctgattacctcaaactgaaaagcaggtgaaaggaggaatatttcagtgtgtttttacatctgaatccaagggatccaagtggcccagcagaaacggaattcttgttaaaatgactgattctcgtgcatgtgaaaggctctggggaatgaatacctgtttggtccaaacttactgtatcataatgctgtatatgttgaaaacgtaatacctgttaatgtcctaatgaatcacgttttgcagaaaacaccgtaagaaacacttcagtctttctgtagtttccatgcatatttcaccatggttcgcactctgatcctcatctggtttagaaagcaattcagtttctttcaaaccaccataacctaagtgctgccccatccttcacctttaccctagaaaatctgagaatccattggtgtgtactgtgtgacacaatgccaacaagcctctggtttctaatactggcaggaccaacacacatactttagtgggaatataatctgtttagacgataatagagggaaatgccataattaacaaatctcccttcactcaccactatcctcattcttgcagttgtcaaggtgtaagcctcactgtaagttacaaagctaccactcccctctttaagaacacatagcttaggattgccttggcgatgtgggctcttttttggttccatatgaacttaagtagttttttccaattctgtgaagaaagtcattggtagcttgatggggatggcattgaatctgtaaattaccttgggcagtatggccattttcacaatattgattcttcctacccaagagcatggaatgttcttccatttgtttgtatcctcttttatttccttgagcagtagcttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagatatacaatcatgtcgtctgcaaacggacaatttgacttcctcttttcctaattgaataccctttatttccttctcctgcctaattgccctggccagaacttccaacactatgttgaatacgagtggtgagagagggcatccctgtcttgtgccagttttcaaagggaatgcttccagtttttgcccattcagtatgatattggctgtgggtttgtcatagatagctcttattattttgaaatacaccccatcaatccctaatttattgagagtttttagcatgaagggttgttgaattttgtcaaaggctttttctgcatctattgagataatcatgtgttttttgtctttggctctgtttatatgctggattacattcattgatttgcgtatattgaaccagccttgcatcccagggatgaagcccacttgatcatggtggataagctttttgatgtgctgctggattcgttttgccagtattttatccagttagaatggcaatcattaaaaagtcaggaaacaacaggtgctggagaggatgtggagaaataggaacactttcacactgttggtgggactgtaaactagttcaaccattgtggaagtcagtgtggcgattcctcagggatctagaactggaaacaccatttgacccagccatcccattactgggtatatacccaaaggactataaatcatgctgctataaagacacatgcacacgtatgtttattgtggcattattcacaatagcaaagacttggaaccaacccaaatgtccaacaatgatagactggattaagaaaacgtggcacatatacaccatggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagatcacatggacacaggaaggggaatatcacactctggggactgttgtggggtggggggatgggggagggatagcattaggagatatacctaatgctagatgacgagttagtgggtgcagcgcaccagcatggcacatgtatacctatgtaactaacctgcacaatgtgcacatgtaccctaaaacttaaagtataaaaaaaaaaaaaaacatagctaaagaaaaactgcatatgcaaatcataccgtattcatttttttatttaacttggggatggaatggggatagcatacattttatttgtacaatatttaacaatcacttatccaaggtggggttttatggggattttaagctttctgttaaatacttgcagaaaaaatagcaagtacgatttgacagtagtacaataacctgtgcccaaaacacaagaaatacagagtaaagcgaaaataactgcttaccaatattctgagaggtaacaaatgggatatgggttgagactgcataaaaaacgtactgctggttgaatatctgaggtaaatgatgttcaatcaagatgctacttgtatcattttgcccataaatggataaataattttatgcatatcataccaaatgttcctaaaaagtaatctttcaaaaaagtataaaagagaaactggaaa

SEQ ID NO: 162727 - DNA, 647 bp, Homo sapiens
  Payload ID: 12065
  Gene Symbol: ORC4
  Gene Name: origin recognition complex, subunit 4
  ENST ID: ENST00000457954
  CDS Start-End: 264-647
ggtccgcagcggcaggtgaagtctagcagaggacgcggccaggcgattcggtgaagcgattcctgcaggcgttggttcccctctttgacctggaagcctggagccagaggacttttggtggctgaggccttagctacctggcttacacattaaggaggacacagatttgcttgctgtctgtctgtcaaggcctggctcagctaaggacctgttaacatttctagagaagaaaacagcattaccatggatttgaatttgttgaaatgagcagtcgtaaatcaaagagtaacagcttaattcacacagagtgcctttcacaggtacaaagaattttacgtgaaagattttgtcgtcagagtccacatagtaacctatttggagtgcaagtacaatacaaacacttaagtgagctgctgaaaagaactgctctccatggagagagtaactctgtccttattatcggaccccgaggatcaggaaaaactatgttaataaatcatgctttgaaagaactcatggaaatagaagaagtgagtgaaaatgtattacaagttcacttaaatggactgctgcagatcaatgacaaaatcgccctaaaggaaatcacaaggcagttaaatctggaaaatgtagttggagataaagtt

SEQ ID NO: 162728 - DNA, 552 bp, Homo sapiens
  Payload ID: 12065
  Gene Symbol: ORC4
  Gene Name: origin recognition complex, subunit 4
  ENST ID: ENST00000440042
  CDS Start-End: 171-552
gtgcgtgcgcggggcatgccgggagtggttgtgtacggtccgcagcggcaggtgaagtctagcagaggacgcggccaggcgattcggtgaagcgattcctgcaggcgttggttcccctctttgacctggtaaatgcaggcttttatgcgagaggatttgaatttgttgaaatgagcagtcgtaaatcaaagagtaacagcttaattcacacagagtgcctttcacaggtacaaagaattttacgtgaaagattttgtcgtcagagtccacatagtaacctatttggagtgcaagtacaatacaaacacttaagtgagctgctgaaaagaactgctctccatggagagagtaactctgtccttattatcggaccccgaggatcaggaaaaactatgttaataaatcatgctttgaaagaactcatggaaatagaagaagtgagtgaaaatgtattacaagttcacttaaatggactgctgcagatcaatgacaaaatcgccctaaaggaaatcacaaggcagttaaatctggaaaatgtagttggagataaag

SEQ ID NO: 162729 - DNA, 571 bp, Homo sapiens
  Payload ID: 12065
  Gene Symbol: ORC4
  Gene Name: origin recognition complex, subunit 4
  ENST ID: ENST00000416719
  CDS Start-End: 136-571
ggctgctcctgggtgtagtgagatgtctccagccagggccaagcagcagcagtagcagcagcagcagtagcagcagcagcagcaacagcagcagcagcagcaacagcagcagcaaagggatttgaatttgttgaaatgagcagtcgtaaatcaaagagtaacagcttaattcacacagagtgcctttcacaggtacaaagaattttacgtgaaagattttgtcgtcagagtccacatagtaacctatttggagtgcaagtacaatacaaacacttaagtgagctgctgaaaagaactgctctccatggagagagtaactctgtccttattatcggaccccgaggatcaggaaaaactatgttaataaatcatgctttgaaagaactcatggaaatagaagaagtgagtgaaaatgtattacaagttcacttaaatggactgctgcagatcaatgacaaaatcgccctaaaggaaatcacaaggcagttaaatctggaaaatgtagttggagataaagtttttggaagctttgctgaaaacctttcatttcttctggaagctttaaaaaaag

SEQ ID NO: 162730 - DNA, 6472 bp, Homo sapiens
  Payload ID: 12065
  Gene Symbol: ORC4
  Gene Name: origin recognition complex, subunit 4
  Uniprot ID: O43929
  ENST ID: ENST00000540442
  CDS Start-End: 271-1359
agtggttgtgtacggtccgcagcggcaggtgaagtctagcagaggacgcggccaggcgattcggtgaagcgattcctgcaggcgttggttcccctctttgacctggtacaaagaattttacgtgaaagattttgtcgtcagagtccacatagtaacctatttggagtgcaagtacaatacaaacacttaagtgagctgctgaaaagaactgctctccatggagagagtaactctgtccttattatcggaccccgaggatcaggaaaaactatgttaataaatcatgctttgaaagaactcatggaaatagaagaagtgagtgaaaatgtattacaagttcacttaaatggactgctgcagatcaatgacaaaatcgccctaaaggaaatcacaaggcagttaaatctggaaaatgtagttggagataaagtttttggaagctttgctgaaaacctttcatttcttctggaagctttaaaaaaaggtgaccgaactagcagttgcccagtgatcttcatattagatgaatttgatctttttgctcatcataaaaaccaaacacttctctataatctttttgacatttctcagtctgcacagaccccaatagcagttattggtcttacatgtagattggatattttggaactcttagaaaaaagagtgaagtcaagattttctcaccggcagatacacttaatgaattcatttggttttccacagtatgttaaaatatttaaagaacagttatctctacctgcagagtttccagacaaggtttttgctgagaagtggaatgaaaatgttcagtatctctcagaagatagaagtgtgcaagaagtactacagaagcatttcaatatcagcaaaaacctgcggtcattacacatgctattgatgcttgctttaaatcgagtaacagcatcgcacccatttatgactgccgtagatctaatggaagcaagccaactgtgtagcatggactcgaaagcaaatattgtacatggtctatcagtcttggaaatctgtcttataatagcaatgaaacatttaaatgacatctatgaggaagagccatttaattttcaaatggtctataatgagtttcagaagtttgttcaaaggaaagcacattccgtttataattttgaaaaacctgttgtcatgaaggcttttgaacacttgcagcaattagaattaataaagcccatggaaagaacttcaggaaattcacagagagagtaccagctgatgaaactgcttttggataatactcaaattatgaatgctctgcagaaatatcccaactgtcctacagatgtgaggcagtgggcaacatcctcactaagctggttatgaatataaccagtgacttcaactttggcatttcattcatacttctgtagagaacggaaaactattgtccattaacatgatatgctaaacattctataaacattcttgtatttatgtgagacttgcccatctactgtcttggctgtgtcttgccttttaatcatgaacagttacatgatttataatttcactgattgagattactttgtaagtagctgttcagaagaataaaatatgactgttttagggactagaccatgtgcttttttaacacttatatatataatggtctatttgaagagctcacttcaacctaacagctagatgtctttacaaaccttaaaccaaaggagtaaaaaaaacaatggtaagcactgaagtataataagtaacctttggtacagcaggtttgctgcagtgtttttttctgtccacatgcaaattttggattctatcccagacccaggttttctagttcagaagactaaccagcttagtcagaagatggttccatggaagaaaaaggccaaggagtttgaagatttttcttctagacatctcaaaatgtggtactcataccatccacatcagaatcccttgtaggattttctaaaattacagattgttgagcctaccataggtcaaaaggactggaattttccttcttaacaagtatagtcatggcaccacgtaacattttggtcaatgacattgtataaagggtggtctcataagattataccatatttttactgtaccttttctatgtctaaatatacaaatgttttaccattgtgttacagttgcctacagtatgattacagtaacattctgtacagtgctatagctgaagagtaataggctaggctatctgtatagcctaagtgtgtaacaggctatatacatatcatcagggtctgtgtaagtatactctgtgatgttcatacagtgatgaaatcacccaaagacacatttctcagaacgtagccccatcatgaagtgacgtgactaccagagatttctggaaaagcactcccaaaagtaatgagatgtgtatggcaatgttaactgaacctgtttgtattaaaaagtaaatccctatgaggaatgtggaaatgtccgtcaaagcattgtcttttaagtaagttccaagatccatgaattaacagaggcatatatttaaaatgaaatttaatgagcacttagtgacttcatttgttcaagaatatttgatttcctattgtgtgcatgggaggtttacaaaagacagactgtccctatgcttgtgcagcttacaatctatttaactattagaggccctgtgagatgtaggcagttatttacagatgagaaaactaacacagcagtggcaatgctgggaatggccaacaggcttggaattcaactcagtttagcaccaaagccagtgctattaagacctgaagttcaacagtggattccttaccaaatagtttttaaagtatgctctaaggaacaatgttttaatgaaatcttggatacaaagtggaataaaaggtttctgagcataaagtagctcttcagtagttacaacctattcttttgcatacatagcctttccttccctgcaaaaagttaagcctgctaagtattcagatccctgtcatttacttctcagcagtctcattcaagctaaggcttgcatactcaatctgtgccgtagtctacacatttttaggggatatttcaccaaaatacttgacatggtaacatcactattatatactagaagcaagaattttacacttatgctctaagtgatccttttaaaaattttctgaactatttgaggaaagtattatttgtcttaaagggtaacagcctcatgaaatgacttgaggattccaatttcttattagcttaagatgtcacttaaaagctgacagccctcatctgtctcattggctacataagagctgcagaagatccatcaataaccaagtataaagaaagattttaagactaagtaccaattgaggtaaacatgaaaccgttataaagcaaattaaaaaaaaatacattaggaaaagttacacaaatgaagtgtacgcctattatattcccaaggcatttttgtggggaggaacagtgctgcttgttggcctttccatattccctcatacaaaaatgctaaaatctattcgcaagagttttgagctaacttcgtctcttaaattgctttaattgtcatcaataaaaacaaatatgaaaaaccctagtttaaaaagcggttcaagaataatgtaaacttatacatatagcttattttcttcatttactagaggaggaaaaatagaaccaaaaaatgcatgaactcctgcttttcaatctgattacctcaaactgaaaagcaggtgaaaggaggaatatttcagtgtgtttttacatctgaatccaagggatccaagtggcccagcagaaacggaattcttgttaaaatgactgattctcgtgcatgtgaaaggctctggggaatgaatacctgtttggtccaaacttactgtatcataatgctgtatatgttgaaaacgtaatacctgttaatgtcctaatgaatcacgttttgcagaaaacaccgtaagaaacacttcagtctttctgtagtttccatgcatatttcaccatggttcgcactctgatcctcatctggtttagaaagcaattcagtttctttcaaaccaccataacctaagtgctgccccatccttcacctttaccctagaaaatctgagaatccattggtgtgtactgtgtgacacaatgccaacaagcctctggtttctaatactggcaggaccaacacacatactttagtgggaatataatctgtttagacgataatagagggaaatgccataattaacaaatctcccttcactcaccactatcctcattcttgcagttgtcaaggtgtaagcctcactgtaagttacaaagctaccactcccctctttaagaacacatagcttaggattgccttggcgatgtgggctcttttttggttccatatgaacttaagtagttttttccaattctgtgaagaaagtcattggtagcttgatggggatggcattgaatctgtaaattaccttgggcagtatggccattttcacaatattgattcttcctacccaagagcatggaatgttcttccatttgtttgtatcctcttttatttccttgagcagtagcttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagatatacaatcatgtcgtctgcaaacggacaatttgacttcctcttttcctaattgaataccctttatttccttctcctgcctaattgccctggccagaacttccaacactatgttgaatacgagtggtgagagagggcatccctgtcttgtgccagttttcaaagggaatgcttccagtttttgcccattcagtatgatattggctgtgggtttgtcatagatagctcttattattttgaaatacaccccatcaatccctaatttattgagagtttttagcatgaagggttgttgaattttgtcaaaggctttttctgcatctattgagataatcatgtgttttttgtctttggctctgtttatatgctggattacattcattgatttgcgtatattgaaccagccttgcatcccagggatgaagcccacttgatcatggtggataagctttttgatgtgctgctggattcgttttgccagtattttatccagttagaatggcaatcattaaaaagtcaggaaacaacaggtgctggagaggatgtggagaaataggaacactttcacactgttggtgggactgtaaactagttcaaccattgtggaagtcagtgtggcgattcctcagggatctagaactggaaacaccatttgacccagccatcccattactgggtatatacccaaaggactataaatcatgctgctataaagacacatgcacacgtatgtttattgtggcattattcacaatagcaaagacttggaaccaacccaaatgtccaacaatgatagactggattaagaaaacgtggcacatatacaccatggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagatcacatggacacaggaaggggaatatcacactctggggactgttgtggggtggggggatgggggagggatagcattaggagatatacctaatgctagatgacgagttagtgggtgcagcgcaccagcatggcacatgtatacctatgtaactaacctgcacaatgtgcacatgtaccctaaaacttaaagtataaaaaaaaaaaaaaacatagctaaagaaaaactgcatatgcaaatcataccgtattcatttttttatttaacttggggatggaatggggatagcatacattttatttgtacaatatttaacaatcacttatccaaggtggggttttatggggattttaagctttctgttaaatacttgcagaaaaaatagcaagtacgatttgacagtagtacaataacctgtgcccaaaacacaagaaatacagagtaaagcgaaaataactgcttaccaatattctgagaggtaacaaatgggatatgggttgagactgcataaaaaacgtactgctggttgaatatctgaggtaaatgatgttcaatcaagatgctacttgtatcattttgcccataaatggataaataattttatgcatatcataccaaatgttcctaaaaagtaatctttcaaaaaagtataaaagagaaactggaaagt

SEQ ID NO: 162731 - DNA, 6328 bp, Homo sapiens
  Payload ID: 12065
  Gene Symbol: ORC4
  Gene Name: origin recognition complex, subunit 4
  Uniprot ID: O43929
  ENST ID: ENST00000536575
  CDS Start-End: 157-1215
agtgcgtgcgcggggcatgccgggagtggttgtgtacggtccgcagcggcaggtgaagtctagcagaggacgcggccaggcgattcggtgaagcgattcctgcaggcgttggttcccctctttgacctgttaataaatcatgctttgaaagaactcatggaaatagaagaagtgagtgaaaatgtattacaagttcacttaaatggactgctgcagatcaatgacaaaatcgccctaaaggaaatcacaaggcagttaaatctggaaaatgtagttggagataaagtttttggaagctttgctgaaaacctttcatttcttctggaagctttaaaaaaaggtgaccgaactagcagttgcccagtgatcttcatattagatgaatttgatctttttgctcatcataaaaaccaaacacttctctataatctttttgacatttctcagtctgcacagaccccaatagcagttattggtcttacatgtagattggatattttggaactcttagaaaaaagagtgaagtcaagattttctcaccggcagatacacttaatgaattcatttggttttccacagtatgttaaaatatttaaagaacagttatctctacctgcagagtttccagacaaggtttttgctgagaagtggaatgaaaatgttcagtatctctcagaagatagaagtgtgcaagaagtactacagaagcatttcaatatcagcaaaaacctgcggtcattacacatgctattgatgcttgctttaaatcgagtaacagcatcgcacccatttatgactgccgtagatctaatggaagcaagccaactgtgtagcatggactcgaaagcaaatattgtacatggtctatcagtcttggaaatctgtcttataatagcaatgaaacatttaaatgacatctatgaggaagagccatttaattttcaaatggtctataatgagtttcagaagtttgttcaaaggaaagcacattccgtttataattttgaaaaacctgttgtcatgaaggcttttgaacacttgcagcaattagaattaataaagcccatggaaagaacttcaggaaattcacagagagagtaccagctgatgaaactgcttttggataatactcaaattatgaatgctctgcagaaatatcccaactgtcctacagatgtgaggcagtgggcaacatcctcactaagctggttatgaatataaccagtgacttcaactttggcatttcattcatacttctgtagagaacggaaaactattgtccattaacatgatatgctaaacattctataaacattcttgtatttatgtgagacttgcccatctactgtcttggctgtgtcttgccttttaatcatgaacagttacatgatttataatttcactgattgagattactttgtaagtagctgttcagaagaataaaatatgactgttttagggactagaccatgtgcttttttaacacttatatatataatggtctatttgaagagctcacttcaacctaacagctagatgtctttacaaaccttaaaccaaaggagtaaaaaaaacaatggtaagcactgaagtataataagtaacctttggtacagcaggtttgctgcagtgtttttttctgtccacatgcaaattttggattctatcccagacccaggttttctagttcagaagactaaccagcttagtcagaagatggttccatggaagaaaaaggccaaggagtttgaagatttttcttctagacatctcaaaatgtggtactcataccatccacatcagaatcccttgtaggattttctaaaattacagattgttgagcctaccataggtcaaaaggactggaattttccttcttaacaagtatagtcatggcaccacgtaacattttggtcaatgacattgtataaagggtggtctcataagattataccatatttttactgtaccttttctatgtctaaatatacaaatgttttaccattgtgttacagttgcctacagtatgattacagtaacattctgtacagtgctatagctgaagagtaataggctaggctatctgtatagcctaagtgtgtaacaggctatatacatatcatcagggtctgtgtaagtatactctgtgatgttcatacagtgatgaaatcacccaaagacacatttctcagaacgtagccccatcatgaagtgacgtgactaccagagatttctggaaaagcactcccaaaagtaatgagatgtgtatggcaatgttaactgaacctgtttgtattaaaaagtaaatccctatgaggaatgtggaaatgtccgtcaaagcattgtcttttaagtaagttccaagatccatgaattaacagaggcatatatttaaaatgaaatttaatgagcacttagtgacttcatttgttcaagaatatttgatttcctattgtgtgcatgggaggtttacaaaagacagactgtccctatgcttgtgcagcttacaatctatttaactattagaggccctgtgagatgtaggcagttatttacagatgagaaaactaacacagcagtggcaatgctgggaatggccaacaggcttggaattcaactcagtttagcaccaaagccagtgctattaagacctgaagttcaacagtggattccttaccaaatagtttttaaagtatgctctaaggaacaatgttttaatgaaatcttggatacaaagtggaataaaaggtttctgagcataaagtagctcttcagtagttacaacctattcttttgcatacatagcctttccttccctgcaaaaagttaagcctgctaagtattcagatccctgtcatttacttctcagcagtctcattcaagctaaggcttgcatactcaatctgtgccgtagtctacacatttttaggggatatttcaccaaaatacttgacatggtaacatcactattatatactagaagcaagaattttacacttatgctctaagtgatccttttaaaaattttctgaactatttgaggaaagtattatttgtcttaaagggtaacagcctcatgaaatgacttgaggattccaatttcttattagcttaagatgtcacttaaaagctgacagccctcatctgtctcattggctacataagagctgcagaagatccatcaataaccaagtataaagaaagattttaagactaagtaccaattgaggtaaacatgaaaccgttataaagcaaattaaaaaaaaatacattaggaaaagttacacaaatgaagtgtacgcctattatattcccaaggcatttttgtggggaggaacagtgctgcttgttggcctttccatattccctcatacaaaaatgctaaaatctattcgcaagagttttgagctaacttcgtctcttaaattgctttaattgtcatcaataaaaacaaatatgaaaaaccctagtttaaaaagcggttcaagaataatgtaaacttatacatatagcttattttcttcatttactagaggaggaaaaatagaaccaaaaaatgcatgaactcctgcttttcaatctgattacctcaaactgaaaagcaggtgaaaggaggaatatttcagtgtgtttttacatctgaatccaagggatccaagtggcccagcagaaacggaattcttgttaaaatgactgattctcgtgcatgtgaaaggctctggggaatgaatacctgtttggtccaaacttactgtatcataatgctgtatatgttgaaaacgtaatacctgttaatgtcctaatgaatcacgttttgcagaaaacaccgtaagaaacacttcagtctttctgtagtttccatgcatatttcaccatggttcgcactctgatcctcatctggtttagaaagcaattcagtttctttcaaaccaccataacctaagtgctgccccatccttcacctttaccctagaaaatctgagaatccattggtgtgtactgtgtgacacaatgccaacaagcctctggtttctaatactggcaggaccaacacacatactttagtgggaatataatctgtttagacgataatagagggaaatgccataattaacaaatctcccttcactcaccactatcctcattcttgcagttgtcaaggtgtaagcctcactgtaagttacaaagctaccactcccctctttaagaacacatagcttaggattgccttggcgatgtgggctcttttttggttccatatgaacttaagtagttttttccaattctgtgaagaaagtcattggtagcttgatggggatggcattgaatctgtaaattaccttgggcagtatggccattttcacaatattgattcttcctacccaagagcatggaatgttcttccatttgtttgtatcctcttttatttccttgagcagtagcttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagatatacaatcatgtcgtctgcaaacggacaatttgacttcctcttttcctaattgaataccctttatttccttctcctgcctaattgccctggccagaacttccaacactatgttgaatacgagtggtgagagagggcatccctgtcttgtgccagttttcaaagggaatgcttccagtttttgcccattcagtatgatattggctgtgggtttgtcatagatagctcttattattttgaaatacaccccatcaatccctaatttattgagagtttttagcatgaagggttgttgaattttgtcaaaggctttttctgcatctattgagataatcatgtgttttttgtctttggctctgtttatatgctggattacattcattgatttgcgtatattgaaccagccttgcatcccagggatgaagcccacttgatcatggtggataagctttttgatgtgctgctggattcgttttgccagtattttatccagttagaatggcaatcattaaaaagtcaggaaacaacaggtgctggagaggatgtggagaaataggaacactttcacactgttggtgggactgtaaactagttcaaccattgtggaagtcagtgtggcgattcctcagggatctagaactggaaacaccatttgacccagccatcccattactgggtatatacccaaaggactataaatcatgctgctataaagacacatgcacacgtatgtttattgtggcattattcacaatagcaaagacttggaaccaacccaaatgtccaacaatgatagactggattaagaaaacgtggcacatatacaccatggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagatcacatggacacaggaaggggaatatcacactctggggactgttgtggggtggggggatgggggagggatagcattaggagatatacctaatgctagatgacgagttagtgggtgcagcgcaccagcatggcacatgtatacctatgtaactaacctgcacaatgtgcacatgtaccctaaaacttaaagtataaaaaaaaaaaaaaacatagctaaagaaaaactgcatatgcaaatcataccgtattcatttttttatttaacttggggatggaatggggatagcatacattttatttgtacaatatttaacaatcacttatccaaggtggggttttatggggattttaagctttctgttaaatacttgcagaaaaaatagcaagtacgatttgacagtagtacaataacctgtgcccaaaacacaagaaatacagagtaaagcgaaaataactgcttaccaatattctgagaggtaacaaatgggatatgggttgagactgcataaaaaacgtactgctggttgaatatctgaggtaaatgatgttcaatcaagatgctacttgtatcattttgcccataaatggataaataattttatgcatatcataccaaatgttcctaaaaagtaatctttcaaaaaagtataaaagagaaactggaaagt

SEQ ID NO: 162732 - DNA, 6710 bp, Homo sapiens
  Payload ID: 12065
  Gene Symbol: ORC4
  Gene Name: origin recognition complex, subunit 4
  Uniprot ID: O43929
  ENST ID: ENST00000535373
  CDS Start-End: 287-1597
gcatgccgggagtggttgtgtacggtccgcagcggcaggtgaagtctagcagaggacgcggccaggcgattcggtgaagcgattcctgcaggcgttggttcccctctttgacctggaagcctggagccagaggacttttggtggctgaggccttagctacctggcttacacattaaggaggacacagatttgcttgctgtctgtctgtcaaggcctggctcagctaaggacctgttaacatttctagagaagaaaacagcattaccatggatttgaatttgttgaaatgagcagtcgtaaatcaaagagtaacagcttaattcacacagagtgcctttcacaggtacaaagaattttacgtgaaagattttgtcgtcagagtccacatagtaacctatttggagtgcaagtacaatacaaacacttaagtgagctgctgaaaagaactgctctccatggagagagtaactctgtccttattatcggaccccgaggatcaggaaaaactatgttaataaatcatgctttgaaagaactcatggaaatagaagaagtgagtgaaaatgtattacaagttcacttaaatggactgctgcagatcaatgacaaaatcgccctaaaggaaatcacaaggcagttaaatctggaaaatgtagttggagataaagtttttggaagctttgctgaaaacctttcatttcttctggaagctttaaaaaaaggtgaccgaactagcagttgcccagtgatcttcatattagatgaatttgatctttttgctcatcataaaaaccaaacacttctctataatctttttgacatttctcagtctgcacagaccccaatagcagttattggtcttacatgtagattggatattttggaactcttagaaaaaagagtgaagtcaagattttctcaccggcagatacacttaatgaattcatttggttttccacagtatgttaaaatatttaaagaacagttatctctacctgcagagtttccagacaaggtttttgctgagaagtggaatgaaaatgttcagtatctctcagaagatagaagtgtgcaagaagtactacagaagcatttcaatatcagcaaaaacctgcggtcattacacatgctattgatgcttgctttaaatcgagtaacagcatcgcacccatttatgactgccgtagatctaatggaagcaagccaactgtgtagcatggactcgaaagcaaatattgtacatggtctatcagtcttggaaatctgtcttataatagcaatgaaacatttaaatgacatctatgaggaagagccatttaattttcaaatggtctataatgagtttcagaagtttgttcaaaggaaagcacattccgtttataattttgaaaaacctgttgtcatgaaggcttttgaacacttgcagcaattagaattaataaagcccatggaaagaacttcaggaaattcacagagagagtaccagctgatgaaactgcttttggataatactcaaattatgaatgctctgcagaaatatcccaactgtcctacagatgtgaggcagtgggcaacatcctcactaagctggttatgaatataaccagtgacttcaactttggcatttcattcatacttctgtagagaacggaaaactattgtccattaacatgatatgctaaacattctataaacattcttgtatttatgtgagacttgcccatctactgtcttggctgtgtcttgccttttaatcatgaacagttacatgatttataatttcactgattgagattactttgtaagtagctgttcagaagaataaaatatgactgttttagggactagaccatgtgcttttttaacacttatatatataatggtctatttgaagagctcacttcaacctaacagctagatgtctttacaaaccttaaaccaaaggagtaaaaaaaacaatggtaagcactgaagtataataagtaacctttggtacagcaggtttgctgcagtgtttttttctgtccacatgcaaattttggattctatcccagacccaggttttctagttcagaagactaaccagcttagtcagaagatggttccatggaagaaaaaggccaaggagtttgaagatttttcttctagacatctcaaaatgtggtactcataccatccacatcagaatcccttgtaggattttctaaaattacagattgttgagcctaccataggtcaaaaggactggaattttccttcttaacaagtatagtcatggcaccacgtaacattttggtcaatgacattgtataaagggtggtctcataagattataccatatttttactgtaccttttctatgtctaaatatacaaatgttttaccattgtgttacagttgcctacagtatgattacagtaacattctgtacagtgctatagctgaagagtaataggctaggctatctgtatagcctaagtgtgtaacaggctatatacatatcatcagggtctgtgtaagtatactctgtgatgttcatacagtgatgaaatcacccaaagacacatttctcagaacgtagccccatcatgaagtgacgtgactaccagagatttctggaaaagcactcccaaaagtaatgagatgtgtatggcaatgttaactgaacctgtttgtattaaaaagtaaatccctatgaggaatgtggaaatgtccgtcaaagcattgtcttttaagtaagttccaagatccatgaattaacagaggcatatatttaaaatgaaatttaatgagcacttagtgacttcatttgttcaagaatatttgatttcctattgtgtgcatgggaggtttacaaaagacagactgtccctatgcttgtgcagcttacaatctatttaactattagaggccctgtgagatgtaggcagttatttacagatgagaaaactaacacagcagtggcaatgctgggaatggccaacaggcttggaattcaactcagtttagcaccaaagccagtgctattaagacctgaagttcaacagtggattccttaccaaatagtttttaaagtatgctctaaggaacaatgttttaatgaaatcttggatacaaagtggaataaaaggtttctgagcataaagtagctcttcagtagttacaacctattcttttgcatacatagcctttccttccctgcaaaaagttaagcctgctaagtattcagatccctgtcatttacttctcagcagtctcattcaagctaaggcttgcatactcaatctgtgccgtagtctacacatttttaggggatatttcaccaaaatacttgacatggtaacatcactattatatactagaagcaagaattttacacttatgctctaagtgatccttttaaaaattttctgaactatttgaggaaagtattatttgtcttaaagggtaacagcctcatgaaatgacttgaggattccaatttcttattagcttaagatgtcacttaaaagctgacagccctcatctgtctcattggctacataagagctgcagaagatccatcaataaccaagtataaagaaagattttaagactaagtaccaattgaggtaaacatgaaaccgttataaagcaaattaaaaaaaaatacattaggaaaagttacacaaatgaagtgtacgcctattatattcccaaggcatttttgtggggaggaacagtgctgcttgttggcctttccatattccctcatacaaaaatgctaaaatctattcgcaagagttttgagctaacttcgtctcttaaattgctttaattgtcatcaataaaaacaaatatgaaaaaccctagtttaaaaagcggttcaagaataatgtaaacttatacatatagcttattttcttcatttactagaggaggaaaaatagaaccaaaaaatgcatgaactcctgcttttcaatctgattacctcaaactgaaaagcaggtgaaaggaggaatatttcagtgtgtttttacatctgaatccaagggatccaagtggcccagcagaaacggaattcttgttaaaatgactgattctcgtgcatgtgaaaggctctggggaatgaatacctgtttggtccaaacttactgtatcataatgctgtatatgttgaaaacgtaatacctgttaatgtcctaatgaatcacgttttgcagaaaacaccgtaagaaacacttcagtctttctgtagtttccatgcatatttcaccatggttcgcactctgatcctcatctggtttagaaagcaattcagtttctttcaaaccaccataacctaagtgctgccccatccttcacctttaccctagaaaatctgagaatccattggtgtgtactgtgtgacacaatgccaacaagcctctggtttctaatactggcaggaccaacacacatactttagtgggaatataatctgtttagacgataatagagggaaatgccataattaacaaatctcccttcactcaccactatcctcattcttgcagttgtcaaggtgtaagcctcactgtaagttacaaagctaccactcccctctttaagaacacatagcttaggattgccttggcgatgtgggctcttttttggttccatatgaacttaagtagttttttccaattctgtgaagaaagtcattggtagcttgatggggatggcattgaatctgtaaattaccttgggcagtatggccattttcacaatattgattcttcctacccaagagcatggaatgttcttccatttgtttgtatcctcttttatttccttgagcagtagcttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagatatacaatcatgtcgtctgcaaacggacaatttgacttcctcttttcctaattgaataccctttatttccttctcctgcctaattgccctggccagaacttccaacactatgttgaatacgagtggtgagagagggcatccctgtcttgtgccagttttcaaagggaatgcttccagtttttgcccattcagtatgatattggctgtgggtttgtcatagatagctcttattattttgaaatacaccccatcaatccctaatttattgagagtttttagcatgaagggttgttgaattttgtcaaaggctttttctgcatctattgagataatcatgtgttttttgtctttggctctgtttatatgctggattacattcattgatttgcgtatattgaaccagccttgcatcccagggatgaagcccacttgatcatggtggataagctttttgatgtgctgctggattcgttttgccagtattttatccagttagaatggcaatcattaaaaagtcaggaaacaacaggtgctggagaggatgtggagaaataggaacactttcacactgttggtgggactgtaaactagttcaaccattgtggaagtcagtgtggcgattcctcagggatctagaactggaaacaccatttgacccagccatcccattactgggtatatacccaaaggactataaatcatgctgctataaagacacatgcacacgtatgtttattgtggcattattcacaatagcaaagacttggaaccaacccaaatgtccaacaatgatagactggattaagaaaacgtggcacatatacaccatggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagatcacatggacacaggaaggggaatatcacactctggggactgttgtggggtggggggatgggggagggatagcattaggagatatacctaatgctagatgacgagttagtgggtgcagcgcaccagcatggcacatgtatacctatgtaactaacctgcacaatgtgcacatgtaccctaaaacttaaagtataaaaaaaaaaaaaaacatagctaaagaaaaactgcatatgcaaatcataccgtattcatttttttatttaacttggggatggaatggggatagcatacattttatttgtacaatatttaacaatcacttatccaaggtggggttttatggggattttaagctttctgttaaatacttgcagaaaaaatagcaagtacgatttgacagtagtacaataacctgtgcccaaaacacaagaaatacagagtaaagcgaaaataactgcttaccaatattctgagaggtaacaaatgggatatgggttgagactgcataaaaaacgtactgctggttgaatatctgaggtaaatgatgttcaatcaagatgctacttgtatcattttgcccataaatggataaataattttatgcatatcataccaaatgttcctaaaaagtaatctttcaaaaaagtataaaagagaaactggaaagt

SEQ ID NO: 162733 - DNA, 1958 bp, Homo sapiens
  Payload ID: 12066
  Gene Symbol: ORC5
  Gene Name: origin recognition complex, subunit 5
  Uniprot ID: O43913
  ENST ID: ENST00000297431
  CDS Start-End: 144-1451
agcccggcagcgcaggctcctcccacgacgctgcgggtccggtttccggcgggagcgtgggccgccagactcgggagaggctccgtcttgtgcaagggtcctgtgggctggctgcactggcctctgcggtggtgcctgccagaatgccccacttggaaaacgtggtgctttgtcgcgagtctcaagtgtccatcttgcagtccttgtttggagagagacatcatttcagctttccatccatttttatttatggacatactgctagtggaaagacctatgtaacacaaacgttgttgaaaactttagagctcccacatgtgtttgtgaattgtgttgaatgctttacattgaggctgcttttggaacaaattttaaacaaattgaatcatcttagttcttcagaggatggatgttctactgaaataacctgtgaaacatttaatgactttgttcgcttgtttaaacaagtaaccacagctgaaaatcttaaagatcagactgtatatattgttctagataaagcagagtatctaagagatatggaagcaaatcttttgcctggatttcttagattacaagaattggctgacagaaatgtgactgttctctttctcagtgaaattgtttgggaaaagtttcgtccaaatactggatgctttgagccgtttgtcttatatttccctgattacagcataggcaaccttcaaaagatcctgtcccatgatcatcctccagagtattcagctgatttctatgctgcctacattaacattcttcttggagttttctacactgtttgtcgagatttgaaagagctcagacatctggcagtacttaattttcctaaatattgtgaacccgtggttaaaggagaagcaagtgaacgtgatactcgcaaactgtggagaaatattgaacctcatttgaagaaagctatgcagactgtttatctcagggaaatatcaagttcccagtgggaaaagctacagaaagatgacacagatccggggcaactgaaaggcctctcagcgcatactcatgtggaacttccatattactctaagttcattctaattgctgcataccttgcttcatacaatccagcaagaactgacaagaggttttttcttaagcatcatggaaaaatcaagaaaaccaactttctaaaaaaacacgaaaagacaagcaatcatctccttgggccaaaaccatttccactagacagattattagcaatattatatagtatcgtggacagcagagttgctccaacagcaaatattttttcccagattacctctctagtgacccttcagctgttaaccctggttggccatgacgatcagcttgatggaccaaaatacaaatgcacagtgtctctagacttcatcagagctattgcaaggacggtgaactttgacataataaaatacttgtatgatttcttgtgaaaacaagcttcaaagccatatggacactgtgacaatgactaagccaagctgtgttcatccagctacttagctggccaaggagaggagttctttggctctattggatttgtccaaacaggtgctggcccagcatggaatctgatgaaaatattctgattggtctgggtggatgtgagcagaagactatttaccagggaccctggagtatttggaagcaacgtgttaattataaacagcagggtttgagcacaatctgttctactcttaatgatgttatcttaacactgaaattgcctgaaacccatttacttaggactacattttgctctgtgaactatcccctgcgctttgaacgtgccagcagcccttgtttatatgcccattcttttcacttcctctccacaggagcctctgcagtcgcttgccaaagcagattttcctaaggccactgttttaaaagatcatagttgcaaaatataataaatacaagttctttttaaaatccaa

SEQ ID NO: 162734 - DNA, 567 bp, Homo sapiens
  Payload ID: 12066
  Gene Symbol: ORC5
  Gene Name: origin recognition complex, subunit 5
  ENST ID: ENST00000448563
  CDS Start-End: 97-297
ggcgggagcgtgggccgccagactcgggagaggctccgtcttgtgcaagggtcctgtgggctggctgcactggcctctgcggtggtgcctgccagaatgccccacttggaaaacgtggtgctttgtcgcgagtctcaagtgtccatcttgcagtccttgtttggagagagacatcatttcagctttccatccatttttatttatggacatactgctagtggaaagacctatgtaacacaaacgttgttgaaaactttagagggactcagacaggcacttagaatatgctgcctttaaaagtcatggatggtacaaatgccgtaagcaagacactattcataacagagatgttgtggacttttgttcttaaaggacagtaaaggagtgagagagaagtgagttagcaaatgctggtgaaactgtccccaactcccacatgtgtttgtgaattgtgttgaatgctttacattgaggctgcttttggaacaaattttaaacaaattgaatcatcttagttcttcagaggatggatgttctactgaaataacctgtgaaacatttaatgac

SEQ ID NO: 162735 - DNA, 2043 bp, Homo sapiens
  Payload ID: 12066
  Gene Symbol: ORC5
  Gene Name: origin recognition complex, subunit 5
  ENST ID: ENST00000422497
  CDS Start-End: 97-297
ggcgggagcgtgggccgccagactcgggagaggctccgtcttgtgcaagggtcctgtgggctggctgcactggcctctgcggtggtgcctgccagaatgccccacttggaaaacgtggtgctttgtcgcgagtctcaagtgtccatcttgcagtccttgtttggagagagacatcatttcagctttccatccatttttatttatggacatactgctagtggaaagacctatgtaacacaaacgttgttgaaaactttagagggactcagacaggcacttagaatatgctgcctttaaaagtcatggatggtacaaatgccgtaagcaagacactattcataacagagatgttgtggacttttgttcttaaaggacagtaaaggagtgagagagaactcccacatgtgtttgtgaattgtgttgaatgctttacattgaggctgcttttggaacaaattttaaacaaattgaatcatcttagttcttcagaggatggatgttctactgaaataacctgtgaaacatttaatgactttgttcgcttgtttaaacaagtaaccacagctgaaaatcttaaagatcagactgtatatattgttctagataaagcagagtatctaagagatatggaagcaaatcttttgcctggatttcttagattacaagaattggctgacagaaatgtgactgttctctttctcagtgaaattgtttgggaaaagtttcgtccaaatactggatgctttgagccgtttgtcttatatttccctgattacagcataggcaaccttcaaaagatcctgtcccatgatcatcctccagagtattcagctgatttctatgctgcctacattaacattcttcttggagttttctacactgtttgtcgagatttgaaagagctcagacatctggcagtacttaattttcctaaatattgtgaacccgtggttaaaggagaagcaagtgaacgtgatactcgcaaactgtggagaaatattgaacctcatttgaagaaagctatgcagactgtttatctcagggaaatatcaagttcccagtgggaaaagctacagaaagatgacacagatccggggcaactgaaaggcctctcagcgcatactcatgtggaacttccatattactctaagttcattctaattgctgcataccttgcttcatacaatccagcaagaactgacaagaggttttttcttaagcatcatggaaaaatcaagaaaaccaactttctaaaaaaacacgaaaagacaagcaatcatctccttgggccaaaaccatttccactagacagattattagcaatattatatagtatcgtggacagcagagttgctccaacagcaaatattttttcccagattacctctctagtgacccttcagctgttaaccctggttggccatgacgatcagcttgatggaccaaaatacaaatgcacagtgtctctagacttcatcagagctattgcaaggacggtgaactttgacataataaaatacttgtatgatttcttgtgaaaacaagcttcaaagccatatggacactgtgacaatgactaagccaagctgtgttcatccagctacttagctggccaaggagaggagttctttggctctattggatttgtccaaacaggtgctggcccagcatggaatctgatgaaaatattctgattggtctgggtggatgtgagcagaagactatttaccagggaccctggagtatttggaagcaacgtgttaattataaacagcagggtttgagcacaatctgttctactcttaatgatgttatcttaacactgaaattgcctgaaacccatttacttaggactacattttgctctgtgaactatcccctgcgctttgaacgtgccagcagcccttgtttatatgcccattcttttcacttcctctccacaggagcctctgcagtcgcttgccaaagcagattttcctaaggccactgttttaaaagatcatagttgcaaaatataataaatacaagttctttttaaaatcc

SEQ ID NO: 162736 - DNA, 1409 bp, Homo sapiens
  Payload ID: 12066
  Gene Symbol: ORC5
  Gene Name: origin recognition complex, subunit 5
  Uniprot ID: O43913
  ENST ID: ENST00000447452
  CDS Start-End: 54-1028
tgcaagggtcctgtgggctggctgcactggcctctgcggtggtgcctgccagaatgccccacttggaaaacgtggtgctttgtcgcgagtctcaagtgtccatcttgcagtccttgtttggagagagacatcatttcagctttccatccatttttatttatggacatactgctagtggaaagacctatgtaacacaaacgttgttgaaaactttagagctcccacatgtgtttgtgaattgtgttgaatgctttacattgaggctgcttttggaacaaattttaaacaaattgaatcatcttagttcttcagaggatggatgttctactgaaataacctgtgaaacatttaatgactttgttcgcttgtttaaacaagtaaccacagctgaaaatcttaaagatcagactgtatatattgttctagataaagcagagtatctaagagatatggaagcaaatcttttgcctggatttcttagattacaagaattggctgacagaaatgtgactgttctctttctcagtgaaattgtttgggaaaagtttcgtccaaatactggatgctttgagccgtttgtcttatatttccctgattacagcataggcaaccttcaaaagatcctgtcccatgatcatcctccagagtattcagctgatttctatgctgcctacattaacattcttcttggagttttctacactgtttgtcgagatttgaaagagctcagacatctggcagtacttaattttcctaaatattgtgaacccgtggttaaaggagaagcaagtgaacgtgatactcgcaaactgtggagaaatattgaacctcatttgaagaaagctatgcagactgtttatctcagggaaatatcaagttcccagtgggaaaagctacagaaagatgacacagatccggggcaactgaaaggtatcagaggaagtattgagacagttaccggagatacttcttcagctaattatcaagatactaaagttaatactaaagagcattcagtcaggaaatagtgttataaaagagaatttacttttcaagctataatgctattttgattaatgatttttctttaactgaagctctaatttaatgggaggaaataaaagtttgaataccagctttctattttctaaatattggattatatcatgaaaatcaagcagtttctatttctttaaatgcttttattaaagcaatctaattatgtgacagttttatctcattatgtttatatttcatgagttttatggaataaaatgtaattttatgttaatcggtttgggatatgcactttggtggttatgttttgaaaacattgtgcttttgtttaagaaaactactactttggattcatcccaaatattaaatagaactaattttacttaaaaaaa

SEQ ID NO: 162737 - DNA, 344 bp, Homo sapiens
  Payload ID: 12066
  Gene Symbol: ORC5
  Gene Name: origin recognition complex, subunit 5
  ENST ID: ENST00000626700
  CDS Start-End: 144-344
agcccggcagcgcaggctcctcccacgacgctgcgggtccggtttccggcgggagcgtgggccgccagactcgggagaggctccgtcttgtgcaagggtcctgtgggctggctgcactggcctctgcggtggtgcctgccagaatgccccacttggaaaacgtggtgctttgtcgcgagtctcaagtgtccatcttgcagtccttgtttggagagagacatcatttcagctttccatccatttttatttatggacatactgctagtggaaagacctatgtaacacaaacgttgttgaaaactttagagggactcagacaggcacttagaatatgctgcctttaa

SEQ ID NO: 162738 - DNA, 1628 bp, Homo sapiens
  Payload ID: 12067
  Gene Symbol: ORC6
  Gene Name: origin recognition complex, subunit 6
  Uniprot ID: Q9Y5N6
  ENST ID: ENST00000219097
  CDS Start-End: 61-819
gcgcgcgggtttcgttgacccgcggcgttcacgggaattgttcgctttagtgccggcgccatggggtcggagctgatcgggcgcctagccccgcgcctgggcctcgccgagcccgacatgctgaggaaagcagaggagtacttgcgcctgtcccgggtgaagtgtgtcggcctctccgcacgcaccacggagaccagcagtgcagtcatgtgcctggaccttgcagcttcctggatgaagtgccccttggacagggcttatttaattaaactttctggtttgaacaaggagacatatcagagctgtcttaaatcttttgagtgtttactgggcctgaattcaaatattggaataagagacctagctgtacagtttagctgtatagaagcagtgaacatggcttcaaagatactaaaaagctatgagtccagtcttccccagacacagcaagtggatcttgacttatccaggccacttttcacttctgctgcactgctttcagcatgcaagattctaaagctgaaagtggataaaaacaaaatggtagccacatccggtgtaaaaaaagctatatttgatcgactgtgtaaacaactagagaagattggacagcaggtcgacagagaacctggagatgtagctactccaccacggaagagaaagaagatagtggttgaagccccagcaaaggaaatggagaaggtagaggagatgccacataaaccacagaaagatgaagatctgacacaggattatgaagaatggaaaagaaaaattttggaaaatgctgccagtgctcaaaaggctacagcagagtgatttcagcttccaaactggtatacattccaaactgatagtacattgccatctccaggaagacttgacggctttgggattttgtttaaacttttataataaggatcctaagactgttgcctttaaatagcaaagcagcctacctggaggctaagtctgggcagtgggctggcccctggtgtgagcattagaccagccacagtgcctgattggtatagccttatgtgctttcctacaaaatggaattggaggccgggcgcagtggctcacgcctgtaatcccagcactttgggaggccaaggtgggtggatcacctgaggtcaggagctcgagaccagcctggccaacatggtgaaaccccatctctactaaaaatacaaaaattagccaggtgtgatggtgcatgcctgtaatcccagctcctcagtaggctgagacaggagcatcacttgaacgtgggaggcagaggttgcagtgagccgagattgcaccaccgcactccagcctgggtgacagagcgagacttatctcataaataaatagatagatactccagcctgggtgacagagcgagacttatagatagatagatagatagatggatagatagatagatagatagatagatagataaacggaattggagccattttgctttaagtgaatggcagtcccttgtcttattcagaatataaaattcagtctgaatggcatcttacagattttacttcaatttttgtgtacggtattttttatttgactaaatcaatatattgtacagcctaagttaataaatgttatttatatatgca

SEQ ID NO: 162739 - DNA, 681 bp, Homo sapiens
  Payload ID: 12067
  Gene Symbol: ORC6
  Gene Name: origin recognition complex, subunit 6
  ENST ID: ENST00000563599
  CDS Start-End: 64-174
tttgcgcgcgggtttcgttgacccgcggcgttcacgggaattgttcgctttagtgccggcgccatggggtcggagctgatcgggcgcctagccccgcgcctgggcctcgccgagcccgacatgctgagaccagcagtgcagtcatgtgcctggaccttgcagcttcctggatgaagtgccccttggacagggcttatttaattaaactttctggtttgaacaaggagacatatcagagctgtcttaaatcttttgagtgtttactgggcctgaattcaaatattggaataagagacctagctgtacagtttagctgtatagaagcagtgaacatggcttcaaagatactaaaaagctatgagtccagtcttccccagacacagcaagtggatcttgacttatccaggccacttttcacttctgctgcactgctttcagcatgcaagattctaaagctgaaagtggataaaaacaaaatggtagccacatccggtgtaaaaaaagctatatttgatcgactgtgtaaacaactagagaagattggacagcaggtcgacagagaacctggagatgtagctactccaccacggaagagaaagaagatagtggttgaagccccagcaaaggaaatggagaaggtagaggagatgccacataaaccacagaaagatgaagatctga

SEQ ID NO: 162740 - DNA, 1699 bp, Homo sapiens
  Payload ID: 12067
  Gene Symbol: ORC6
  Gene Name: origin recognition complex, subunit 6
  ENST ID: ENST00000566860
  CDS Start-End: 288-899
aagcatttgagcacagtgatgtttggagtcagtgctggttctgtcttcctctcaccagaggatatgaccttcattcccagccccagataaacgagccacaggagttaggcttagtgtgaagctaaccaggctgtattcattgtttaccaacgtgttgagcaaacttctgaataagttgtagcgaacacactgcccttttaaccaggaaagcagaggagtacttgcgcctgtcccgggtgaagtgtgtcggcctctccgcacgcaccacggagaccagcagtgcagtcatgtgcctggaccttgcagcttcctggatgaagtgccccttggacagggcttatttaattaaactttctggtttgaacaaggagacatatcagagctgtcttaaatcttttgagtgtttactgggcctgaattcaaatattggaataagagacctagctgtacagtttagctgtatagaagcagtgaacatggcttcaaagatactaaaaagctatgagtccagtcttccccagacacagcaagtggatcttgacttatccaggccacttttcacttctgctgcactgctttcagcatgcaagattctaaagctgaaagtggataaaaacaaaatggtagccacatccggtgtaaaaaaagctatatttgatcgactgtgtaaacaactagagaagattggacagcaggtcgacagagaacctggagatgtagctactccaccacggaagagaaagaagatagtggttgaagccccagcaaaggaaatggagaaggtagaggagatgccacataaaccacagaaagatgaagatctgacacaggattatgaagaatggaaaagaaaaattttggaaaatgctgccagtgctcaaaaggctacagcagagtgatttcagcttccaaactggtatacattccaaactgatagtacattgccatctccaggaagacttgacggctttgggattttgtttaaacttttataataaggatcctaagactgttgcctttaaatagcaaagcagcctacctggaggctaagtctgggcagtgggctggcccctggtgtgagcattagaccagccacagtgcctgattggtatagccttatgtgctttcctacaaaatggaattggaggccgggcgcagtggctcacgcctgtaatcccagcactttgggaggccaaggtgggtggatcacctgaggtcaggagctcgagaccagcctggccaacatggtgaaaccccatctctactaaaaatacaaaaattagccaggtgtgatggtgcatgcctgtaatcccagctcctcagtaggctgagacaggagcatcacttgaacgtgggaggcagaggttgcagtgagccgagattgcaccaccgcactccagcctgggtgacagagcgagacttatctcataaataaatagatagatactccagcctgggtgacagagcgagacttatagatagatagatagatagatggatagatagatagatagatagatagatagataaacggaattggagccattttgctttaagtgaatggcagtcccttgtcttattcagaatataaaattcagtctgaatggcatcttacagattttacttcaatttttgtgtacggtattttttatttgactaaatcaatatattgtacagcctaagttaataaatgttattt

SEQ ID NO: 162741 - DNA, 888 bp, Homo sapiens
  Payload ID: 12067
  Gene Symbol: ORC6
  Gene Name: origin recognition complex, subunit 6
  ENST ID: ENST00000568364
  CDS Start-End: 10-513
gccggcgccatggggtcggagctgatcgggcgcctagccccgcgcctgggcctcgccgagcccgacatgctgaggaaagcagaggagtacttgcgcctgtcccgggtgaagtgtgtcggcctctccgcacgcaccacggagaccagcagtgcagtcatgtgcctggaccttgcagcttcctggatgaagtgccccttggacagggcttatttaattaaactttctggtttgaacaaggagacatatcagagctgtcttaaatcttttgagtgtttactgggcctgaattcaaatattggaataagagacctagctgtacagtttagctgtatagaagcagtgaacatggcttcaaagatactaaaaagctatgagtccagtcttccccagacacagcaagtggatcttgacttatccaggccacttttcacttctgctgcactgctttcagcatgcaagagaacctggagatgtagctactccaccacggaagagaaagaagatagtggttgaagccccagcaaaggaaatggagaaggtagaggagatgccacataaaccacagaaagatgaagatctgacacaggattatgaagaatggaaaagaaaaattttggaaaatgctgccagtgctcaaaaggctacagcagagtgatttcagcttccaaactggtatacattccaaactgatagtacattgccatctccaggaagacttgacggctttgggattttgtttaaacttttataataaggatcctaagactgttgcctttaaatagcaaagcagcctacctggaggctaagtctgggcagtgggctggcccctggtgtgagcattagaccagccacagtgcctgattggtatagccttatgtgctttcctac

SEQ ID NO: 162742 - DNA, 2692 bp, Homo sapiens
  Payload ID: 12068
  Gene Symbol: ORMDL1
  Gene Name: ORMDL sphingolipid biosynthesis regulator 1
  Uniprot ID: Q9P0S3
  ENST ID: ENST00000325795
  CDS Start-End: 788-1249
attttaagcaattcttagtctcaagtaaacaccatcattaaaagaactgagaactattatcaattcttcctttggagtccatcttcaatggaaaggagaagggaaaaccttttttaaaaagaagaaagaaaactgaagtttttgatttgactagagaaatattcagaagactccttattttcacctagtttaatcacaaaattgagaaacaaacattatcccttgaccatgtaaattttacaccacattatgtcaacagcatgtaccttccacattgagtattcagaaagaagtgatctgaactctgaccattctttatggatacattaagtcaaatataagagtctgactacttgacacactggctcggtgagttctgctttttctttttaatataaatttattatgttggtaaatttagcttttggcttttcactttgctctcatgatataagaaaatgtaggttttctctttcagtttgaattttcctattcagtaaaacaacatgctagaaaacaaacttttggaaaggcattgtaactattttttcaaatagaaccataataacaagtcttgtcttaccctaaagtcaaatgctgaagattctttactgctgtcatcagcatctacaagtagcatattttggatggtgtttgtgtgctacttcaaagtaactaggaaaaaataatcctcgcaacacaggtaccttgtcatgtcagaattgggggtgttaggttgccagttgtatcagtgttgattcatttcattacttcctacagagcaaacatgaacgttggagttgcccacagtgaagtgaatccaaatacccgtgtcatgaacagccggggtatgtggctgacatatgcattgggagttggcttgcttcatattgtcttactcagcattcccttcttcagtgttcctgttgcttggactttaacaaatattatacataatctggggatgtacgtatttttgcatgcagtgaaaggaacacctttcgaaactcctgaccagggtaaagcaaggctcctaactcattgggaacaactggactatggagtacagtttacatcttcacggaagtttttcacaatttctccaataattctatattttctggcaagtttctatacgaagtatgatccaactcacttcatcctaaacacagcttctctcctgagtgtactaattcccaaaatgccacaactacatggtgttcggatctttggaattaataagtattgaaatgttttgaaactgaaaaaaaattttacagctactgaatttcttataaggaaggagtggttagtaaactgcactgtttctgtgataatgtgaaatgagaagtatttacattggagggccaatggctggtccttcaagtgctgttttgaagtgcagatttccattaaatgatgcctctgtttaatacacctggtacatttctgaagaggggctttataagcaggctgggcaggcccagcttataagttaaagggcatcacagtgagggtgtagtagataaattcaaggaaataagagatttgtaagaaactaggaccagcttaacttataatgaatgggcattgtgttaagaaaagaacatttccagtcattcagctgtggttatttaaagcagacttacatgtaaaccggaatcctctctatacaagtttattaaagattatttttattaccgtacatatttctcgttttatgtaagcggatgtatatcctcttgttttatacaagccagttcccacttatgagggtacttttttggttttgctggcttaatattgtgtattggtcaatgaggccatttttacatttattacgttacagagttcatggaggttcacctttgtgactgattggtgataaaagatagccaagtgtcttacaagcagcttctgagtcaagtgttctaattttggaacaaagcaggttttactgcttttccagacacaaggctgctaaaccaattaagaaaataattaatttctttcaagcaactaaaaaatatatggtaatttaaaggtgtctgcttatttggttgaacaatttaattgggaaagtttgtcatcatttgaaaaaggaaatataaaaggaacaaccatatagccaacctgtggtctggcagaaacaacgtctctagcaatagtaccaaagtaagtaatggagtcttttttttggcaggtctgcagtaaaagataacattttcttttcttagtcctcctgctctcaacccccatattttgcctttgaatacgtgggttttagtatatatagcccaaaatggtaactgtctccagaacagcaaccacattgaattcttgtgacttaggaaagcttcttatagttgctgacattaattgcaagaaataactatatactactttgagaagtaaacatgtcaaaaaaaacaaagttcagatatgggacaaaatttaaaaattcagtaacatttataaacagaattgaatgaaaagagttacagaccaacttaaacatcaattcgtgtcagtaaactgacttttgggggtaatgatcattgttttgtatctcaaaagtattgagtttagaaatcagttgtatgatactacctttgtatgtctgtcttttcccgtgtatttttaaataactggtgatctataatttaataaaatttttcgttggtgtaatatt

SEQ ID NO: 162743 - DNA, 1137 bp, Homo sapiens
  Payload ID: 12068
  Gene Symbol: ORMDL1
  Gene Name: ORMDL sphingolipid biosynthesis regulator 1
  Uniprot ID: Q9P0S3
  ENST ID: ENST00000392349
  CDS Start-End: 221-682
agcttccgcaagctgcgcagcgccgggcctgagggcgtgtatccgcggccgtagcagccgggctggtcctgctgcgagccggcggcccggagtggggcggcggcatgtaccttccacattgagtattcagaaagaagtgatctgaactctgaccattctttatggatacattaagtcaaatataagagtctgactacttgacacactggctcgagcaaacatgaacgttggagttgcccacagtgaagtgaatccaaatacccgtgtcatgaacagccggggtatgtggctgacatatgcattgggagttggcttgcttcatattgtcttactcagcattcccttcttcagtgttcctgttgcttggactttaacaaatattatacataatctggggatgtacgtatttttgcatgcagtgaaaggaacacctttcgaaactcctgaccagggtaaagcaaggctcctaactcattgggaacaactggactatggagtacagtttacatcttcacggaagtttttcacaatttctccaataattctatattttctggcaagtttctatacgaagtatgatccaactcacttcatcctaaacacagcttctctcctgagtgtactaattcccaaaatgccacaactacatggtgttcggatctttggaattaataagtattgaaatgttttgaaactgaaaaaaaattttacagctactgaatttcttataaggaaggagtggttagtaaactgcactgtttctgtgataatgtgaaatgagaagtatttacattggagggccaatggctggtccttcaagtgctgttttgaagtgcagatttccattaaatgatgcctctgtttaatacacctggtacatttctgaagaggggctttataagcaggctgggcaggcccagcttataagttaaagggcatcacagtgagggtgtagtagataaattcaaggaaataagagatttgtaagaaactaggaccagcttaacttataatgaatgggcattgtgttaagaaaagaacatttccagtcattcagctgtggttatttaaagcagacttacatgtaaaccggaatcctctctatacaagtttattaaagattatttttattaccgt

SEQ ID NO: 162744 - DNA, 2009 bp, Homo sapiens
  Payload ID: 12068
  Gene Symbol: ORMDL1
  Gene Name: ORMDL sphingolipid biosynthesis regulator 1
  Uniprot ID: Q9P0S3
  ENST ID: ENST00000392350
  CDS Start-End: 104-565
gcaagctgcgcagcgccgggcctgagggcgtgtatccgcggccgtagcagccgggctggtcctgctgcgagccggcggcccggagtggggcggcggagcaaacatgaacgttggagttgcccacagtgaagtgaatccaaatacccgtgtcatgaacagccggggtatgtggctgacatatgcattgggagttggcttgcttcatattgtcttactcagcattcccttcttcagtgttcctgttgcttggactttaacaaatattatacataatctggggatgtacgtatttttgcatgcagtgaaaggaacacctttcgaaactcctgaccagggtaaagcaaggctcctaactcattgggaacaactggactatggagtacagtttacatcttcacggaagtttttcacaatttctccaataattctatattttctggcaagtttctatacgaagtatgatccaactcacttcatcctaaacacagcttctctcctgagtgtactaattcccaaaatgccacaactacatggtgttcggatctttggaattaataagtattgaaatgttttgaaactgaaaaaaaattttacagctactgaatttcttataaggaaggagtggttagtaaactgcactgtttctgtgataatgtgaaatgagaagtatttacattggagggccaatggctggtccttcaagtgctgttttgaagtgcagatttccattaaatgatgcctctgtttaatacacctggtacatttctgaagaggggctttataagcaggctgggcaggcccagcttataagttaaagggcatcacagtgagggtgtagtagataaattcaaggaaataagagatttgtaagaaactaggaccagcttaacttataatgaatgggcattgtgttaagaaaagaacatttccagtcattcagctgtggttatttaaagcagacttacatgtaaaccggaatcctctctatacaagtttattaaagattatttttattaccgtacatatttctcgttttatgtaagcggatgtatatcctcttgttttatacaagccagttcccacttatgagggtacttttttggttttgctggcttaatattgtgtattggtcaatgaggccatttttacatttattacgttacagagttcatggaggttcacctttgtgactgattggtgataaaagatagccaagtgtcttacaagcagcttctgagtcaagtgttctaattttggaacaaagcaggttttactgcttttccagacacaaggctgctaaaccaattaagaaaataattaatttctttcaagcaactaaaaaatatatggtaatttaaaggtgtctgcttatttggttgaacaatttaattgggaaagtttgtcatcatttgaaaaaggaaatataaaaggaacaaccatatagccaacctgtggtctggcagaaacaacgtctctagcaatagtaccaaagtaagtaatggagtcttttttttggcaggtctgcagtaaaagataacattttcttttcttagtcctcctgctctcaacccccatattttgcctttgaatacgtgggttttagtatatatagcccaaaatggtaactgtctccagaacagcaaccacattgaattcttgtgacttaggaaagcttcttatagttgctgacattaattgcaagaaataactatatactactttgagaagtaaacatgtcaaaaaaaacaaagttcagatatgggacaaaatttaaaaattcagtaacatttataaacagaattgaatgaaaagagttacagaccaacttaaacatcaattcgtgtcagtaaactgacttttgggggtaatgatcattgttttgtatctcaaaagtattgagtttagaaatcagttgtatgatactacctttgtatgtctgtcttttcccgtgtatttttaaataactggtgatctataatttaataaaatttttcgttggtgtaatatta

SEQ ID NO: 162745 - DNA, 1223 bp, Homo sapiens
  Payload ID: 12068
  Gene Symbol: ORMDL1
  Gene Name: ORMDL sphingolipid biosynthesis regulator 1
  ENST ID: ENST00000409519
  CDS Start-End: 58-387
gcagccgggctggtcctgctgcgagccggcggcccggagtggggcggcggagcaaacatgaacgttggagttgcccacagtgaagtgaatccaaatacccgtgtcatgaacagccggggtatgtggctgacatatgcattgggagttggcttgcttcatattgtcttactcagcattcccttcttcagtgttcctgttgcttggactttaacaaatattatacataatctggggatgtacgtatttttgcatgcagtgaaaggaacacctttcgaaactcctgaccagggtaaagcaaggctcctaactcattgggaacaactggactatggagtacagtttacatcttcacggaagtttttcacaatttctccaataattctgtaagtggcagaaatttttaggtatgaggaggattggataagaggaagatatcttttcatcagattgaattggaattagaaacatattttgttgcaaacttctatcaataagtagcacctcggatagaacataaaatatagacaaaatttttaacaagttgataataaactaattttcacttcagtcagtacatatacggagacaatattacatgctaatcagtgcacctagacatttaggatatacaggtcaaatgtattccagctcccgtccttaggtttcatataaggacacaaaatacataatcatattctatattgcactgtcagattaatctccttaagcaatgatttagataatgagaagaatttcactggccacctatcctattaagatattcagactccttgggaaagagtatggtttcgaaaaaagtaggtcaggctttcattataggatagacctgggtggagtcctatatatatcactcagccagcttggtttgctcatatataaaattctagctagtgatacctaattcaatcctaatgctgtaagaaataaatgagataataatctacctggatagcatgtaacctgtatctggtatctaatttctttctcctatctgatgttctgggccttccagaaaatagttcttacctccttttcccttgatgtaaatattttatccccacccaactcctacctggccttctaagcagcatttcttgaatatttcatgtgtagtcctatttctgtctttgttcaaatcagttcaaatcatatctcctacctgaaatgcctcctccttttttccccagctttactgaggtata

SEQ ID NO: 162746 - DNA, 914 bp, Homo sapiens
  Payload ID: 12068
  Gene Symbol: ORMDL1
  Gene Name: ORMDL sphingolipid biosynthesis regulator 1
  ENST ID: ENST00000458355
  CDS Start-End: 589-914
cgcggccgtagcagccgggctggtcctgctgcgagccggcggcccggagtggggcggcggcatgtaccttccacattgagtattcagaaagaagtgatctgaactctgaccattctttatggatacattaagtcaaatataagagtctgactacttgacacactggctcggtgagttctgctttttctttttaatataaatttattatgttggtaaatttagcttttggcttttcactttgctctcatgatataagaaaatgtaggttttctctttcagtttgaattttcctattcagtaaaacaacatgctagaaaacaaacttttggaaaggcattgtaactattttttcaaatagaaccataataacaagtcttgtcttaccctaaagtcaaatgctgaagattctttactgctgtcatcagcatctacaagtagcatattttggatggtgtttgtgtgctacttcaaagtaactaggaaaaaataatcctcgcaacacaggtaccttgtcatgtcagaattgggggtgttaggttgccagttgtatcagtgttgattcatttcattacttcctacagagcaaacatgaacgttggagttgcccacagtgaagtgaatccaaatacccgtgtcatgaacagccggggtatgtggctgacatatgcattgggagttggcttgcttcatattgtcttactcagcattcccttcttcagtgttcctgttgcttggactttaacaaatattatacataatctggggatgtacgtatttttgcatgcagtgaaaggaacacctttcgaaactcctgaccagggtaaagcaaggctcctaactcattgggaacaactggactatggagtacagtttacatcttcacggaagtttttcacaatttctccaataattct

SEQ ID NO: 162747 - DNA, 893 bp, Homo sapiens
  Payload ID: 12068
  Gene Symbol: ORMDL1
  Gene Name: ORMDL sphingolipid biosynthesis regulator 1
  ENST ID: ENST00000442547
  CDS Start-End: 568-893
tatgggtctctagagcggaaggagcattatactccggaaacatttgctggaaggggttatgagaaattcctctctgtatgctaactccgtaatacaagcgtttgtgtattttaaaatcacagctgttccaaatataatctagcctcgttttccccctccgtcggatgataggtgttcttcaggacagttttattttaagcaattcttagtctcaagtaaacaccatcattaaaagaactgagaactattatcaattcttcctttggagtccatcttcaatggaaaggagaagggaaaaccttttttaaaaagaagaaagaaaactgaagtttttgatttgactagagaaatattcagaagactccttattttcacctagtttaatcacaaaattgagaaacaaacattatcccttgaccatgtaaattttacaccacattatgtcaacagcatgtaccttccacattgagtattcagaaagaagtgatctgaactctgaccattctttatggatacattaagtcaaatataagagtctgactacttgacacactggctcgagcaaacatgaacgttggagttgcccacagtgaagtgaatccaaatacccgtgtcatgaacagccggggtatgtggctgacatatgcattgggagttggcttgcttcatattgtcttactcagcattcccttcttcagtgttcctgttgcttggactttaacaaatattatacataatctggggatgtacgtatttttgcatgcagtgaaaggaacacctttcgaaactcctgaccagggtaaagcaaggctcctaactcattgggaacaactggactatggagtacagtttacatcttcacggaagtttttcacaatttctccaataattct

SEQ ID NO: 162748 - DNA, 2141 bp, Homo sapiens
  Payload ID: 12069
  Gene Symbol: ORMDL2
  Gene Name: ORMDL sphingolipid biosynthesis regulator 2
  Uniprot ID: Q53FV1
  ENST ID: ENST00000243045
  CDS Start-End: 196-657
actgtatcttgcgaacgacagaaatggcaaccaactgtgcttctgcattacagaccaccaaccaatgggtggtggcagcgctgattctgttcctccaataggaaaggggcagaaggagaggcgttacttcctggagacttcaggtgtggtagccggcgccgcgcccatagccggacggggatctgagctggcaggatgaatgtgggggtggcacacagcgaagtaaaccccaacacccgagtgatgaatagccgaggcatctggctggcctacatcatcttggtaggattgctgcatatggttctactcagcatccccttcttcagcattcctgttgtctggaccctgaccaacgtcatccataacctggctacgtatgtcttccttcatacggtgaaagggacaccctttgagactcctgaccaaggaaaggctcggctactgacacactgggagcaaatggactatgggctccagtttacctcttcccgcaagttcctcagcatctctcctattgtgctctatctcctggccagcttctataccaagtatgatgctgcgcacttcctcatcaacacagcctcattgctaagtgtactgctgccgaagttgccccagttccatggggttcgtgtctttggcatcaacaaatactgagggatgggttttgggacagctccatgggcatggggaaggcactgaaacagaggactataaaacatccttctcttattctccatactgtcttctacacctttaaagcctgagaactatacaacctttcccagactcccaagaagagaagagattggcaaatggggctcctgggcccagtcctgctagtggcaagtttctttgaatcaggaaggcaggtgaggtaagggccaaatcactctcctccatagcaggaagccatttgggcagcttctttggtgattacatctttccatatcttttacacttaccaccttccagctctgttttgctgtgtatttttcttacaataatttttttcagctatagctgcagtttaatcaggatgggtagagagctgtcctcataaggctgggggtgggaagatggaatactgacctaatgtataaaacttaaaacaattctccaatcccctctcctttggtccagtaggaggtgcccttcactctaagcttaacacttagtagggaagagattctcaaatgagaaaaagggctccggctatatgggcaacaaagagggaagatacaggttgccagttatacatttatagaaagataatcccctggctttaaatagtcatgtacatacaaatatgaacaaacttaaaaaaaaaatacaaacccttggatcacatgggggcttctgggaacccccgtattcttccccctcacccaagggcagtgggcatgaatctactttttaaaaatgattaattttggccatccttgcagaaaagagcctaaaattgggtgatttacccacaaagtgaaagtcgagggaaaattcagtttccagtctctgaactctatgcgataatctcctatcattagggctacatgctttcttgttctcttttaaatattatatcaggataaaggagagggctccctcctgaaatgggtcaagaaagaagatagacttgtagctttaaaagggtgggaaaaagtgtcatctgccctaaaagcaaatgacaagacaaaggcatacagaccccagggaaatacccagttcccacacctaaagggatacactgtccagcccaggtccaggccctaggttctttactctagctaccccctatttctttggtattgtcaaaagacaagattcaggccgggcacagtggcttatgcctgtaatccagcactttgggaggccaagacgggtggatcacctgagctcaggagttcgagaccagcctgggcaacatggtgaaaccccgtctctactaaaaatacaaaaaagaattagctgggccaggtgtggtggtgtgtgcctgtaatcccagctactcaggaggctgagatgggagaattgcttgaacccgggagacagaggttgcagtaagctgagatcacaccactgcactccagctgggcaacagagcaagactccatctcaaaaaataaaaagaaaaagattca

SEQ ID NO: 162749 - DNA, 760 bp, Homo sapiens
  Payload ID: 12069
  Gene Symbol: ORMDL2
  Gene Name: ORMDL sphingolipid biosynthesis regulator 2
  ENST ID: ENST00000552672
  CDS Start-End: 84-443
gttacttcctggagacttcaggtgtggtagccggcgccgcgcccatagccggacggggatctgagctggcaggattgctgcatatggttctactcagcatccccttcttcagcattcctgttgtctggaccctgaccaacgtcatccataacctggctacgtatgtcttccttcatacggtgaaagggacaccctttgagactcctgaccaaggaaaggctcggctactgacacactgggagcaaatggactatgggctccagtttacctcttcccgcaagttcctcagcatctctcctattgtgctctatctcctggccagcttctataccaagtatgatgctgcgcacttcctcatcaacacagcctcattgctaagtgtactgctgccgaagttgccccagttccatggggttcgtgtctttggcatcaacaaatactgagggatgggttttgggacagctccatgggcatggggaaggcactgaaacagaggactataaaacatccttctcttattctccatactgtcttctacacctttaaagcctgagaactatacaacctttcccagactcccaagaagagaagagattggcaaatggggctcctgggcccagtcctgctagtggcaagtttctttgaatcaggaaggcaggtgaggtaagggccaaatcactctcctccatagcaggaagccatttgggcagcttctttggtgattacatctttccatatcttttacacttaccaccttcca

SEQ ID NO: 162750 - DNA, 671 bp, Homo sapiens
  Payload ID: 12069
  Gene Symbol: ORMDL2
  Gene Name: ORMDL sphingolipid biosynthesis regulator 2
  Uniprot ID: Q53FV1
  ENST ID: ENST00000548974
  CDS Start-End: 92-553
atcagctttagagctaccacaattttaaagatccgagttcagataatcactgctgcccctggagtcagagccaaggctccacctttcgaggatgaatgtgggggtggcacacagcgaagtaaaccccaacacccgagtgatgaatagccgaggcatctggctggcctacatcatcttggtaggattgctgcatatggttctactcagcatccccttcttcagcattcctgttgtctggaccctgaccaacgtcatccataacctggctacgtatgtcttccttcatacggtgaaagggacaccctttgagactcctgaccaaggaaaggctcggctactgacacactgggagcaaatggactatgggctccagtttacctcttcccgcaagttcctcagcatctctcctattgtgctctatctcctggccagcttctataccaagtatgatgctgcgcacttcctcatcaacacagcctcattgctaagtgtactgctgccgaagttgccccagttccatggggttcgtgtctttggcatcaacaaatactgagggatgggttttgggacagctccatgggcatggggaaggcactgaaacagaggactataaaacatccttctcttattctccatactgtcttctacacctttaaagcctgagaactata

SEQ ID NO: 162751 - DNA, 438 bp, Homo sapiens
  Payload ID: 12069
  Gene Symbol: ORMDL2
  Gene Name: ORMDL sphingolipid biosynthesis regulator 2
  ENST ID: ENST00000550836
  CDS Start-End: 160-357
acttcctggagacttcaggtgtggtagccggcgccgcgcccatagccggacggggatctgagctggcaggctacgtatgtcttccttcatacggtgaaagggacaccctttgagactcctgaccaaggaaaggctcggctactgacacactgggagcaaatggactatgggctccagtttacctcttcccgcaagttcctcagcatctctcctattgtgctctatctcctggccagcttctataccaagtatgatgctgcgcacttcctcatcaacacagcctcattgctaagtgtactgctgccgaagttgccccagttccatggggttcgtgtctttggcatcaacaaatactgagggatgggttttgggacagctccatgggcatggggaaggcactgaaacagaggactataaaacatccttctcttattctcc

SEQ ID NO: 162752 - DNA, 2111 bp, Homo sapiens
  Payload ID: 12070
  Gene Symbol: ORMDL3
  Gene Name: ORMDL sphingolipid biosynthesis regulator 3
  Uniprot ID: Q8N138
  ENST ID: ENST00000304046
  CDS Start-End: 141-602
gattcggccggagctgccagcggggaggctgcagccgcgggttgttacagctgctggagcagcagcggcccccgctcccgggaaccgttcccgggccgttgatcttcggccccacacgaacagcagagaggggcagcaggatgaatgtgggcacagcgcacagcgaggtgaaccccaacacgcgggtgatgaacagccgtggcatctggctctcctacgtgctggccatcggtctcctccacatcgtgctgctgagcatcccgtttgtgagtgtccctgtcgtctggaccctcaccaacctcattcacaacatgggcatgtatatcttcctgcacacggtgaaggggacaccctttgagaccccggaccagggcaaggcgaggctgctaacccactgggagcagatggattatggggtccagttcacggcctctcggaagttcttgaccatcacacccatcgtgctgtacttcctcaccagcttctacactaagtacgaccagatccattttgtgctcaacaccgtgtccctgatgagcgtgcttatccccaagctgccccagctccacggagtccggatttttggaatcaataagtactgagagtgcagccccttcccctgcccagggtggcaggggaggggtagggtaaaaggcatgtgctgcaacactgaagacagaaagaagaagcctctggacactgccagagatgggggttgagcctctggcctaatttcccccctcgcttcccccagtagccaacttggagtagcttgtagtggggttggggtaggccccctgggctctgaccttttctgaattttttgatcttttccttttgctttttgaatagagactccatggagttggtcatggaatgggctgggctcctgggctgaacatggaccacgcagttgcgacaggaggccaggggaaaaacccctgctcacttgtttgccctcaggcagccaaagcactttaacccctgcatagggagcagagggcggtacggcttctggattgtttcactgtgattcctaggttttttcgatgccacgcagtgtgtgcttttgtgtatggaagcaagtgtgggatgggtctttgcctttctgggtagggagctgtctaatccaagtcccaggcttttggcagcttctctgcaacccaccgtgggtcctggttgggagtggggagggtcaggttggggaaagatggggtagagtgtagatggcttggttccagaggtgagggggccagggctgctgccatcctggcctggtggaggttggggagctgtaggagagctagtgagtcgagacttagaagaatggggccacatagcagcagaggactggtgtaagggagggaggggtagggacagaagctagacccaatctcctttgggatgtgggcagggagggaagcaggcttggagggttaatttacccacagaatgtgatagtaataggggagggaggctgctgtgggtttaactcctgggttggctgttgggtagacaggtggggaaaaggcccgtgagtcattgtaagcacaggtccaacttggccctgactcctgcgggggtatggggaagctgtgacagaaacgatgggtgctgtggtcctctgcaggccctcaccccttaacttcctcatacagactggcactgggcagggcctctcatgtggcagccacatgtggcgttgtgaggccaccccatgtggggtctgtggtgagagtcctgtaggatccctgctcaagcagcacagaggaaggggcaagacgtggcctgtaggcactgtctcagcctgcagagaagaaagtgaggccgggagcctgagcctgggctggagccttctcccctccccagttggactaggggcagtgttaattttgaaaaggtgtgggtccctgtgtcctcttccaggggtccaagggaacgggagaggtcactgggcctgttttctccctcctgaccctgcatctcccaccccgtgtatcatagggaactttcaccttaaaatctttctaagcaaagtgtgaataggatttttactccctttgtacagtattctgagaaacgcaaataaaagggcaacatgtttctgtttc

SEQ ID NO: 162753 - DNA, 2230 bp, Homo sapiens
  Payload ID: 12070
  Gene Symbol: ORMDL3
  Gene Name: ORMDL sphingolipid biosynthesis regulator 3
  Uniprot ID: Q8N138
  ENST ID: ENST00000394169
  CDS Start-End: 1496-1957
gtgctcctcttccagaagacaggaggtttgctgttgtgagggctgctctttcctgggggagggaatgggaagggctcacctggtggctgccctggtggtgctcagccttggcttgagtgtctggcatactggctgggcccggatatttgtatgtggagccaagagggtggggcgggaaggagggggaaagagctaccagcaaaaaagtggttaacacaacagagttgctgcaggctctggtttgaggcaggttatgaaaccacatcagggcccagcactaagcagccacctgccagctatggcagcagaagttttcggctcaactcctgtagacctagtcgacctctgccagcctcttctctctgtttctccccatctagggtaggggccagttggttgttttactaatggaagtgatatgtatccatagtcacacgaaagtctcaagagtgtttcctcattgccagtctttttgttagtttattgatctcttctttttcaggggtctctggtggtttcctgctctcagggcacctagtgtttaggcttcaggaagaagcttctgagggtgttggctaggacctaggtctaggcttttcctaggctcatcaagttttgttggctgccctgtgaaagccagaaaggcgtatggggtcctgtgatctgggattccccaaggcttttggcactcctggacaaatactaggaagggttagtggactttctataccagcacccctgtaggtgcgggttacagagaggtgatggggtggcagtttcaggtcagacttgggaagctctttccctctccttagtcagagttaagtccttcagagccctcacttgtcagccacatgccgccctcccctctcaggtggaggcttttgcgtagcagctgtcccaggggctgctagagtaactgaagccccaaggccctgggaagataaacaatctgagccagctctggctttctagatacttgaatttctgttaggctcaattatccagcctagtgggctgcgctgatgggtcccaggagcatctcttcaatcagaatgcgccccaggctggcgcacgggtgtttgcttgttgggatggcgtgttgtgggtcacattttctctgaggtctctaagcttggagctgtctgagaagaggaaacttgctcctgttatcctggaagtaaataactggcccctgaggactcagtctcctgtgcagggccctcagggatctggggacagccaaactctggataaggggcagatcattccaccccttccttctctacttccctctgctcactgtgggttgcggccacctcctggttcctcctgctgcaggactcctaccgttggtgctgggcaggggaaggcatggtgctaatatacacctggaaacaggtgctgagaggggagactgagtcctcctaagttggggtttggggagatccagaattgaaaaaatcagaggagaacagcagagaggggcagcaggatgaatgtgggcacagcgcacagcgaggtgaaccccaacacgcgggtgatgaacagccgtggcatctggctctcctacgtgctggccatcggtctcctccacatcgtgctgctgagcatcccgtttgtgagtgtccctgtcgtctggaccctcaccaacctcattcacaacatgggcatgtatatcttcctgcacacggtgaaggggacaccctttgagaccccggaccagggcaaggcgaggctgctaacccactgggagcagatggattatggggtccagttcacggcctctcggaagttcttgaccatcacacccatcgtgctgtacttcctcaccagcttctacactaagtacgaccagatccattttgtgctcaacaccgtgtccctgatgagcgtgcttatccccaagctgccccagctccacggagtccggatttttggaatcaataagtactgagagtgcagccccttcccctgcccagggtggcaggggaggggtagggtaaaaggcatgtgctgcaacactgaagacagaaagaagaagcctctggacactgccagagatgggggttgagcctctggcctaatttcccccctcgcttcccccagtagccaacttggagtagcttgtagtggggttggggtaggccccctgggctctgaccttttctgaattttttgatcttttccttttgctttttgaatagagactccatggagttggtcatgg

SEQ ID NO: 162754 - DNA, 561 bp, Homo sapiens
  Payload ID: 12070
  Gene Symbol: ORMDL3
  Gene Name: ORMDL sphingolipid biosynthesis regulator 3
  ENST ID: ENST00000581284
  CDS Start-End: 1-307
caacctcattcacaacatgggcatgtatatcttcctgcacacggtgaaggggacaccctttgagaccccggaccagggcaaggcgaggctgctaacccactgggagcagatggattatggggtccagttcacggcctctcggaagttcttgaccatcacacccatcgtgctgtacttcctcaccagcttctacactaagtacgaccagatccattttgtgctcaacaccgtgtccctgatgagcgtgcttatccccaagctgccccagctccacggagtccggatttttggaatcaataagtactgagagtgcagccccttcccctgcccagggtggcaggggaggggtagggtaaaagagactccatggagttggtcatggaatgggctgggctcctgggctgaacatggaccacgcagttgcgacaggaggccaggggaaaaacccctgctcacttgtttgccctcaggcagccaaagcactttaacccctgcatagggagcagagggcggtacggcttctggattgtttcactgtgattcctaggttttttcgatgcc

SEQ ID NO: 162755 - DNA, 572 bp, Homo sapiens
  Payload ID: 12070
  Gene Symbol: ORMDL3
  Gene Name: ORMDL sphingolipid biosynthesis regulator 3
  ENST ID: ENST00000584000
  CDS Start-End: 186-572
gataaacgtttggctgcctccagggctgggtgaacgcgtggagatggctgtggggtcccggaccggaccgggttccgagtgcgaagacccaggctggggaacagagcgggacccctccccccggccccgcacccgaggtctcactcagaaaaccccaacaacaaacagcagagaggggcagcaggatgaatgtgggcacagcgcacagcgaggtgaaccccaacacgcgggtgatgaacagccgtggcatctggctctcctacgtgctggccatcggtctcctccacatcgtgctgctgagcatcccgtttgtgagtgtccctgtcgtctggaccctcaccaacctcattcacaacatgggcatgtatatcttcctgcacacggtgaaggggacaccctttgagaccccggaccagggcaaggcgaggctgctaacccactgggagcagatggattatggggtccagttcacggcctctcggaagttcttgaccatcacacccatcgtgctgtacttcctcaccagcttctacactaagtacgaccagatccattttgtgctcaacaccgtg

SEQ ID NO: 162756 - DNA, 414 bp, Homo sapiens
  Payload ID: 12070
  Gene Symbol: ORMDL3
  Gene Name: ORMDL sphingolipid biosynthesis regulator 3
  Uniprot ID: Q8N138
  ENST ID: ENST00000584220
  CDS Start-End: 1-414
atgaatgtgggcacagcgcacagcgaggtgaaccccaacacgcgggtgatgaacagccgtggcatctggctctcctacgtgctggccatcggtctcctccacatcgtgctgctgagcatcccgtttggcatgtatatcttcctgcacacggtgaaggggacaccctttgagaccccggaccagggcaaggcgaggctgctaacccactgggagcagatggattatggggtccagttcacggcctctcggaagttcttgaccatcacacccatcgtgctgtacttcctcaccagcttctacactaagtacgaccagatccattttgtgctcaacaccgtgtccctgatgagcgtgcttatccccaagctgccccagctccacggagtccggatttttggaatcaataagtactga

SEQ ID NO: 162757 - DNA, 2106 bp, Homo sapiens
  Payload ID: 12070
  Gene Symbol: ORMDL3
  Gene Name: ORMDL sphingolipid biosynthesis regulator 3
  Uniprot ID: Q8N138
  ENST ID: ENST00000579695
  CDS Start-End: 136-597
gattcggccggagctgccagcggggaggctgcagccgcgggttgttacagctgctggagcagcagcggcccccgctcccgggaaccgttcccgggccgttgatcttcggccccacacgcagagaggggcagcaggatgaatgtgggcacagcgcacagcgaggtgaaccccaacacgcgggtgatgaacagccgtggcatctggctctcctacgtgctggccatcggtctcctccacatcgtgctgctgagcatcccgtttgtgagtgtccctgtcgtctggaccctcaccaacctcattcacaacatgggcatgtatatcttcctgcacacggtgaaggggacaccctttgagaccccggaccagggcaaggcgaggctgctaacccactgggagcagatggattatggggtccagttcacggcctctcggaagttcttgaccatcacacccatcgtgctgtacttcctcaccagcttctacactaagtacgaccagatccattttgtgctcaacaccgtgtccctgatgagcgtgcttatccccaagctgccccagctccacggagtccggatttttggaatcaataagtactgagagtgcagccccttcccctgcccagggtggcaggggaggggtagggtaaaaggcatgtgctgcaacactgaagacagaaagaagaagcctctggacactgccagagatgggggttgagcctctggcctaatttcccccctcgcttcccccagtagccaacttggagtagcttgtagtggggttggggtaggccccctgggctctgaccttttctgaattttttgatcttttccttttgctttttgaatagagactccatggagttggtcatggaatgggctgggctcctgggctgaacatggaccacgcagttgcgacaggaggccaggggaaaaacccctgctcacttgtttgccctcaggcagccaaagcactttaacccctgcatagggagcagagggcggtacggcttctggattgtttcactgtgattcctaggttttttcgatgccacgcagtgtgtgcttttgtgtatggaagcaagtgtgggatgggtctttgcctttctgggtagggagctgtctaatccaagtcccaggcttttggcagcttctctgcaacccaccgtgggtcctggttgggagtggggagggtcaggttggggaaagatggggtagagtgtagatggcttggttccagaggtgagggggccagggctgctgccatcctggcctggtggaggttggggagctgtaggagagctagtgagtcgagacttagaagaatggggccacatagcagcagaggactggtgtaagggagggaggggtagggacagaagctagacccaatctcctttgggatgtgggcagggagggaagcaggcttggagggttaatttacccacagaatgtgatagtaataggggagggaggctgctgtgggtttaactcctgggttggctgttgggtagacaggtggggaaaaggcccgtgagtcattgtaagcacaggtccaacttggccctgactcctgcgggggtatggggaagctgtgacagaaacgatgggtgctgtggtcctctgcaggccctcaccccttaacttcctcatacagactggcactgggcagggcctctcatgtggcagccacatgtggcgttgtgaggccaccccatgtggggtctgtggtgagagtcctgtaggatccctgctcaagcagcacagaggaaggggcaagacgtggcctgtaggcactgtctcagcctgcagagaagaaagtgaggccgggagcctgagcctgggctggagccttctcccctccccagttggactaggggcagtgttaattttgaaaaggtgtgggtccctgtgtcctcttccaggggtccaagggaacgggagaggtcactgggcctgttttctccctcctgaccctgcatctcccaccccgtgtatcatagggaactttcaccttaaaatctttctaagcaaagtgtgaataggatttttactccctttgtacagtattctgagaaacgcaaataaaagggcaacatgtttctgtttc

SEQ ID NO: 162758 - DNA, 2048 bp, Homo sapiens
  Payload ID: 12071
  Gene Symbol: OAT
  Gene Name: ornithine aminotransferase
  Uniprot ID: P04181
  ENST ID: ENST00000368845
  CDS Start-End: 94-1413
ctccggcgtcactgttgcgcttcatagacgccgcgtgtacccggttgtcctcaggcgctgtcagatctgtggtttttctacttgaaggacacaatgttttccaaactagcacatttgcagaggtttgctgtacttagtcgcggagttcattcttcagtggcttctgctacatctgttgcaactaaaaaaacagtccaaggccctccaacctctgatgacatttttgaaagggaatataagtatggtgcacacaactaccatcctttacctgtagccctggagagaggaaaaggtatttacttatgggatgtagaaggcagaaaatattttgacttcctgagttcttacagtgctgtcaaccaagggcattgtcaccccaagattgtgaatgctctgaagagtcaagtggacaaattgaccttaacatctagagctttctataataacgtacttggtgaatatgaggagtatattactaaacttttcaactaccacaaagttcttcctatgaatacaggagtggaggctggagagactgcctgtaaactagctcgtaagtggggctataccgtgaagggcattcagaaatacaaagcaaagattgtttttgcagctgggaacttctggggtaggacgttgtctgctatctccagttccacagacccaaccagttacgatggttttggaccatttatgccgggattcgacatcattccctataatgatctgcccgcactggagcgtgctcttcaggatccaaatgtggctgcgttcatggtagaaccaattcagggtgaagcaggcgttgttgttccggatccaggttacctaatgggagtgcgagagctctgcaccaggcaccaggttctctttattgctgatgaaatacagacaggattggccagaactggtagatggctggctgttgattatgaaaatgtcagacctgatatagtcctccttggaaaggccctttctgggggcttataccctgtgtctgcagtgctgtgtgatgatgacatcatgctgaccattaagccaggggagcatgggtccacatacggtggcaatccactaggctgccgagtggccatcgcagcccttgaggttttagaagaagaaaaccttgctgaaaatgcagacaaattgggcattatcttgagaaatgaactcatgaagctaccttctgatgttgtaactgccgtaagaggaaaaggattattaaacgctattgtcattaaagaaaccaaagattgggatgcttggaaggtgtgtctacgacttcgagataatggacttctggccaagccaacccatggcgacattatcaggtttgcgcctccgctggtgatcaaggaggatgagcttcgagagtccattgaaattattaacaagaccatcttgtctttctgagggtagccagctgttttcagtggtccctgggagccagctggagacaggtggtcctgtaaaagctttattcctaatgtgggcacattccactcccatgagtcttcaaaaactttttttttgaatatatttttttcagttgatacataatagaacaacgtttatgaacctgccgtttgctttgtaacgtaactaaataatgtaatggcatctatattcagttgaagtgttttgatgtgcatgtgtacttcctaaggtgaaatgcatctatatacagacagcctctaaatcaagtccttcagtataattgatatatgtttttataatttcctcactggtataagtgtttcatatttgaaaaagttatctctgggtattgcataaaaggcttcatcttataaagtgaaatcattgttattgaattttaggaaggattaatggttaagtgtatataaaatactaatattaagtaaacttcatattggccaacaccagggttgtattctatggatgtcattattttgaattaagaattagtgtttaacattcctaaattgttttgagtgcttgattataatttgtaaaaaatgtttattttcaatacttctttaaatttaaaataaagcttatatttcaaa

SEQ ID NO: 162759 - DNA, 1864 bp, Homo sapiens
  Payload ID: 12071
  Gene Symbol: OAT
  Gene Name: ornithine aminotransferase
  Uniprot ID: P04181
  ENST ID: ENST00000539214
  CDS Start-End: 320-1225
ttgggggcggggcagaatcagcctttaagttgcagtgactctccggcgtcactgttgcgcttcatagacgccgcgtgtacccggttgtcctcaggcgctgtcaggtatttacttatgggatgtagaaggcagaaaatattttgacttcctgagttcttacagtgctgtcaaccaagggcattgtcaccccaagattgtgaatgctctgaagagtcaagtggacaaattgaccttaacatctagagctttctataataacgtacttggtgaatatgaggagtatattactaaacttttcaactaccacaaagttcttcctatgaatacaggagtggaggctggagagactgcctgtaaactagctcgtaagtggggctataccgtgaagggcattcagaaatacaaagcaaagattgtttttgcagctgggaacttctggggtaggacgttgtctgctatctccagttccacagacccaaccagttacgatggttttggaccatttatgccgggattcgacatcattccctataatgatctgcccgcactggagcgtgctcttcaggatccaaatgtggctgcgttcatggtagaaccaattcagggtgaagcaggcgttgttgttccggatccaggttacctaatgggagtgcgagagctctgcaccaggcaccaggttctctttattgctgatgaaatacagacaggattggccagaactggtagatggctggctgttgattatgaaaatgtcagacctgatatagtcctccttggaaaggccctttctgggggcttataccctgtgtctgcagtgctgtgtgatgatgacatcatgctgaccattaagccaggggagcatgggtccacatacggtggcaatccactaggctgccgagtggccatcgcagcccttgaggttttagaagaagaaaaccttgctgaaaatgcagacaaattgggcattatcttgagaaatgaactcatgaagctaccttctgatgttgtaactgccgtaagaggaaaaggattattaaacgctattgtcattaaagaaaccaaagattgggatgcttggaaggtgtgtctacgacttcgagataatggacttctggccaagccaacccatggcgacattatcaggtttgcgcctccgctggtgatcaaggaggatgagcttcgagagtccattgaaattattaacaagaccatcttgtctttctgagggtagccagctgttttcagtggtccctgggagccagctggagacaggtggtcctgtaaaagctttattcctaatgtgggcacattccactcccatgagtcttcaaaaactttttttttgaatatatttttttcagttgatacataatagaacaacgtttatgaacctgccgtttgctttgtaacgtaactaaataatgtaatggcatctatattcagttgaagtgttttgatgtgcatgtgtacttcctaaggtgaaatgcatctatatacagacagcctctaaatcaagtccttcagtataattgatatatgtttttataatttcctcactggtataagtgtttcatatttgaaaaagttatctctgggtattgcataaaaggcttcatcttataaagtgaaatcattgttattgaattttaggaaggattaatggttaagtgtatataaaatactaatattaagtaaacttcatattggccaacaccagggttgtattctatggatgtcattattttgaattaagaattagtgtttaacattcctaaattgttttgagtgcttgattataatttgtaaaaaatgtttattttcaatacttctttaaatttaaaataaagcttatatttcaaatgtc

SEQ ID NO: 162760 - DNA, 1585 bp, Homo sapiens
  Payload ID: 12072
  Gene Symbol: OTC
  Gene Name: ornithine carbamoyltransferase
  Uniprot ID: P00480
  ENST ID: ENST00000039007
  CDS Start-End: 153-1217
aggggactttgataaggaagctgaagggtgatattacctttgctccctcactgcaactgaacacatttcttagtttttaggtggcccccgctggctaacttgctgtggagttttcaagggcatagaatcgtcctttacacaattaaaagaagatgctgtttaatctgaggatcctgttaaacaatgcagcttttagaaatggtcacaacttcatggttcgaaattttcggtgtggacaaccactacaaaataaagtgcagctgaagggccgtgaccttctcactctaaaaaactttaccggagaagaaattaaatatatgctatggctatcagcagatctgaaatttaggataaaacagaaaggagagtatttgcctttattgcaagggaagtccttaggcatgatttttgagaaaagaagtactcgaacaagattgtctacagaaacaggctttgcacttctgggaggacatccttgttttcttaccacacaagatattcatttgggtgtgaatgaaagtctcacggacacggcccgtgtattgtctagcatggcagatgcagtattggctcgagtgtataaacaatcagatttggacaccctggctaaagaagcatccatcccaattatcaatgggctgtcagatttgtaccatcctatccagatcctggctgattacctcacgctccaggaacactatagctctctgaaaggtcttaccctcagctggatcggggatgggaacaatatcctgcactccatcatgatgagcgcagcgaaattcggaatgcaccttcaggcagctactccaaagggttatgagccggatgctagtgtaaccaagttggcagagcagtatgccaaagagaatggtaccaagctgttgctgacaaatgatccattggaagcagcgcatggaggcaatgtattaattacagacacttggataagcatgggacaagaagaggagaagaaaaagcggctccaggctttccaaggttaccaggttacaatgaagactgctaaagttgctgcctctgactggacatttttacactgcttgcccagaaagccagaagaagtggatgatgaagtcttttattctcctcgatcactagtgttcccagaggcagaaaacagaaagtggacaatcatggctgtcatggtgtccctgctgacagattactcacctcagctccagaagcctaaattttgatgttgtgttacttgtcaagaaagaagcaatgttcttcagtaacagaatgagttggtttatggggaaaagagaagagaatctaaaaaataaacaaatccctaacacgtggtatgggtgaaccgtatgatatgctttgccattgtgaaactttccttaagcctttaatttaagtgctgatgcactgtaatacgtgcttaactttgcttaaactctctaattcccaatttctgagttacatttagatatcatattaattatcatatacatttacttcaacataaaatactgtgttcataatgtataatgtctaagccattaagtgtaatctatgcttattacctaaataaattatcacccatgctaattta

SEQ ID NO: 162761 - DNA, 2653 bp, Homo sapiens
  Payload ID: 12073
  Gene Symbol: ODC1
  Gene Name: ornithine decarboxylase 1
  Uniprot ID: P11926
  ENST ID: ENST00000234111
  CDS Start-End: 512-1897
gacgtcggcccgccggcgccccaccagctccgcgcgggcccgggttggccaccgccgggcccccgcccctcccccggcggtgtcccggccggaaccgatcgtggctggtttgagctggtgcgtctccatggcgacccgccggtgctataagtagggagcggcgtgccgtggggctttgtcagtccctcctgtagccgccgccgccgccgcccgccgcccctctgccagcagctccggcgccacctcgggccggcgtctccggcgggcgggagccaggcgctgacgggcgcggcgggggcggccgagcgctcctgcggctgcgactcaggctccggcgtctgcgcttccccatggggctggcctgcggcgcctgggcgctctgagattgtcactgctgttccaagggcacacgcagagggatttggaattcctggagagttgcctttgtgagaagctggaaatatttctttcaattccatctcttagttttccataggaacatcaagaaatcatgaacaactttggtaatgaagagtttgactgccacttcctcgatgaaggttttactgccaaggacattctggaccagaaaattaatgaagtttcttcttctgatgataaggatgccttctatgtggcagacctgggagacattctaaagaaacatctgaggtggttaaaagctctccctcgtgtcacccccttttatgcagtcaaatgtaatgatagcaaagccatcgtgaagacccttgctgctaccgggacaggatttgactgtgctagcaagactgaaatacagttggtgcagagtctgggggtgcctccagagaggattatctatgcaaatccttgtaaacaagtatctcaaattaagtatgctgctaataatggagtccagatgatgacttttgatagtgaagttgagttgatgaaagttgccagagcacatcccaaagcaaagttggttttgcggattgccactgatgattccaaagcagtctgtcgtctcagtgtgaaattcggtgccacgctcagaaccagcaggctccttttggaacgggcgaaagagctaaatatcgatgttgttggtgtcagcttccatgtaggaagcggctgtaccgatcctgagaccttcgtgcaggcaatctctgatgcccgctgtgtttttgacatgggggctgaggttggtttcagcatgtatctgcttgatattggcggtggctttcctggatctgaggatgtgaaacttaaatttgaagagatcaccggcgtaatcaacccagcgttggacaaatactttccgtcagactctggagtgagaatcatagctgagcccggcagatactatgttgcatcagctttcacgcttgcagttaatatcattgccaagaaaattgtattaaaggaacagacgggctctgatgacgaagatgagtcgagtgagcagacctttatgtattatgtgaatgatggcgtctatggatcatttaattgcatactctatgaccacgcacatgtaaagccccttctgcaaaagagacctaaaccagatgagaagtattattcatccagcatatggggaccaacatgtgatggcctcgatcggattgttgagcgctgtgacctgcctgaaatgcatgtgggtgattggatgctctttgaaaacatgggcgcttacactgttgctgctgcctctacgttcaatggcttccagaggccgacgatctactatgtgatgtcagggcctgcgtggcaactcatgcagcaattccagaaccccgacttcccacccgaagtagaggaacaggatgccagcaccctgcctgtgtcttgtgcctgggagagtgggatgaaacgccacagagcagcctgtgcttcggctagtattaatgtgtagatagcactctggtagctgttaactgcaagtttagcttgaattaagggatttggggggaccatgtaacttaattactgctagttttgaaatgtctttgtaagagtagggtcgccatgatgcagccatatggaagactaggatatgggtcacacttatctgtgttcctatggaaactatttgaatatttgttttatatggatttttattcactcttcagacacgctactcaagagtgcccctcagctgctgaacaagcatttgtagcttgtacaatggcagaatgggccaaaagcttagtgttgtgacctgtttttaaaataaagtatcttgaaataattaggcattgggacgtttttatggtgtgttcattccagacagttcacgaatcccgtatagctcgctctgattctcagagaacaatgagtgggtccacccacacacaggtaggaggacaggtgagacggaagccccatcctcccatgtggacggtgcacatctgctcagcccaccccacatgtccagagttggctgcaaactccttgtccagagcctctggtggtgggacctacttaagtctgacggacctgtcctgtccaggccagtgcccagggaaggtgtgggaggccctttgagcctggcctgcagagaccatccgtgtcccctcccaccttcatgcctgtgagaagttaggaatgtatacggtaccacatttggcagtcagcttattttaataaattcagcaacagcaagtcccta

SEQ ID NO: 162762 - DNA, 1943 bp, Homo sapiens
  Payload ID: 12073
  Gene Symbol: ODC1
  Gene Name: ornithine decarboxylase 1
  Uniprot ID: P11926
  ENST ID: ENST00000405333
  CDS Start-End: 435-1820
cctggcggccgcgcagcaggtgcaggggcgcagagcccgggctcgccttggtacagacgagcgggccccggccttggcgccttcagtttccttccagtttttattttcgctgtgtctacagagcagatgacaccaatttggaaacccgcgagagtgggtagagctaagatagtcttgctgtagtagctgtgatattagatgctcggccatgacttagaggtgtttatttaaggactgtgaatgactcggtgatttcggaaaagcttggcttagatgaacggacatacacaggggagacagccctaagattgtcactgctgttccaagggcacacgcagagggatttggaattcctggagagttgcctttgtgagaagctggaaatatttctttcaattccatctcttagttttccataggaacatcaagaaatcatgaacaactttggtaatgaagagtttgactgccacttcctcgatgaaggttttactgccaaggacattctggaccagaaaattaatgaagtttcttcttctgatgataaggatgccttctatgtggcagacctgggagacattctaaagaaacatctgaggtggttaaaagctctccctcgtgtcacccccttttatgcagtcaaatgtaatgatagcaaagccatcgtgaagacccttgctgctaccgggacaggatttgactgtgctagcaagactgaaatacagttggtgcagagtctgggggtgcctccagagaggattatctatgcaaatccttgtaaacaagtatctcaaattaagtatgctgctaataatggagtccagatgatgacttttgatagtgaagttgagttgatgaaagttgccagagcacatcccaaagcaaagttggttttgcggattgccactgatgattccaaagcagtctgtcgtctcagtgtgaaattcggtgccacgctcagaaccagcaggctccttttggaacgggcgaaagagctaaatatcgatgttgttggtgtcagcttccatgtaggaagcggctgtaccgatcctgagaccttcgtgcaggcaatctctgatgcccgctgtgtttttgacatgggggctgaggttggtttcagcatgtatctgcttgatattggcggtggctttcctggatctgaggatgtgaaacttaaatttgaagagatcaccggcgtaatcaacccagcgttggacaaatactttccgtcagactctggagtgagaatcatagctgagcccggcagatactatgttgcatcagctttcacgcttgcagttaatatcattgccaagaaaattgtattaaaggaacagacgggctctgatgacgaagatgagtcgagtgagcagacctttatgtattatgtgaatgatggcgtctatggatcatttaattgcatactctatgaccacgcacatgtaaagccccttctgcaaaagagacctaaaccagatgagaagtattattcatccagcatatggggaccaacatgtgatggcctcgatcggattgttgagcgctgtgacctgcctgaaatgcatgtgggtgattggatgctctttgaaaacatgggcgcttacactgttgctgctgcctctacgttcaatggcttccagaggccgacgatctactatgtgatgtcagggcctgcgtggcaactcatgcagcaattccagaaccccgacttcccacccgaagtagaggaacaggatgccagcaccctgcctgtgtcttgtgcctgggagagtgggatgaaacgccacagagcagcctgtgcttcggctagtattaatgtgtagatagcactctggtagctgttaactgcaagtttagcttgaattaagggatttggggggaccatgtaacttaattactgctagttttgaaatgtctttgtaagagtagggtcgccatgatgcagc

SEQ ID NO: 162763 - DNA, 494 bp, Homo sapiens
  Payload ID: 12073
  Gene Symbol: ODC1
  Gene Name: ornithine decarboxylase 1
  ENST ID: ENST00000443218
  CDS Start-End: 289-494
ggggaggccctggcggccgcgcagcaggtgcaggggcgcagagcccgggctcgccttggtacagacgagcgggccccggccttggcgccttcagtttccttccagtttttattttcgctgtgtctacagagcagatgacaccaatttggaaacccgcgagaattgtcactgctgttccaagggcacacgcagagggatttggaattcctggagagttgcctttgtgagaagctggaaatatttctttcaattccatctcttagttttccataggaacatcaagaaatcatgaacaactttggtaatgaagagtttgactgccacttcctcgatgaaggttttactgccaaggacattctggaccagaaaattaatgaagtttcttcttctgatgataaggatgccttctatgtggcagacctgggagacattctaaagaaacatctgaggtggttaaaagctctccctcgtgtcacccccttttatgcagtcaa

SEQ ID NO: 162764 - DNA, 969 bp, Homo sapiens
  Payload ID: 12074
  Gene Symbol: OAZ1
  Gene Name: ornithine decarboxylase antizyme 1
  ENST ID: ENST00000582888
  CDS Start-End: 66-746
gagcagcggcggcggcgcggagagacgcagcggaggttttcctggtttcggaccccagcggccggatggtgaaatcctccctgcagcggatcctcaatagccactgcttcgccagagagaaggaaggggataaacccagcgccaccatccacgccagccgcaccatgccgctcctaagcctgcacagccgcggcggcagcagcagtgagagggtctccctccactgctgtagtaacccgggtccggggcctcggtggtgctccgatgcccctcacccacccctgaagatcccaggtgggcgagggaatagtcagagggatcacaatctttcagctaacttattctactccgatgatcggctgaatgtaacagaggaactaacgtccaacgacaagacgaggattctcaacgtccagtccaggctcacagacgccaaacgcattaactggcgaacagtgctgagtggcggcagcctctacatcgagatcccgggcggcgcgctgcccgaggggagcaaggacagctttgcagttctcctggagttcgctgaggagcagctgcgagccgaccatgtcttcatttgcttccacaagaaccgcgaggacagagccgccttgctccgaaccttcagctttttgggctttgagattgtgagaccggggcatccccttgtccccaagagacccgacgcttgcttcatggcctacacgttcgagagagagtcttcgggagaggaggaggagtagggccgcctcggggctgggcatccggcccctggggccaccccttgtcagccgggtgggtaggaaccgtagactcgctcatctcgcctgggtttgtccgcatgttgtaatcgtgcaaataaacgctcactccgaattagcggtgtatttcttgaagtttaatattgtgtttgtgatactgaagtatttgctttaattctaaataaaaatttatattttacttttt

SEQ ID NO: 162765 - DNA, 1012 bp, Homo sapiens
  Payload ID: 12074
  Gene Symbol: OAZ1
  Gene Name: ornithine decarboxylase antizyme 1
  ENST ID: ENST00000590943
  CDS Start-End: 91-249
gcagaggcgccattttgcgaacggcgagcagcggcggcggcgcggagagacgcagcggaggttttcctggtttcggaccccagcggccggatggtgaaatcctccctgcagcggatcctcaatagccactgcttcgccagagagaaggaaggggataaacccagcgccaccatccacgccagccgcaccatgccgctcctaagcctgcacagccgcggcggcagcagcagtgagaggatgatcggctgaatgtaacagaggaactaacgtccaacgacaagacgaggattctcaacgtccagtccaggctcacagacgccaaacgcattaactggcgaacagtgctgagtggcggcagcctctacatcgagatcccgggcggcgcgctgcccgaggggagcaaggacagctttgcagttctcctggagttcgctgaggagcagctgcgagccgaccatgtcttcatttgcttccacaagaaccgcgaggacagagccgccttgctccgaaccttcagctttttgggctttgagattgtgagaccggggcatccccttgtccccaagagacccgacgcttgcttcatggcctacacgttcgagagagagtcttcgggagaggaggaggagtagggccgcctcggggctgggcatccggcccctggggccaccccttgtcagccgggtgggtaggaaccgtagactcgctcatctcgcctgggtttgtccgcatgttgtaatcgtgcaaataaacgctcactccgaattagcggtgtatttcttgaagtttaatattgtgtttgtgatactgaagtatttgctttaattctaaataaaaatttatattttacttttttattgctggtttaagatgattcagattatccttgtactttgaggagaagtttcttatttggagtcttttggaaacagtcttagtcttttaacttggaaagatgaggtattaatcccctccattgctctccaaaagccaataaagtgattacacccga

SEQ ID NO: 162766 - DNA, 780 bp, Homo sapiens
  Payload ID: 12074
  Gene Symbol: OAZ1
  Gene Name: ornithine decarboxylase antizyme 1
  ENST ID: ENST00000588673
  CDS Start-End: 155-780
gcacttttcggtcccggccgtcgagcgtgcgctgcgggagcggggagcgctttgcggtggacgagctcccgcgggtccctgttgcctcgatgtggcccctgcacgcgacggacctcgtgggccccgtttttcgcccctgagcgagtcggtctggatggcccgggacgcgccgggcgaggccgcgcacgtagacggcacccagggcttctccgcgggggccgccggggagctgggggtggcgcactccgacagcccggcagcgccctgggaagacccccgccgcttcccgggaagacgcgtcccgcttccgggggcgcgggtgccagctgcggttgtgggggagcccgcggggtctcggtcgagctttcccgactgcgtcccccgagttccagggtctccctccactgctgtagtaacccgggtccggggcctcggtggtgctcctgatgcccctcacccacccctgaagatcccaggtgggcgagggaatagtcagagggatcacaatctttcagctaacttattctactccgatgatcggctgaatgtaacagaggaactaacgtccaacgacaagacgaggattctcaacgtccagtccaggctcacagacgccaaacgcattaactggcgaacagtgctgagtggcggcagcctctacatcgagatcccgggcggcgcgctgcccgaggggagcaaggacagctttgcagttctcctggagttcgctgaggagcagctgcgagccgaccatgtcttcatttgcttccacaagaaccg

SEQ ID NO: 162767 - DNA, 1148 bp, Homo sapiens
  Payload ID: 12074
  Gene Symbol: OAZ1
  Gene Name: ornithine decarboxylase antizyme 1
  Uniprot ID: P54368
  ENST ID: ENST00000602676
  CDS Start-End: 80-766
attttgcgaacggcgagcagcggcggcggcgcggagagacgcagcggaggttttcctggtttcggaccccagcggccggatggtgaaatcctccctgcagcggatcctcaatagccactgcttcgccagagagaaggaaggggataaacccagcgccaccatccacgccagccgcaccatgccgctcctaagcctgcacagccgcggcggcagcagcagtgagagttccagggtctccctccactgctgtagtaacccgggtccggggcctcggtggtgctccgatgcccctcacccacccctgaagatcccaggtgggcgagggaatagtcagagggatcacaatctttcagctaacttattctactccgatgatcggctgaatgtaacagaggaactaacgtccaacgacaagacgaggattctcaacgtccagtccaggctcacagacgccaaacgcattaactggcgaacagtgctgagtggcggcagcctctacatcgagatcccgggcggcgcgctgcccgaggggagcaaggacagctttgcagttctcctggagttcgctgaggagcagctgcgagccgaccatgtcttcatttgcttccacaagaaccgcgaggacagagccgccttgctccgaaccttcagctttttgggctttgagattgtgagaccggggcatccccttgtccccaagagacccgacgcttgcttcatggcctacacgttcgagagagagtcttcgggagaggaggaggagtagggccgcctcggggctgggcatccggcccctggggccaccccttgtcagccgggtgggtaggaaccgtagactcgctcatctcgcctgggtttgtccgcatgttgtaatcgtgcaaataaacgctcactccgaattagcggtgtatttcttgaagtttaatattgtgtttgtgatactgaagtatttgctttaattctaaataaaaatttatattttacttttttattgctggtttaagatgattcagattatccttgtactttgaggagaagtttcttatttggagtcttttggaaacagtcttagtcttttaacttggaaagatgaggtattaatcccctccattgctctccaaaagccaataaagtgattacacccgatg

SEQ ID NO: 162768 - DNA, 576 bp, Homo sapiens
  Payload ID: 12075
  Gene Symbol: OAZ2
  Gene Name: ornithine decarboxylase antizyme 2
  ENST ID: ENST00000559912
  CDS Start-End: 168-576
agttggaggcaggcgctcgctgaggcaaaaggaggcgctcggcccgcggcctgacagggacttagcccgcagagatcgaccccgcgcgcgtgaccccacacccacccactcatccatctatccactccctgcgccgcctcctcccaccctgagcagagccgccgaggatgataaacacccaggacagtagtattttgcctttgagtaactgtccccagctccagtgctgcaggcacattgttccagggcctctgtggtgctccgatgcccctcacccactgtcgaagatccccggtgggcgagggggcggcagggatccttctctctcagctctaatatataagggaaggaaaagaacatggtgttgggggaaagcgtgggctttcgagtcagggagacctgggtttgaatctcatctctgccattcactgtctttggagccttgggacgagaagctcactgtgacccaggacctccctgtgaatgatggaaaacctcacatcgtccacttccagtatgaggtcaccgaggtgaaggtctcttcttgggatgcagtcctgtccagccagagcctgt

SEQ ID NO: 162769 - DNA, 1744 bp, Homo sapiens
  Payload ID: 12075
  Gene Symbol: OAZ2
  Gene Name: ornithine decarboxylase antizyme 2
  ENST ID: ENST00000560258
  CDS Start-End: 161-550
ggcaggcgctcgctgaggcaaaaggaggcgctcggcccgcggcctgacagggacttagcccgcagagatcgaccccgcgcgcgtgaccccacacccacccactcatccatctatccactccctgcgccgcctcctcccaccctgagcagagccgccgaggatgataaacacccaggacagtagtattttgcctttgagtaactgtccccagctccagtgctgcaggcacattgttccagggcctctgtggtgctccgatgcccctcacccactgtcgaagatccccggtgggcgagggggcggcagggatccttctctctcagctctaatatataaggacgagaagctcactgtgacccaggacctccctgtgaatgatggaaaacctcacatcgtccacttccagtatgaggtcaccgaggtgaaggtctcttcttgggatgcagtcctgtccagccagagcctgtttgtagaaatcccagatggattattagctgatgggagcaaagaaggctccactcctgaagaccttcagcttcttgggctttgagattgtacgtccaggccatccctgtgtcccctctcggccagatgtgatgttcatggtttatcccctggaccagaacttgtccgatgaggactaatagtcatagaggatgctttacccaagagccacagtgggggaagaggggaagttaggcagccctgggacagacgagagggctcctcgctgtctagggaaggacactgaggggctcagggtgagggttgcctattgtgttctcggagttgactcgttgaaattgttttccataaagaacagtataaacatattattcacatgtaatcaccaatagtaaatgaagatgtttatgaactggcattagaagctttctaaactgcgctgtgtgatgtgttctatctagcctaggggaggacattgcctagagggggagggactgtctgggttcaggggcatggcctggagggctggtgggcagcactgtcaggctcaggtttccctgctgttggctttctgttttggttattaagacttgtgtattttctttctttgcttcctgtcaccccaggggctcctgagtataggcttttcagtccctgggcagtgtccttgagttgttttttgacactcttacctgggcttctctgtgtgcatttgcgtctggcctggagtaagcaggtccgacccctccttctttacagcttagtgttattctggcatttggttaagctggcttaatctgtttaatgttatcagtacattttaaataggggcattgaaatttactcccaccaccagggcttttttgggggatgcctgggcctttaaaacactagccaaactctaattaattctcaaatcactgccaggagttcttgctcctggctgcaggcccaggccccaaggtctccttcttggggtcacaaacagcagtaaggaagaggaatatatagcaactcagggcctgggaattgtggggcaatccgttcttagggactggatacttctggctggctgagtatagtactagctgcctccccaccaggttccgagtagtgtctgagactctgctctgcagggcctagggtagcgctgggagtgtagaagtggcctgcccttaactgttttcactaaacagctttttctaaggggagagcaagggggagagatctagattgggtgagggggacggggatgtcagggaggcaagtgtgttgtgtt

SEQ ID NO: 162770 - DNA, 1934 bp, Homo sapiens
  Payload ID: 12075
  Gene Symbol: OAZ2
  Gene Name: ornithine decarboxylase antizyme 2
  Uniprot ID: O95190
  ENST ID: ENST00000326005
  CDS Start-End: 234-803
atgcagatgaggcactcgggggcggggcggcggcggcggcggcggcggtggcggccggggagggtcagttggaggcaggcgctcgctgaggcaaaaggaggcgctcggcccgcggcctgacagggacttagcccgcagagatcgaccccgcgcgcgtgaccccacacccacccactcatccatctatccactccctgcgccgcctcctcccaccctgagcagagccgccgaggatgataaacacccaggacagtagtattttgcctttgagtaactgtccccagctccagtgctgcaggcacattgttccagggcctctgtggtgctccgatgcccctcacccactgtcgaagatccccggtgggcgagggggcggcagggatccttctctctcagctctaatatataaggacgagaagctcactgtgacccaggacctccctgtgaatgatggaaaacctcacatcgtccacttccagtatgaggtcaccgaggtgaaggtctcttcttgggatgcagtcctgtccagccagagcctgtttgtagaaatcccagatggattattagctgatgggagcaaagaaggattgttagcactgctagagtttgctgaagagaagatgaaagtgaactatgtcttcatctgcttcaggaagggccgagaagacagagctccactcctgaagaccttcagcttcttgggctttgagattgtacgtccaggccatccctgtgtcccctctcggccagatgtgatgttcatggtttatcccctggaccagaacttgtccgatgaggactaatagtcatagaggatgctttacccaagagccacagtgggggaagaggggaagttaggcagccctgggacagacgagagggctcctcgctgtctagggaaggacactgaggggctcagggtgagggttgcctattgtgttctcggagttgactcgttgaaattgttttccataaagaacagtataaacatattattcacatgtaatcaccaatagtaaatgaagatgtttatgaactggcattagaagctttctaaactgcgctgtgtgatgtgttctatctagcctaggggaggacattgcctagagggggagggactgtctgggttcaggggcatggcctggagggctggtgggcagcactgtcaggctcaggtttccctgctgttggctttctgttttggttattaagacttgtgtattttctttctttgcttcctgtcaccccaggggctcctgagtataggcttttcagtccctgggcagtgtccttgagttgttttttgacactcttacctgggcttctctgtgtgcatttgcgtctggcctggagtaagcaggtccgacccctccttctttacagcttagtgttattctggcatttggttaagctggcttaatctgtttaatgttatcagtacattttaaataggggcattgaaatttactcccaccaccagggcttttttgggggatgcctgggcctttaaaacactagccaaactctaattaattctcaaatcactgccaggagttcttgctcctggctgcaggcccaggccccaaggtctccttcttggggtcacaaacagcagtaaggaagaggaatatatagcaactcagggcctgggaattgtggggcaatccgttcttagggactggatacttctggctggctgagtatagtactagctgcctccccaccaggttccgagtagtgtctgagactctgctctgcagggcctagggtagcgctgggagtgtagaagtggcctgcccttaactgttttcactaaacagctttttctaaggggagagcaagggggagagatctagattgggtgagggggacggggatgtcagggaggcaagtgtgttgtgttactgtgtcaataaactgatttaaagttgtgg

SEQ ID NO: 162771 - DNA, 785 bp, Homo sapiens
  Payload ID: 12075
  Gene Symbol: OAZ2
  Gene Name: ornithine decarboxylase antizyme 2
  ENST ID: ENST00000559753
  CDS Start-End: 384-566
gctcgctgaggcaaaaggaggcgctcggcccgcggcctgacagggacttagcccgcagagatcgaccccgcgcgcgtgaccccacacccacccactcatccatctatccactccctgcgccgcctcctcccaccctgagcagagccgccgaggatgataaacacccaggacaggacgagaagctcactgtgacccaggacctccctgtgaatgatggaaaacctcacatcgtccacttccagtatgaggtcaccgaggtgaaggtctcttcttgggatgcagtcctgtccagccagagcctgtttgtagaaatcccagatggattattagctgatgggagcaaagaaggattgttagcactgctagagtttgctgaagagaagatgaaagtgaactatgtcttcatctgcttcaggaagggccgagaagacagagctccactcctgaagaccttcagcttcttgggctttgagattgtacgtccaggccatccctgtgtcccctctcggccagatgtgatgttcatggtttatcccctggaccagaacttgtccgatgaggactaatagtcatagaggatgctttacccaagagccacagtgggggaagaggggaagttaggcagccctgggacagacgagagggctcctcgctgtctagggaaggacactgaggggctcagggtgagggttgcctattgtgttctcggagttgactcgttgaaattgttttccataaagaacagtataaacatattattcacatgtaatcaccaatagtaaatg

SEQ ID NO: 162772 - DNA, 851 bp, Homo sapiens
  Payload ID: 12076
  Gene Symbol: OAZ3
  Gene Name: ornithine decarboxylase antizyme 3
  ENST ID: ENST00000321531
  CDS Start-End: 168-740
gcgcctcggcccgggccttactctccaccgactgcgtcaggatgagctccaggttttctttgggccgatgcttcgtgtcctccaccagcttatagacgcgatgtcgccggtgcaggcgcggcttccggccctccccggccagcggtaccttccaccagcgctccacgatgaccgtgccctggcggccaggaaagcgacgcatcacttataaggaagaggaggacttgacactccagccccgttcctgcctccagtgctccgagtccctagtaggcctccaggagggcaaaagcaccgagcagggtaaccacgaccagcttaaagaactgtattcggctgggaacttgacggtgctggctactgaccccctgctccaccaggacccagtacagttagactttcacttccgccttacctcccagacctctgcccattggcacggccttctctgtgaccgtcgactcttcctggatatcccatatcaggccttggatcaaggcaaccgggaaagtttgactgcaaccctggagtacgtggaagagaagacaaatgtggactctgtgtttgtgaacttccagaatgatcggaacgacagaggtgccctgctgcgggccttcagctacatgggctttgaggtggtcagaccagatcaccctgccctccctcccttggacaatgtcatctttatggtgtatccccttgaaagggatgttggccacctgcccagtgagcctccttgaacatgcttattccaacgctttgaggggctggaagccttgacacatggaatcaggggcccgggatgtgattcaggacactttccatcctaggaataaagggtagtgcaatca

SEQ ID NO: 162773 - DNA, 890 bp, Homo sapiens
  Payload ID: 12076
  Gene Symbol: OAZ3
  Gene Name: ornithine decarboxylase antizyme 3
  ENST ID: ENST00000400999
  CDS Start-End: 68-775
gttgcctaaacctctgccacccacctgtgaacttcactttgccacagggaggcactgaactgaaaaactgccttgtaagaggtgtcgcccctctgtctactccctttcttatatcaagaggggaaaaacacgtaactacctctacccgatctggtcaccatacgcctattacctttactgttacaagtaccggatcactctccgggagaagatgctgcctcgttgttataaaagcatcacttataaggaagaggaggacttgacactccagccccgttcctgcctccagtgctccgagtccctagtaggcctccaggagggcaaaagcaccgagcagggtaaccacgaccagcttaaagaactgtattcggctgggaacttgacggtgctggctactgaccccctgctccaccaggacccagtacagttagactttcacttccgccttacctcccagacctctgcccattggcacggccttctctgtgaccgtcgactcttcctggatatcccatatcaggccttggatcaaggcaaccgggaaagtttgactgcaaccctggagtacgtggaagagaagacaaatgtggactctgtgtttgtgaacttccagaatgatcggaacgacagaggtgccctgctgcgggccttcagctacatgggctttgaggtggtcagaccagatcaccctgccctccctcccttggacaatgtcatctttatggtgtatccccttgaaagggatgttggccacctgcccagtgagcctccttgaacatgcttattccaacgctttgaggggctggaagccttgacacatggaatcaggggcccgggatgtgattcaggacactttccatcctaggaataaagggtagtgcaatcatcaa

SEQ ID NO: 162774 - DNA, 729 bp, Homo sapiens
  Payload ID: 12076
  Gene Symbol: OAZ3
  Gene Name: ornithine decarboxylase antizyme 3
  ENST ID: ENST00000453029
  CDS Start-End: 16-627
gttcacaggcacagaatgagacctgagggaggaccccggcgtcggcggcaggaaaggcccccgccagtgctgcctgcggcgcgccgcatcacttataaggaagaggaggacttgacactccagccccgttcctgcctccagtgctccgagtccctagtaggcctccaggagggcaaaagcaccgagcagggtaaccacgaccagcttaaagaactgtattcggctgggaacttgacggtgctggctactgaccccctgctccaccaggacccagtacagttagactttcacttccgccttacctcccagacctctgcccattggcacggccttctctgtgaccgtcgactcttcctggatatcccatatcaggccttggatcaaggcaaccgggaaagtttgactgcaaccctggagtacgtggaagagaagacaaatgtggactctgtgtttgtgaacttccagaatgatcggaacgacagaggtgccctgctgcgggccttcagctacatgggctttgaggtggtcagaccagatcaccctgccctccctcccttggacaatgtcatctttatggtgtatccccttgaaagggatgttggccacctgcccagtgagcctccttgaacatgcttattccaacgctttgaggggctggaagccttgacacatggaatcaggggcccgggatgtgattcaggacactttccatcctaggaataaagggta

SEQ ID NO: 162775 - DNA, 3789 bp, Homo sapiens
  Payload ID: 12076
  Gene Symbol: OAZ3
  Gene Name: ornithine decarboxylase antizyme 3
  ENST ID: ENST00000479764
  CDS Start-End: 3145-3519
gaaagtatggggagcgggccggggaacagatggcaccgcggcttgcctatttttgctttttggcagaggtgacggacgcctagaattactgactgataatggaatgagtgttaggtggactgacgccggaaaagacgctcttcctcttgaaagtgtgggctttgctgtagctccagttgctgggctaacttttaattctaacgttctgtgatgactggatactgaccggagaatgaatgatgctctcacttttccttacttcaaatctacctaaaagtggtaaaggatgggatcccttggaaaactctgccagctccaggaggagcctgacccttaatcattatactgcagtatttaagctaataaaggagaattctaaatcacaagctatgtaaaccgtagaaaaaaaagcaactatggtaaggccgcgacagttccctctggggagggtctcagtactggacagaagaccataaaaactggatgaaagaaggtccatttggcagagattatggaaagactggcccttaaacatactgaccagtcctccttcctcctaaatacactacttggcctcctggacaccggtcttcttcagtctcgtttgctgatttctccttttctccccgcttcttagaatgccctcgggactccgtttttgaacctttactcttctcagtatacactcactgttgatctcatccagtctcgtggcttacaataccatttataagccaatgactcccaaatttctagttccatcctagacatctcccaaactcgtctcaaatattcaactgtttattcgtcattttcctcttacgtatccaaaggacacctcaaagttaactgtcccaaactaatttatttattcccccctcgcccccaaaactgccccatctgcagcctttttcctctcagttgacagaaactccattctttccattctaactcttttctctcatactccatcaggaaatcctgtgggttctacctttaaattacagatagtccctgacttggatttacaatttttgagtttgtgatggtgtgaaagtgatgtgcactcagtaggacatcaataagttacatgaaatattcaacactttattataaaataggctttgtgttagatgattttacccaactgtcggataagttgtctgagcatgtttaagataggctaggctaagctatggtgtttggtaggtgtattatatgcattttcaacttatgatactttcaacatacgatgggtttatcaggacataaccctattttaagtcaaggagcacttgtatttccagaatccagccacttgtcaccacctccaatgctctaccttggaataagacactactttctcctggattactgcaatagtcccctaaaagatatcccttaattctctacagtttataattctatgtagcttatttatagcagccagaatgatctttttaaagcataagtcagatcatgtcattcttccacccaaaactttgtaatgacttcctcctttactcaaggtaaaagaaaaaggccatcagatggtctacaaggccatacatactctgaccccattagctcctctctaatttacactgctccacccacagtggcctccttgtttcttgaaaacaccaggcacgtttcctgctcagggcttttgcactggctgcttttgcgttggatgctcttatcctcagatgctggcttggttaacaacctcacatcctccaagtgtttaattaaatgtcagtttttttcagtgagagatcaccctatttcttactgtaaccctgacccatccccttcacattccttatcttcctttatcttgctctattccccccaccccatagcagttaccttctaacatactaaacaatttactatgtttattttctaggtttgtcctctcacttttagaagatacgttccatagggcagggatttgttttgttcactgatgtatcatctcaagcacctagaatagtgcctggctaatagtagaccctcaataaatatttgttgaatggataaatatgcagaggtctcaaagtggcagtcccagaaccaaattttgcttacaatgttgtttttttatcaacaattttttagtagttgatttttttttttttttgagttggagtctcgctatgttgcccaggctggagtgcagtggcacgatctcagctcactgcaagctccgcctcctgggttcacgccattctcctgcctcagcctcccgtgtagctgggaatacaggcgcctgccaccacgcccggctaattttttgtatttttagtacagacagagtttcatcgtgttagccaggatggtctcgatctcctgacctcgtgatccgcccgcctcggcctcccaaagcgctgggattacagacgtgagccaccgtgcccggcccagtagtcgatattttttaaaattggtgagatttactacaaaactgtctttccagtttctgttcaaaaatcatacgatacagcaccatcaagtctgcattcttgcatggaactggatggaattgagttgtgtggacttcctttagataacgtgtgagctttcctattttgctacagccctaccctgccactccactaatttccataagctgtctaggcccctgaaggggcctagacaattagtttgcaattcctaccctacaaggatcctgggttattaagggtagggatgataataaaaatactcaactggtatgaactgggaaccaactaatcaggtcaccactggatcagagccttggaagagtcagataccaactctttacttgctggattttgggggaaggggagtgtccacagaggagcagggtgggtgggcacaagtgctcaggcagggcttttggccaaccagtacagaagtcttcaagttctattttttaatcattcatacagccataacatgcatactagtcgaatatgagccttggataagggattagggtagataagcagcagagtggagtcctgaggtgacataagggctgaccccttatccatgtcatagtgcccactgggtcacaatgccaccaggttgcctaaacctctgccacccacctgtgaacttcactttgccacagggaggcactgaactgaaaaactgccttgtaagaggtgtcgcccctctgtctactccctttcttatatcaagaggggaaaaacacgtaactacctctacccgatctggtcaccatacgcctattacctttactgttacaagtaccggatcactctccgggagaagatgctgcctcgttgttataaaagcatcacttataaggaagaggaggacttgacactccagccccgttcctgcctccagtgctccgagtccctagtaggcctccaggagggcaaaagcaccgagcagggtaaccacgaccagcttaaagaactgtattcgtttgactgcaaccctggagtacgtggaagagaagacaaatgtggactctgtgtttgtgaacttccagaatgatcggaacgacagaggtgccctgctgcgggccttcagctacatgggctttgaggtggtcagaccagatcaccctgccctccctcccttggacaatgtcatctttatggtgtatccccttgaaagggatgttggccacctgcccagtgagcctccttgaacatgcttattccaacgctttgaggggctggaagccttgacacatggaatcaggggcccgggatgtgattcaggacactttccatcctaggaataaagggtagtgcaatcatc

SEQ ID NO: 162776 - DNA, 481 bp, Homo sapiens
  Payload ID: 12076
  Gene Symbol: OAZ3
  Gene Name: ornithine decarboxylase antizyme 3
  ENST ID: ENST00000582415
  CDS Start-End: 1-370
gggcaaaagcaccgagcagggtaaccacgaccagcttaaagaactgtattcgacctctgcccattggcacggccttctctgtgaccgtcgactcttcctggatatcccatatcaggccttggatcaaggcaaccgggaaagtttgactgcaaccctggagtacgtggaagagaagacaaatgtggactctgtgtttgtgaacttccagaatgatcggaacgacagaggtgccctgctgcgggccttcagctacatgggctttgaggtggtcagaccagatcaccctgccctccctcccttggacaatgtcatctttatggtgtatccccttgaaagggatgttggccacctgcccagtgagcctccttgaacatgcttattccaacgctttgaggggctggaagccttgacacatggaatcaggggcccgggatgtgattcaggacactttccatcctaggaataaagggtagtgcaatca

SEQ ID NO: 162777 - DNA, 850 bp, Homo sapiens
  Payload ID: 12076
  Gene Symbol: OAZ3
  Gene Name: ornithine decarboxylase antizyme 3
  Uniprot ID: Q9UMX2
  ENST ID: ENST00000627780
  CDS Start-End: 168-740
gcgcctcggcccgggccttactctccaccgactgcgtcaggatgagctccaggttttctttgggccgatgcttcgtgtcctccaccagcttatagacgcgatgtcgccggtgcaggcgcggcttccggccctccccggccagcggtaccttccaccagcgctccacgatgaccgtgccctggcggccaggaaagcgacgcatcacttataaggaagaggaggacttgacactccagccccgtcctgcctccagtgctcctgagtccctagtaggcctccaggagggcaaaagcaccgagcagggtaaccacgaccagcttaaagaactgtattcggctgggaacttgacggtgctggctactgaccccctgctccaccaggacccagtacagttagactttcacttccgccttacctcccagacctctgcccattggcacggccttctctgtgaccgtcgactcttcctggatatcccatatcaggccttggatcaaggcaaccgggaaagtttgactgcaaccctggagtacgtggaagagaagacaaatgtggactctgtgtttgtgaacttccagaatgatcggaacgacagaggtgccctgctgcgggccttcagctacatgggctttgaggtggtcagaccagatcaccctgccctccctcccttggacaatgtcatctttatggtgtatccccttgaaagggatgttggccacctgcccagtgagcctccttgaacatgcttattccaacgctttgaggggctggaagccttgacacatggaatcaggggcccgggatgtgattcaggacactttccatcctaggaataaagggtagtgcaatc

SEQ ID NO: 162778 - DNA, 745 bp, Homo sapiens
  Payload ID: 12076
  Gene Symbol: OAZ3
  Gene Name: ornithine decarboxylase antizyme 3
  ENST ID: ENST00000635322
  CDS Start-End: 238-477
aagcaaggcaaatagttgagggggacgggctagaaaaagctgatgccaaaccggaccagcctgagaggaagcgcctcggcccgggccttactctccaccgactgcgtcaggatgagctccaggttttctttgggccgatgcttcgtgtcctccaccagcttatagacgcgatgtcgccggtgcaggcgcggcttccggccctccccggccagcggtaccttccaccagcgctccacgatgaccgtgccctggcggccaggaaagcgacgcatcacttataaggaagaggaggacttgacactccagccccgttcctgcctccagtgctccgagtccctagtaggcctccaggagggcaaaagcaccgagcagggtaaccacgaccagcttaaagaactgtattcgtttgactgcaaccctggagtacgtggaagagaagacaaatgtggactctgtgtttgtgaacttccagaatgatcggaacgacagaggtgccctgctgcgggccttcagctacatgggctttgaggtggtcagaccagatcaccctgccctccctcccttggacaatgtcatctttatggtgtatccccttgaaagggatgttggccacctgcccagtgagcctccttgaacatgcttattccaacgctttgaggggctggaagccttgacacatggaatcaggggcccgggatgtgattcaggacactttccatcctaggaataaagggtagtgcaatca

SEQ ID NO: 162779 - DNA, 539 bp, Homo sapiens
  Payload ID: 12076
  Gene Symbol: OAZ3
  Gene Name: ornithine decarboxylase antizyme 3
  ENST ID: ENST00000635374
  CDS Start-End: 1-318
ctccagccccgttcctgcctccagtgctccgagtccctagtaggcctccaggagggcaaaagcaccgagcagggtaaccacgaccagcttaaagaactgtattcggctgggaacttgacggtgctggctactgaccccctgctccaccaggacccagtacagttagactttcacttccgccttacctcccagacctctgcccattggcacggccttctctgtgaccgtcgactcttcctggatatcccatatcaggccttggatcaaggcaaccgggaaaggtgccctgctgcgggccttcagctacatgggctttgaggtggtcagaccagatcaccctgccctccctcccttggacaatgtcatctttatggtgtatccccttgaaagggatgttggccacctgcccagtgagcctccttgaacatgcttattccaacgctttgaggggctggaagccttgacacatggaatcaggggcccgggatgtgattcaggacactttccatcctaggaataaagggtagtgcaatcatcaa

SEQ ID NO: 162780 - DNA, 863 bp, Homo sapiens
  Payload ID: 12077
  Gene Symbol: OFCC1
  Gene Name: orofacial cleft 1 candidate 1
  ENST ID: ENST00000316020
  CDS Start-End: 1-696
tttaggagagataagtttcagcagaaggctctgaagcaaactaagcagaagaaatccaagtcggctgaatttctgatggttaaagaagatagagaagctacagaaggcactggaaatccagcttttaacatgagcagtccagatctctcagcatgtcagactgcagaaaagaaagttattagacacgacatgccggatcgcacccttgcagctcaccaacaaaaattcaggctgccagcctctgcagaaccaaaaggaaatgaatacggcagaaattactttgacccactgatggatgaggaaataaacccaaggcagtgtgcgacggaggtcagcagagaagatgacgatagaattttctataatcgattaacgaagctttttgatgagagcagacaaggagaaccccaagatgagagtggccgggaggagactctgaattctgaagcacctgggagttccaataagagtcacgaaatccacaaagaagccagcgaagccaccactgctcaccttgaggagttccaaagatctcagaaaactataattctgcttggaagttctccattagaacaggaaattagatctacttcattgcattgtatggaggatgagatgagtcatccatggatactcttgctcaaagtaactgctgtaatcagaagcaggaggtactatagagagcaaagattctaaaacccattctcaggtcagtgctcgcaatgttcttatgttcactgtgtcgggaagttccatgaacacacaaggcaacatcataagtaggaaaaaccttcagatttggtgttagaactcagagctgtcatccttgattcagatatttatgtgaacttaaacctctttgt

SEQ ID NO: 162781 - DNA, 1222 bp, Homo sapiens
  Payload ID: 12077
  Gene Symbol: OFCC1
  Gene Name: orofacial cleft 1 candidate 1
  Uniprot ID: Q8IZS5
  ENST ID: ENST00000487015
  CDS Start-End: 1-369
actaagcagaagaaatccaagtcggctgaatttctgatggttaaagaagatagagaagctacagaaggcactggaaatccagcttttaacatgagcagtccagatctctcagcatgtcagactgcagaaaagaaagttattagacacgacatgccggatcgcacccttgcagctcaccaacaaaaattcaggctgccagcctctgcagaaccaaaaggaaatgaatacggcagaaattactttgacccactgatggatgaggaaataaacccaaggcagtgtgcgacggaggtcagcagagaaggatttgaaattcgaaggggaaggcctcaacgaatacattcctatgtcacttttaaagactggtaaaacatttgagaaaactccaagtcaaccattcattgcagacctaaatatttgtaaaaaggacagtgcagcccagcttggtaccctcacagaagtaactaatgactcaaagggagcagcaggaccccgctggaagttcctgcgtaattcaagaaccccaccttttgtggaaaatgagcagtctcaaccacctcagcctctgcaaatccagatcagatgcctgaggggccttaaagacaaggctcctccaggctcttatgtcctcaaagtgtccaagtgtccctgcttggtcgactgggaggctgtgtcttgcagtggtggcaaacggagcaactaaagaccagaaaacactccgtcaggcacaatggaaacttttatgatgtgggggtgtatttccacgaaaacctttatgtgggagcattcctaaaaaaatcggtccctgttctatggactatgatcccaatctcttagaagaagacgatgaactacactctcagggagatagcctgacggatcattctgtgaaaggaaaatcaactgtttggagaattggagaagctgaagattattcacaggacatatcttacttggaggaactggaggaacaccgattttctgtttgctgttcttcagttgctgatagtagatatggagacttcttcaagcatctccattttgtgctggtatcagcgtcttcagaacttcagttatctcaatggcaaagccagggcttctggtacattatactgctgatgttttttctctggttcctgaggctctacctgcattacttgggccagtggcttttcctccaggccatttcaactcctgttacaaaattccatttttctcttca

SEQ ID NO: 162782 - DNA, 464 bp, Homo sapiens
  Payload ID: 12077
  Gene Symbol: OFCC1
  Gene Name: orofacial cleft 1 candidate 1
  ENST ID: ENST00000485268
  CDS Start-End: 453-464
cagacacagatgggagtgtgtcaagcaggaaactgaagggagctgatcatcttcgtctcacccagaatcccatttggtctgtgtcctcttccctactctgtttatcgtggccttggctgtagcagggggaagagacaagtctggaaagaaccctgcccttggtttccatctctctgctgaaattccacatctagtcaggaatgtggtaatgtgtccggaattggtgggttcttgatctcactgacttcaagaatgaagccacagaacctcacggtgggtgttccagttcttaaacacagtgtctggcgtttgttccttctgatgttcggatgtgttaggaatttctttcttctggtgagttcgtgatctcgctggctcagcagtgaagctgcagaccttcgtgagagactggattgaaatctgtgcattgccaagggcaagaagctgagaacatggagagagag

SEQ ID NO: 162783 - DNA, 559 bp, Homo sapiens
  Payload ID: 12077
  Gene Symbol: OFCC1
  Gene Name: orofacial cleft 1 candidate 1
  ENST ID: ENST00000492169
  CDS Start-End: 1-559
atccaagtcggctgaatttctgatggttaaagaagatagagaagctacagaaggcactggaaatccagcttttaacatgagcagtccagatctctcagcatgtcagactgcagaaaagaaagttattagacacgacatgccggatcgcacccttgcagctcaccaacaaaaattcaggctgccagcctctgcagaaccaaaaggaaatgaatacggcagaaattactttgacccactgatggatgaggaaataaacccaaggcagtgtgcgacggaggtcagcagagaaggtgctccctcaaaggaaaaatggagcattcctaaaaaaatcggtccctgttctatggactatgatcccaatctcttagaagaagacgatgaactacactctcagggagatagcctgacggatcattctgtgaaaggaaaatcaactgtttggagaattggagaagctgaagattattcacaggacatatcttacttggaggaactggaggaacaccgattttctgtttgctgttcttcagttgctgatagtagatatggagacttcttc

SEQ ID NO: 162784 - DNA, 655 bp, Homo sapiens
  Payload ID: 12077
  Gene Symbol: OFCC1
  Gene Name: orofacial cleft 1 candidate 1
  Uniprot ID: Q8IZS5
  ENST ID: ENST00000491508
  CDS Start-End: 32-655
atgtttacttctgtgtgagcttatattaattatgtggatcaccagtctcatcaccatgaaggatgaagatatatttgatttggcaggggatccccaagacagcctcattcctgggccttctcccacccccaagcaaaacccagtttgtaatgaggctttctttggacaccagactttctccttaagagagactggattgaaatctgtgcattgccaagggcaagaagctgagaacatggagagagagaagtttcagcagaaggctctgaagcaaactaagcagaagaaatccaagtcggctgaatttctgatggttaaagaagatagagaagctacagaaggcactggaaatccagcttttaacatgagcagtccagatctctcagcatgtcagactgcagaaaagaaagttattagacacgacatgccggatcgcacccttgcagctcaccaacaaaaattcaggctgccagcctctgcagaaccaaaaggaaatgaatacggcagaaattactttgacccactgatggatgaggaaataaacccaaggcagtgtgcgacggaggtcagcagagaagatgagagtggccgggaggagactctgaattctgaagcacctgggagttccaataagagtcacgaaatccacaaagaa

SEQ ID NO: 162785 - DNA, 398 bp, Homo sapiens
  Payload ID: 12077
  Gene Symbol: OFCC1
  Gene Name: orofacial cleft 1 candidate 1
  ENST ID: ENST00000481704
  CDS Start-End: 333-398
tgtggcatgtgatgtttacatgatcctaggaagaaaatggatgagccgatgttgacaagagcttaagtaagtctccatgtacatcaagtactttggagacgccaaaggtgtaactttaaagggcaaagacctcaggacaaagcaacttgaagaagccaggaactaaagacgggacatttggttcaaaacttgaagtggctccccgccccccgccccgagatttcatgacagaaaaacaacaacagaatcaatatgactactgagaatacatttttaaaaattaacgtgacatcttggatcttataagagtcaagcccttcaggaaataaaccatgagagagactggattgaaatctgtgcattgccaagggcaagaagctgagaacatggagagagag

SEQ ID NO: 162786 - DNA, 973 bp, Homo sapiens
  Payload ID: 12077
  Gene Symbol: OFCC1
  Gene Name: orofacial cleft 1 candidate 1
  ENST ID: ENST00000486246
  CDS Start-End: 1-320
tgaagcaaactaagcagaagaaatccaagtcggctgaatttctgatggttaaagaagatagagaagctacagaaggcactggaaatccagcttttaacatgagcagtccagatctctcagcatgtcagactgcagaaaagaaagttattagacacgacatgccggatcgcacccttgcagctcaccaacaaaaattcaggctgccagcctctgcagaaccaaaaggaaatgaatacggcagaaattactttgacccactgatggatgaggaaataaacccaaggcagtgtgcgacggaggtcagcagagaagctttttgatgagagcagacaaggagaaccccaagatgagagtggccgggaggagactctgaattctgaagcacctgggagttccaataagagtcacgaaatccacaaagaagccagcgaagccaccactgctcaccttgaggagttccaaagatctcagaaaactataattctgcttggaagttctccattagaacaggccagactccaaacatctaggaatgaaaaatgcccatgggcataagtgtcctgaacattcttatggatttgggatttgaaattcgaaggggaaggcctcaacgaatacattcctatgtcacttttaaagactggtaaaacatttgagaaaactccaagtcaaccattcattgcagacctaaatatttgtaaaaaggacagtgcagcccagcttggtaccctcacagaagtaactaatgactcaaagggagcagcaggaccccgctggaagttcctgcgtaattcaagaaccccaccttttgtggaaaatgagcagtctcaaccacctcagcctctgcaaatccagatcagatgcctgaggggccttaaagacaaggctcctccaggctcttatgtcctcaaagtgtccaagtgtccctgcttggtcgactgggaggctgtgtcttgcagtggtggcaaacgga

SEQ ID NO: 162787 - DNA, 919 bp, Homo sapiens
  Payload ID: 12077
  Gene Symbol: OFCC1
  Gene Name: orofacial cleft 1 candidate 1
  ENST ID: ENST00000460363
  CDS Start-End: 20-919
agggcaagaagctgagaacatggagagagagaagtttcagcagaaggctctgaagcaaactaagcagaagaaatccaagtcggctgaatttctgatggttaaagaagatagagaagctacagaaggcactggaaatccagcttttaacatgagcagtccagatctctcagcatgtcagactgcagaaaagaaagttattagacacgacatgccggatcgcacccttgcagctcaccaacaaaaattcaggctgccagcctctgcagaaccaaaaggaaatgaatacggcagaaattactttgacccactgatggatgaggaaataaacccaaggcagtgtgcgacggaggtcagcagagaagtttgtctaatggctaaaggagagaaagcagaatcaggagtggataatacagctggcctttcagagaaggaaacacagaagaatcctcgtgcaccaatggatgaggcagacgttaaatccgcagcacactcttctcaggggagcattcctaaaaaaatcggtccctgttctatggactatgatcccaatctcttagaagaagacgatgaactacactctcagggagatagcctgacggatcattctgtgaaaggaaaatcaactgtttggagaattggagaagctgaagattattcacaggacatatcttacttggaggaactggaggaacaccgattttctgtttgctgttcttcagttgctgatagtagatatggagacttcttcaagcatctccattttgtgctggtatcagcgtcttcagaacttcagttatctcaatggcaaagccagggcttctggtacattatactgctgatgttttttctctggttcctgaggctctacctgcattacttgggccagtggcttttcctccaggccatttcaactcctgtt

SEQ ID NO: 162788 - DNA, 1527 bp, Homo sapiens
  Payload ID: 12077
  Gene Symbol: OFCC1
  Gene Name: orofacial cleft 1 candidate 1
  ENST ID: ENST00000469426
  CDS Start-End: 1-657
actaagcagaagaaatccaagtcggctgaatttctgatggttaaagaagatagagaagctacagaaggcactggaaatccagcttttaacatgagcagtccagatctctcagcatgtcagactgcagaaaagaaagttattagacacgacatgccggatcgcacccttgcagctcaccaacaaaaattcaggctgccagcctctgcagaaccaaaaggaaatgaatacggcagaaattactttgacccactgatggatgaggaaataaacccaaggcagtgtgcgacggaggtcagcagagaagatgacgatagaattttctataatcgattaacgaagctttttgatgagagcagacaaggagaaccccaagatgagagtggccgggaggagactctgaattctgaagcacctgggagttccaataagagtcacgaaatccacaaagaagccagcgaagccaccactgctcaccttgaggagttccaaagatctcagaaaactataattctgcttggaagttctccattagaacaggaaattagatctacttcattgcattgtatggaggatgagatgagtcatccatggatactcttgctcaaagtaactgctgtaatcagaagcaggaggtactatagagagcaaagattctaaaacccattctcaggccagactccaaacatctaggaatgaaaaatgcccatgggcataagtgtcctgaacattcttatggatttgggatttgaaattcgaaggggaaggcctcaacgaatacattcctatgtcacttttaaagactggtaaaacatttgagaaaactccaagtcaaccattcattgcagacctaaatatttgtaaaaaggacagtgcagcccagcttggtaccctcacagaagtaactaatgactcaaagggagcagcaggaccccgctggaagttcctgcgtaattcaagaaccccaccttttgtggaaaatgagcagtctcaaccacctcagcctctgcaaatccagatcagatgcctgaggggccttaaagacaaggctcctccaggctcttatgtcctcaaagtgtccaagtgtccctgcttggtcgactgggaggctgtgtcttgcagtggtggcaaacggagcaactaaagaccagaaaacactccgtcaggcacaatggaaacttttatgatgtgggggtgtatttccacgaaaacctttatgtggtgctccctcaaaggaaaaatgtgagccctggcatggtttcttgtttgaactctttcttcttcgtggaacatacacttgcctggaccgggctgtgggctgagcagtgttccctttgtgtaataacaactttgatacagtggagggaaaatttaagtgtccccttctatgaggacattatgaccagaaactcagtaactttaggaaaattgaagatttgatttgcctggacttggaccactggctgtgcaatctctattttcaggtcattaaacttcctttgcattttgatggtcaaaaaaatcatgaaa

SEQ ID NO: 162789 - DNA, 1200 bp, Homo sapiens
  Payload ID: 12077
  Gene Symbol: OFCC1
  Gene Name: orofacial cleft 1 candidate 1
  ENST ID: ENST00000469656
  CDS Start-End: 1-356
aagatgacgatagaattttctataatcgattaacgaagctttttgatgagagcagacaaggagaaccccaagatgagagtggccgggaggagactctgaattctgaagcacctgggagttccaataagagtcacgaaatccacaaagaagccagcgaagccaccactgctcaccttgaggagttccaaagatctcagaaaactataattctgcttggaagttctccattagaacaggaaattagatctacttcattgcattgtatggaggatgagatgagtcatccatggatactcttgctcaaagtaactgctgtaatcagaagcaggaggtactatagagagcaaagattctaaaacccattctcaggatttgaaattcgaaggggaaggcctcaacgaatacattcctatgtcacttttaaagactggtaaaacatttgagaaaactccaagtcaaccattcattgcagacctaaatatttgtaaaaaggacagtgcagcccagcttggtaccctcacagaagtaactaatgactcaaagggagcagcaggaccccgctggaagagagataaagattttttatggcttgctgacttgaaacaaccacgagaaccagtgaagagatggctaagcggccatgcatagtaattccactgttcctgcgtaattcaagaaccccaccttttgtggaaaatgagcagtctcaaccacctcagcctctgcaaatccagatcagatgcctgaggggccttaaagacaaggctcctccaggctcttatgtcctcaaagtgtccaagtgtccctgcttggtcgactgggaggctgtgtcttgcagtggtggcaaacggagcaactaaagaccagaaaacactccgtcaggcacaatggaaacttttatgatgtgggggtgtatttccacgaaaacctttatgtggtgctccctcaaaggaaaaatgtgagccctggcatggtttcttgtttgaactctttcttcttcgtggaacatacacttgcctggaccgggctgtgggctgagcagtgttccctttgtgtaataacaactttgatacagtggagggaaaatttaagtgtccccttctatgaggacattatgaccagaaactcagtaactttaggaaaattgaagatttgatttgcctggacttggaccactggctgtgcaatctctattttcag

SEQ ID NO: 162790 - DNA, 2877 bp, Homo sapiens
  Payload ID: 12077
  Gene Symbol: OFCC1
  Gene Name: orofacial cleft 1 candidate 1
  ENST ID: ENST00000492094
  CDS Start-End: 1-934
gcattgccaagggcaagaagctgagaacatggagagagagaagtttcagcagaaggctctgaagcaaactaagcagaagaaatccaagtcggctgaatttctgatggttaaagaagatagagaagctacagaaggcactggaaatccagcttttaacatgagcagtccagatctctcagcatgtcagactgcagaaaagaaagttattagacacgacatgccggatcgcacccttgcagctcaccaacaaaaattcaggctgccagcctctgcagaaccaaaaggaaatgaatacggcagaaattactttgacccactgatggatgaggaaataaacccaaggcagtgtgcgacggaggtcagcagagaagatgagagtggccgggaggagactctgaattctgaagcacctgggagttccaataagagtcacgaaatccacaaagaagccagcgaagccaccactgctcaccttgaggagttccaaagatctcagaaaactataattctgcttggaagttctccattagaacaggatttgaaattcgaaggggaaggcctcaacgaatacattcctatgtcacttttaaagactggtaaaacatttgagaaaactccaagtcaaccattcattgcagacctaaatatttgtaaaaaggacagtgcagcccagcttggtaccctcacagaagtaactaatgactcaaagggagcagcaggaccccgctggaagttcctgcgtaattcaagaaccccaccttttgtggaaaatgagcagtctcaaccacctcagcctctgcaaatccagatcagatgcctgaggggccttaaagacaaggctcctccaggctcttatgtcctcaaagtgtccaagtgtccctgcttggtcgactgggaggctgtgtcttgcagtggtggcaaacggagcaactaaagaccagaaaacactccgtcaggcacaatggaaacttttatgatgtgggggtgtatttccacgaaaacctttatgtggtgctccctcaaaggaaaaatgtgagccctggcatggtttcttgtttgaactctttcttcttcgtggaacatacacttgcctggaccgggctgtgggctgagcagtgttccctttgtgtaataacaactttgatacagtggagggaaaatttaagtgtccccttctatgaggacattatgaccagaaactcagtaactttaggaaaattgaagatttgatttgcctggacttggaccactggctgtgcaatctctattttcaggtcattaaacttcctttgcattttgatggtcaaaaaaatcatgaaagctatactcgactttcccctgaatttccagtttgtctaatggctaaaggagagaaagcagaatcaggagtggataatacagctggcctttcagagaaggaaacacagaagaatcctcgtgcaccaatggatgaggcagacgttaaatccgcagcacactcttctcaggggagcattcctaaaaaaatcggtccctgttctatggactatgatcccaatctcttagaagaagacgatgaactacactctcagggagatagcctgacggatcattctgtgaaaggaaaatcaactgtttggagaattggagaagctgaagattattcacaggacatatcttacttggaggaactggaggaacaccgattttctgtttgctgttcttcagttgctgatagtagatatggagacttcttcaagcatctccattttgtgctggtatcagcgtcttcagaacttcagttatctcaatggcaaagccagggcttctggtacattatactgctgatgttttttctctggttcctgaggctctacctgcattacttgggccagtggcttttcctccaggccatttcaactcctgttacaaaattccatttttctcttcacatcgttgagctttgctacccaacttcctcacttcacattggagaagagcttcccgtggttgtgatggggcctttaatgctgaatgcaatcctgcttcttttggttttgatcagatggggctgtcagctactctttgcctcctgtcctgatgtcttgtcaaagttaatcattaccatgggactatggacaattctggacccattggcagtgtttatactggatactctcctggggcggcttacagataatgaggagactcctgtggcggatgccgcgaagctctactggatgtttgtaagaaccgtgcagccaggcattcttggcgtggtgatcacagtgctgctttacatcctcctgttcgtcatttcttctttgattttatatttatattgtcttaggttgcacaatgactcttggatattagatgcttttcagcgcatccacagtgaagaaaccaagttcttcataccgtatgacttggagatttccaatcaggagctaagttatatagtgaaatgatctgagcagtggagaggaatcaatggtgaaagaagaaaggtggcagtgtatgattacatctggaaaagccatggcattaagtccagtgtctgcagctgtgacctccaacatcaaaatgaaatttctgtgtctgcacttggtccaggagatattacttctcatgtatctgtatataccatttatcccagtgggttgcaagagctgtaccgccattttctgagactccccggtgggccattgttgaggtgtttggtgatatcagtggcttaaagcttgtccacagtgaagtgatcacagctattcaggagcatataagcaaaacggacagcatcctgggaggctcgtttgacatttaattgagagacatgaaaagaacccgttaaaataaaaaggaaattggtggccccagtggaaggatgagtaaaga

SEQ ID NO: 162791 - DNA, 754 bp, Homo sapiens
  Payload ID: 12077
  Gene Symbol: OFCC1
  Gene Name: orofacial cleft 1 candidate 1
  ENST ID: ENST00000622909
  CDS Start-End: 29-736
gcattgccaagggcaagaagctgagaacatggagagagagaagtttcagcagaaggctctgaagcaaactaagcagaagaaatccaagtcggctgaatttctgatggttaaagaagatagagaagctacagaaggcactggaaatccagcttttaacatgagcagtccagatctctcagcatgtcagactgcagaaaagaaagttattagacacgacatgccggatcgcacccttgcagctcaccaacaaaaattcaggctgccagcctctgcagaaccaaaaggtactttcacaggaaatgaatacggcagaaattactttgacccactgatggatgaggaaataaacccaaggcagtgtgcgacggaggtcagcagagaagatgacgatagaattttctataatcgattaacgaagctttttgatgagagcagacaaggagaaccccaagatgagagtggccgggaggagactctgaattctgaagcacctgggagttccaataagagtcacgaaatccacaaagaagccagcgaagccaccactgctcaccttgaggagttccaaagatctcagaaaactataattctgcttggaagttctccattagaacaggaaattagatctacttcattgcattgtatggaggatgagatgagtcatccatggatactcttgctcaaagtaactgctgtaatcagaagcaggaggtactatagagagcaaagattctaaaacccattctcaggtcag

SEQ ID NO: 162792 - DNA, 875 bp, Homo sapiens
  Payload ID: 12077
  Gene Symbol: OFCC1
  Gene Name: orofacial cleft 1 candidate 1
  ENST ID: ENST00000611763
  CDS Start-End: 1-708
tttaggagagataagtttcagcagaaggctctgaagcaaactaagcagaagaaatccaagtcggctgaatttctgatggttaaagaagatagagaagctacagaaggcactggaaatccagcttttaacatgagcagtccagatctctcagcatgtcagactgcagaaaagaaagttattagacacgacatgccggatcgcacccttgcagctcaccaacaaaaattcaggctgccagcctctgcagaaccaaaaggcactatgccaggaaatgaatacggcagaaattactttgacccactgatggatgaggaaataaacccaaggcagtgtgcgacggaggtcagcagagaagatgacgatagaattttctataatcgattaacgaagctttttgatgagagcagacaaggagaaccccaagatgagagtggccgggaggagactctgaattctgaagcacctgggagttccaataagagtcacgaaatccacaaagaagccagcgaagccaccactgctcaccttgaggagttccaaagatctcagaaaactataattctgcttggaagttctccattagaacaggaaattagatctacttcattgcattgtatggaggatgagatgagtcatccatggatactcttgctcaaagtaactgctgtaatcagaagcaggaggtactatagagagcaaagattctaaaacccattctcaggtcagtgctcgcaatgttcttatgttcactgtgtcgggaagttccatgaacacacaaggcaacatcataagtaggaaaaaccttcagatttggtgttagaactcagagctgtcatccttgattcagatatttatgtgaacttaaacctctttgt

SEQ ID NO: 162793 - DNA, 802 bp, Homo sapiens
  Payload ID: 12078
  Gene Symbol: ORM1
  Gene Name: orosomucoid 1
  Uniprot ID: P02763
  ENST ID: ENST00000259396
  CDS Start-End: 79-684
gcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccggatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctataacaccacctacctgaatgtccagcgggaaaatgggaccatctccagatacgtgggaggccaagagcatttcgctcacttgctgatcctcagggacaccaagacctacatgcttgcttttgacgtgaacgatgagaagaactgggggctgtctgtctatgctgacaagccagagacgaccaaggagcaactgggagagttctacgaagctctcgactgcttgcgcattcccaagtcagatgtcgtgtacaccgattggaaaaaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacag

SEQ ID NO: 162794 - DNA, 760 bp, Homo sapiens
  Payload ID: 12079
  Gene Symbol: ORM2
  Gene Name: orosomucoid 2
  Uniprot ID: P19652
  ENST ID: ENST00000431067
  CDS Start-End: 37-642
agcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccggatcactggcaagtggttttatatcgcatcggcctttcgaaacgaggagtacaataagtcggttcaggagatccaagcaaccttcttttactttacccccaacaagacagaggacacgatctttctcagagagtaccagacccgccagaaccagtgcttctataactccagttacctgaatgtccagcgggagaatgggaccgtctccagatacgagggaggccgagaacatgttgctcacctgctgttccttagggacaccaagaccttgatgtttggttcctacctggacgatgagaagaactgggggctgtctttctatgctgacaagccagagacgaccaaggagcaactgggagagttctacgaagctctcgactgcttgtgcattcccaggtcagatgtcatgtacaccgactggaaaaaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacag

SEQ ID NO: 162795 - DNA, 2861 bp, Homo sapiens
  Payload ID: 12080
  Gene Symbol: OTX1
  Gene Name: orthodenticle homeobox 1
  Uniprot ID: P32242
  ENST ID: ENST00000282549
  CDS Start-End: 277-1341
acatacccggggagggcagtagaaaggtgatcaatcttcatcaggctacatttccaatcacctaaacaaccgagcaagacaagccactccgacaaggttggctgcccggcgggtctctgtgagagatccaggtagatggtgaacggccccggcagctgagggcaggccaggcccccagacgcatcagaccctgaaggactgcgtggtgggagccctgcaccgctcctggccccgggccccctggatccgtcggggcgcctccacccagctgttagcatgatgtcttacctcaaacaacccccatacggcatgaacgggctgggcctggccgggcccgccatggacctcctgcacccatccgtgggctatccggccactccgcggaagcagcggcgggagcgcaccaccttcacgcgttcacagctggacgtgctcgaggcgctcttcgccaagactcgctaccctgacatcttcatgcgggaggaggtggcgctcaagatcaacctgccggagtctagagtccaggtctggttcaagaaccgccgcgccaaatgccgccagcagcagcagagcgggagcggaaccaagagccgcccagccaagaagaagtcctctccagtgcgggagagctcgggctccgaaagcagtggccaattcacgccgccagctgtgtccagctctgcctcgtcctctagctcggcgtccagctcttccgccaacccagcggctgcagcggctgcgggactaggtgggaacccggtggcggccgcgtcgtcgctgagtacaccagctgcctcatctatctggagcccggcctccatctcgccaggctcagcgcccgcgtccgtgtcggtgccggagccattggccgcgcctagcaacacctcgtgtatgcagcgctccgtagctgcaggcgccgccaccgcagcagcctcttatcccatgtcctacggccagggcggcagctacggccaaggctaccctacgccctcctcttcctactttggcggcgtggactgcagctcatacctagcgcccatgcactcacatcaccacccgcaccagctcagccccatggcaccctcctccatggcgggccaccatcatcaccacccacatgcgcaccacccgttgagccagtcctcaggccaccaccaccaccatcaccaccaccaccaccaaggctacggtggctctgggcttgccttcaactctgccgactgcttggattacaaggagcctggcgccgctgctgcttcctccgcctggaaactcaacttcaactcccccgactgtctggactataaggaccaagcctcatggcggttccaggtcttgtgagcccaggaatgaaagaggagaagaaacgcaactacctgcgccctccgtggtcccgatcctgttgctgctgctgcaccgcccgcctttgcctcgtcttctccaaaactgaattttcaccccccaaaaagatgtccattgcctgcactgccgcccccatttttgtgccacttgcttggggggatgtgcaaacccaccctgccccttggatggggggaccggtgcttcggcttggcctacacattctatacaggagagatgtattatttccccccttcagcccctactaaactcttaagcctccccttccagtctttctggacagctattaagcacttgcagccttcggaggctctgcgctctgatccgctgtttgagcccaacactttaatttattctttctggacactggagtcactaactggcgtgtttctgcccattggagcacccgcacactactccaaatcaaaaccactaagagttcctcccgcgcagactgctgccccttcagctgccctcgattttgctccacgcctgccggccagagcctcccggcgtttcttccgccccagcggagtgcgctggggcgcgccagggctaggcccgccggaggagcgcgtccccagccttccgcgcacagagccgcatcccgccccgccctgcgctggactggttcaagcttccgcctcggcgggaacgctgtacatagtcaggtccgttccagggaccacttaaactttttagttgctgttggttggttgaactgaacatatcttgtcttagcacccaggaaacagaactttaagatatatacagcacatatatatatatatacatatatatatacacatatataaaaaacaaaagcaaaaaatattttccctctgtccgtcccccttctgctcttcctcaatcaatggcgctttttctttttcagttgttgcaaagctgccctgccctcttcacatcttctccctctgtgtatttattgaagagaaccgcttggtttcaggaagctgggcgcgggatatccgaagtgtggaggaaacagacaagtcagggtacagaggtgggggttgggcaggggcgcagggctgaccccctcacccggtctaagcacagggtcgcagttccagtttacaaacctaaaacaagaaaaccaaaaccagggaacaaaacaacaaaacaaaacaaaatccgtaaaagtacagcattagggaaaaacaaacaaacccaggccccaaacccagttccaactcctctgtcggcttctctctttcaacacccttgttttgtctagtgagtttttagtgcaccttcgttctccgaaatctgcggagagcccgcgcgcctgtgtatcaattttggctttggccgcttcgtccagtaggtgggaaagtaatttgtaaatttgatttgtctgatgtgaagatcacaaattacttgttgaaatgtaaggcagtccccctcctcctctttatctacattacttcccgaaaataaatgcaaattaatgaacggct

SEQ ID NO: 162796 - DNA, 2861 bp, Homo sapiens
  Payload ID: 12080
  Gene Symbol: OTX1
  Gene Name: orthodenticle homeobox 1
  Uniprot ID: P32242
  ENST ID: ENST00000366671
  CDS Start-End: 277-1341
ggacgctgggctccaacgtttcagtagaagcgcttaagacttgcaaacacccttggtggggacctggaaccccgggagatgccgacgagcaagcaggttggctgcccggcgggtctctgtgagagatccaggtagatggtgaacggccccggcagctgagggcaggccaggcccccagacgcatcagaccctgaaggactgcgtggtgggagccctgcaccgctcctggccccgggccccctggatccgtcggggcgcctccacccagctgttagcatgatgtcttacctcaaacaacccccatacggcatgaacgggctgggcctggccgggcccgccatggacctcctgcacccatccgtgggctatccggccactccgcggaagcagcggcgggagcgcaccaccttcacgcgttcacagctggacgtgctcgaggcgctcttcgccaagactcgctaccctgacatcttcatgcgggaggaggtggcgctcaagatcaacctgccggagtctagagtccaggtctggttcaagaaccgccgcgccaaatgccgccagcagcagcagagcgggagcggaaccaagagccgcccagccaagaagaagtcctctccagtgcgggagagctcgggctccgaaagcagtggccaattcacgccgccagctgtgtccagctctgcctcgtcctctagctcggcgtccagctcttccgccaacccagcggctgcagcggctgcgggactaggtgggaacccggtggcggccgcgtcgtcgctgagtacaccagctgcctcatctatctggagcccggcctccatctcgccaggctcagcgcccgcgtccgtgtcggtgccggagccattggccgcgcctagcaacacctcgtgtatgcagcgctccgtagctgcaggcgccgccaccgcagcagcctcttatcccatgtcctacggccagggcggcagctacggccaaggctaccctacgccctcctcttcctactttggcggcgtggactgcagctcatacctagcgcccatgcactcacatcaccacccgcaccagctcagccccatggcaccctcctccatggcgggccaccatcatcaccacccacatgcgcaccacccgttgagccagtcctcaggccaccaccaccaccatcaccaccaccaccaccaaggctacggtggctctgggcttgccttcaactctgccgactgcttggattacaaggagcctggcgccgctgctgcttcctccgcctggaaactcaacttcaactcccccgactgtctggactataaggaccaagcctcatggcggttccaggtcttgtgagcccaggaatgaaagaggagaagaaacgcaactacctgcgccctccgtggtcccgatcctgttgctgctgctgcaccgcccgcctttgcctcgtcttctccaaaactgaattttcaccccccaaaaagatgtccattgcctgcactgccgcccccatttttgtgccacttgcttggggggatgtgcaaacccaccctgccccttggatggggggaccggtgcttcggcttggcctacacattctatacaggagagatgtattatttccccccttcagcccctactaaactcttaagcctccccttccagtctttctggacagctattaagcacttgcagccttcggaggctctgcgctctgatccgctgtttgagcccaacactttaatttattctttctggacactggagtcactaactggcgtgtttctgcccattggagcacccgcacactactccaaatcaaaaccactaagagttcctcccgcgcagactgctgccccttcagctgccctcgattttgctccacgcctgccggccagagcctcccggcgtttcttccgccccagcggagtgcgctggggcgcgccagggctaggcccgccggaggagcgcgtccccagccttccgcgcacagagccgcatcccgccccgccctgcgctggactggttcaagcttccgcctcggcgggaacgctgtacatagtcaggtccgttccagggaccacttaaactttttagttgctgttggttggttgaactgaacatatcttgtcttagcacccaggaaacagaactttaagatatatacagcacatatatatatatatacatatatatatacacatatataaaaaacaaaagcaaaaaatattttccctctgtccgtcccccttctgctcttcctcaatcaatggcgctttttctttttcagttgttgcaaagctgccctgccctcttcacatcttctccctctgtgtatttattgaagagaaccgcttggtttcaggaagctgggcgcgggatatccgaagtgtggaggaaacagacaagtcagggtacagaggtgggggttgggcaggggcgcagggctgaccccctcacccggtctaagcacagggtcgcagttccagtttacaaacctaaaacaagaaaaccaaaaccagggaacaaaacaacaaaacaaaacaaaatccgtaaaagtacagcattagggaaaaacaaacaaacccaggccccaaacccagttccaactcctctgtcggcttctctctttcaacacccttgttttgtctagtgagtttttagtgcaccttcgttctccgaaatctgcggagagcccgcgcgcctgtgtatcaattttggctttggccgcttcgtccagtaggtgggaaagtaatttgtaaatttgatttgtctgatgtgaagatcacaaattacttgttgaaatgtaaggcagtccccctcctcctctttatctacattacttcccgaaaataaatgcaaattaatgaacggct

SEQ ID NO: 162797 - DNA, 1694 bp, Homo sapiens
  Payload ID: 12080
  Gene Symbol: OTX1
  Gene Name: orthodenticle homeobox 1
  ENST ID: ENST00000405984
  CDS Start-End: 248-553
atcaatcttcatcaggctacatttccaatcacctaaacaaccgagcaagacaagccactccgacaaggttggctgcccggcgggtctctgtgagagatccaggtagatggtgaacggccccggcagctgagggcaggccaggcccccagacgcatcagaccctgaaggactgcgtggtgggagccctgcaccgctcctggccccgggccccctggatccgtcggggcgcctccacccagctgttagcatgatgtcttacctcaaacaacccccatacggcatgaacgggctgggcctggccgggcccgccatggacctcctgcacccatccgtgggctatccggttcggctttcttttgcgaaggccgagatctgggcctgccaggggcctgcccgagtcctctatcgcgggtccacgtggccaccaatgacccgcggcgcccccgcgtgtccccgcagccactccgcggaagcagcggcgggagcgcaccaccttcacgcgttcacagctggacgtgctcgaggcgctcttcgccaagactcgctaccctgacatcttcatgcgggaggaggtggcgctcaagatcaacctgccggagtctagagtccaggtctggttcaagaaccgccgcgccaaatgccgccagcagcagcagagcgggagcggaaccaagagccgcccagccaagaagaagtcctctccagtgcgggagagctcgggctccgaaagcagtggccaattcacgccgccagctgtgtccagctctgcctcgtcctctagctcggcgtccagctcttccgccaacccagcggctgcagcggctgcgggactaggtgggaacccggtggcggccgcgtcgtcgctgagtacaccagctgcctcatctatctggagcccggcctccatctcgccaggctcagcgcccgcgtccgtgtcggtgccggagccattggccgcgcctagcaacacctcgtgtatgcagcgctccgtagctgcaggcgccgccaccgcagcagcctcttatcccatgtcctacggccagggcggcagctacggccaaggctaccctacgccctcctcttcctactttggcggcgtggactgcagctcatacctagcgcccatgcactcacatcaccacccgcaccagctcagccccatggcaccctcctccatggcgggccaccatcatcaccacccacatgcgcaccacccgttgagccagtcctcaggccaccaccaccaccatcaccaccaccaccaccaaggctacggtggctctgggcttgccttcaactctgccgactgcttggattacaaggagcctggcgccgctgctgcttcctccgcctggaaactcaacttcaactcccccgactgtctggactataaggaccaagcctcatggcggttccaggtcttgtgagcccaggaatgaaagaggagaagaaacgcaactacctgcgccctccgtggtcccgatcctgttgctgctgctgcaccgcccgcctttgcctcgtcttctccaaaactgaattttcaccccccaaaaagatgtccattgcctgcactgccgcccccatttttgtgccacttgcttggggggatgtgcaaacccaccctgccccttggatggggggaccggtgcttcggcttggcctacacattctatacaggagagatgtattatttc

SEQ ID NO: 162798 - DNA, 3001 bp, Homo sapiens
  Payload ID: 12081
  Gene Symbol: OTX2
  Gene Name: orthodenticle homeobox 2
  Uniprot ID: P32243
  ENST ID: ENST00000339475
  CDS Start-End: 278-1171
cctgagagcgggaccggcctcagctccaacacagcctccactgtgattaaaaataaaaattgctagagcagccctcactcgccacatctactttgatagctggctatttggaatttaaaggatatttgactttttctaacctcccatgaggctgtaagttccactgctccaaacccacccaccaaggactctgaacctgtccaccccgggcgcatcaagatcttccagctgggtacccccgatttgggccgactttgcacctccaaacaaccttagcatgatgtcttatcttaagcaaccgccttacgcagtcaatgggctgagtctgaccacttcgggtatggacttgctgcacccctccgtgggctacccggggccctgggcttcttgtcccgcagccaccccccggaaacagcgccgggagaggacgacgttcactcgggcgcagctagatgtgctggaagcactgtttgccaagacccggtacccagacatcttcatgcgagaggaggtggcactgaaaatcaacttgcccgagtcgagggtgcaggtatggtttaagaatcgaagagctaagtgccgccaacaacagcaacaacagcagaatggaggtcaaaacaaagtgagacctgccaaaaagaagacatctccagctcgggaagtgagttcagagagtggaacaagtggccaattcactcccccctctagcacctcagtcccgaccattgccagcagcagtgctcctgtgtctatctggagcccagcttccatctccccactgtcagatcccttgtccacctcctcttcctgcatgcagaggtcctatcccatgacctatactcaggcttcaggttatagtcaaggatatgctggctcaacttcctactttgggggcatggactgtggatcatatttgacccctatgcatcaccagcttcccggaccaggggccacactcagtcccatgggtaccaatgcagtcaccagccatctcaatcagtccccagcttctctttccacccagggatatggagcttcaagcttgggttttaactcaaccactgattgcttggattataaggaccaaactgcctcctggaagcttaacttcaatgctgactgcttggattataaagatcagacatcctcgtggaaattccaggttttgtgaagacctgtagaacctctttttgtgggtgatttttaaatatactgggctggacattccagttttagccaggcattggttaaaagagttagatgggatgatgctcagactcatctgatcaaagttccgagaggcatagaaggaaaaacgaagggccttagaggggcctacaaaccagcaacatgaaatggacaaaccaatctgcttaagatcctgtcatagttttagatcattggttatcctgatttgcaaagtgatcaaaagcattctagccatgtgcaaccaaacaccaccaaaaataaaatcaaacaaaactaagttgtgaaggaagggagggaaggtcatagccttcttaagcagaggtgttccattgttttagccaatccttggttgaatcttaggaatgaacagtgtctcaagctcattcacgtttcatgaccaactggtagttggcactgaaaaaacttttcagggctgtgtgaattgtgtgactgattgtcctagatgcactactttatttaaaaaataatgttcataaggagtcaatatgtagtttaagagacaatcagtgtgtgtcttataaatggtacatctgtggtttttaatctgtgctagacttcaaaactgtgatctcctgttattgtatgcaaccttgaactccacctctgcaggggttcttctgtgattaaataggttataattataagcaaaattcagagcaactgagtactgatctaaaaagattacctttggctggaggtgagctgcactgaaactttacgacaaaatgtctctggacaaagagagtcagagaagagaagcaaaaggacactaattcatctgtaatttactgttggtaagcctagcagtaaagagacattggtcaattgctctgaccctgatgaattattaaactgagatcattgtcgtttatgcttgcagatgttaaatggaaaagttatatatgcataaaccttttcttcctggatttggcagatatgtataattatattaaaatggttctagcacaacattgggtccagtttaattttacaccgctatttatgaataagaagcctacattcagcctttcctccccaaaacacgtttttcttaggacagagagtaaattagcaaacttatttttactttttttttttgctaatctatgcataaaatagatatgaatgacagtggtaggtagactttttgtgactttcatcaggattgctctgaaattgagtttggagagcctaacaacaagatcttgttttccttgcttttccctccctacttcaaacctgaacgatttcttaggcactttattagaatgttttaaaatatatcaagtttttaagagggaggaggagaattggagtatctctgaaaacatgagaatgacaagaatttcttgttactattctcttatttgattaaggggattttttttttttaacttccaaaaactgaggtaaacatgagagggagtgtaatcagaatctgaaagtaattcaggcagaaatgattcctgaacaaaagagtttcagaaaagttttaaaacctataatttcagtagttgaacataaggcaccctggtcagtttgtgtgtatgtgtttaagaaagtgccgagggggaaaaaatgggtcccttttcagttgtacctgcattttgtaaaccagtcaccagaaaagacaaatgggccaatgatcatggtgctcctcaggtaaaagcaatatttaatttcattttaagctgcttaagctcttacagctgaccaaaattaagtgactcttgattgtaacgttttaaatgaaggttagcagttgcaacca

SEQ ID NO: 162799 - DNA, 1082 bp, Homo sapiens
  Payload ID: 12081
  Gene Symbol: OTX2
  Gene Name: orthodenticle homeobox 2
  Uniprot ID: P32243
  ENST ID: ENST00000408990
  CDS Start-End: 208-1077
tttttaagttagtgctggaacgtggaagagctgctgcctccgaagcagtaaaccagcccctctgtttgtttgtttgctttgcccttagttccactgctccaaacccacccaccaaggactctgaacctgtccaccccgggcgcatcaagatcttccagctgggtacccccgatttgggccgactttgcacctccaaacaaccttagcatgatgtcttatcttaagcaaccgccttacgcagtcaatgggctgagtctgaccacttcgggtatggacttgctgcacccctccgtgggctacccggccaccccccggaaacagcgccgggagaggacgacgttcactcgggcgcagctagatgtgctggaagcactgtttgccaagacccggtacccagacatcttcatgcgagaggaggtggcactgaaaatcaacttgcccgagtcgagggtgcaggtatggtttaagaatcgaagagctaagtgccgccaacaacagcaacaacagcagaatggaggtcaaaacaaagtgagacctgccaaaaagaagacatctccagctcgggaagtgagttcagagagtggaacaagtggccaattcactcccccctctagcacctcagtcccgaccattgccagcagcagtgctcctgtgtctatctggagcccagcttccatctccccactgtcagatcccttgtccacctcctcttcctgcatgcagaggtcctatcccatgacctatactcaggcttcaggttatagtcaaggatatgctggctcaacttcctactttgggggcatggactgtggatcatatttgacccctatgcatcaccagcttcccggaccaggggccacactcagtcccatgggtaccaatgcagtcaccagccatctcaatcagtccccagcttctctttccacccagggatatggagcttcaagcttgggttttaactcaaccactgattgcttggattataaggaccaaactgcctcctggaagcttaacttcaatgctgactgcttggattataaagatcagacatcctcgtggaaattccaggttttgtgaagacc

SEQ ID NO: 162800 - DNA, 715 bp, Homo sapiens
  Payload ID: 12081
  Gene Symbol: OTX2
  Gene Name: orthodenticle homeobox 2
  ENST ID: ENST00000554559
  CDS Start-End: 288-395
agcaaatctccctgagagcgggaccggcctcagctccaacacagcctccactgtgattaaaaataaaaattgctagagcagccctcactcgccacatctactttgatagctggctatttggaatttaaaggatatttgactttttctaacctcccatgaggctgtaagttccactgctccaaacccacccaccaaggactctgaacctgtccaccccgggcgcatcaagatcttccagctgggtacccccgatttgggccgactttgcacctccaaacaaccttagcatgatgtcttatcttaagcaaccgccttacgcagtcaatgggctgagtctgaccacttcgggtatggacttgctgcacccctccgtgggctacccgggtatggtttaagaatcgaagagctaagtgccgccaacaacagcaacaacagcagaatggaggtcaaaacaaagtgagacctgccaaaaagaagacatctccagctcgggaagtgagttcagagagtggaacaagtggccaattcactcccccctctagcacctcagtcccgaccattgccagcagcagtgctcctgtgtctatctggagcccagcttccatctccccactgtcagatcccttgtccacctcctcttcctgcatgcagaggtcctatcccatgacctatactcaggcttcaggttatagtcaaggatatgctggctcaactt

SEQ ID NO: 162801 - DNA, 797 bp, Homo sapiens
  Payload ID: 12081
  Gene Symbol: OTX2
  Gene Name: orthodenticle homeobox 2
  ENST ID: ENST00000555804
  CDS Start-End: 308-797
agcaaatctccctgagagcgggaccggcctcagctccaacacagcctccactgtgattaaaaataaaaattgctagagcagccctcactcgccacatctactttgatagctggctatttggaatttaaaggatatttgactttttctaacctcccatgaggctgtaaggattgtaggaaacttgaaagttccactgctccaaacccacccaccaaggactctgaacctgtccaccccgggcgcatcaagatcttccagctgggtacccccgatttgggccgactttgcacctccaaacaaccttagcatgatgtcttatcttaagcaaccgccttacgcagtcaatgggctgagtctgaccacttcgggtatggacttgctgcacccctccgtgggctacccggccaccccccggaaacagcgccgggagaggacgacgttcactcgggcgcagctagatgtgctggaagcactgtttgccaagacccggtacccagacatcttcatgcgagaggaggtggcactgaaaatcaacttgcccgagtcgagggtgcaggtatggtttaagaatcgaagagctaagtgccgccaacaacagcaacaacagcagaatggaggtcaaaacaaagtgagacctgccaaaaagaagacatctccagctcgggaagtgagttcagagagtggaacaagtggccaattcactcccccctctagcacctcagtcccgaccattgccagcagcagtgctcctgtgtctatctggagcccagcttccatctccccactgtcagatccct

SEQ ID NO: 162802 - DNA, 908 bp, Homo sapiens
  Payload ID: 12081
  Gene Symbol: OTX2
  Gene Name: orthodenticle homeobox 2
  ENST ID: ENST00000554845
  CDS Start-End: 193-908
tggaacgtggaagagctgctgcctccgaagcagtaaaccagcccctctgtttgtttgtttgctttgcccttagttccactgctccaaacccacccaccaaggactctgaacctgtccaccccgggcgcatcaagatcttccagctgggtacccccgatttgggccgactttgcacctccaaacaaccttagcatgatgtcttatcttaagcaaccgccttacgcagtcaatgggctgagtctgaccacttcgggtatggacttgctgcacccctccgtgggctacccggggccctgggcttcttgtcccgcagccaccccccggaaacagcgccgggagaggacgacgttcactcgggcgcagctagatgtgctggaagcactgtttgccaagacccggtacccagacatcttcatgcgagaggaggtggcactgaaaatcaacttgcccgagtcgagggtgcaggtatggtttaagaatcgaagagctaagtgccgccaacaacagcaacaacagcagaatggaggtcaaaacaaagtgagacctgccaaaaagaagacatctccagctcgggaagtgagttcagagagtggaacaagtggccaattcactcccccctctagcacctcagtcccgaccattgccagcagcagtgctcctgtgtctatctggagcccagcttccatctccccactgtcagatcccttgtccacctcctcttcctgcatgcagaggtcctatcccatgacctatactcaggcttcaggttatagtcaaggatatgctggctcaacttcctactttgggggcatggactgtggatcatatttgacccctatgcatcaccagcttcccggaccaggggccacactcagtcccatgggtaccaatgcagtcaccagccatct

SEQ ID NO: 162803 - DNA, 1279 bp, Homo sapiens
  Payload ID: 12081
  Gene Symbol: OTX2
  Gene Name: orthodenticle homeobox 2
  Uniprot ID: P32243
  ENST ID: ENST00000555006
  CDS Start-End: 410-1279
agctccaacacagcctccactgtgattaaaaataaaaattgctagagcagccctcactcgccacatctactttgtatgtattgcagaggggcccacgcgtgtttagaactctagccgccttcctcattttcgttctttaaaaaaaattttttttggttgtgtttgacttttcatggaagggtgaagactgcaaggtttctaactcaatactcttgatttcttttaggatagctggctatttggaatttaaaggatatttgactttttctaacctcccatgaggctgtaagttccactgctccaaacccacccaccaaggactctgaacctgtccaccccgggcgcatcaagatcttccagctgggtacccccgatttgggccgactttgcacctccaaacaaccttagcatgatgtcttatcttaagcaaccgccttacgcagtcaatgggctgagtctgaccacttcgggtatggacttgctgcacccctccgtgggctacccggccaccccccggaaacagcgccgggagaggacgacgttcactcgggcgcagctagatgtgctggaagcactgtttgccaagacccggtacccagacatcttcatgcgagaggaggtggcactgaaaatcaacttgcccgagtcgagggtgcaggtatggtttaagaatcgaagagctaagtgccgccaacaacagcaacaacagcagaatggaggtcaaaacaaagtgagacctgccaaaaagaagacatctccagctcgggaagtgagttcagagagtggaacaagtggccaattcactcccccctctagcacctcagtcccgaccattgccagcagcagtgctcctgtgtctatctggagcccagcttccatctccccactgtcagatcccttgtccacctcctcttcctgcatgcagaggtcctatcccatgacctatactcaggcttcaggttatagtcaaggatatgctggctcaacttcctactttgggggcatggactgtggatcatatttgacccctatgcatcaccagcttcccggaccaggggccacactcagtcccatgggtaccaatgcagtcaccagccatctcaatcagtccccagcttctctttccacccagggatatggagcttcaagcttgggttttaactcaaccactgattgcttggattataaggaccaaactgcctcctggaagcttaacttcaatgctgactgcttggattataaagatcagacatcctcgtggaaattccaggttttgtga

SEQ ID NO: 162804 - DNA, 835 bp, Homo sapiens
  Payload ID: 12081
  Gene Symbol: OTX2
  Gene Name: orthodenticle homeobox 2
  ENST ID: ENST00000554788
  CDS Start-End: 193-300
tggaacgtggaagagctgctgcctccgaagcagtaaaccagcccctctgtttgtttgtttgctttgcccttagttccactgctccaaacccacccaccaaggactctgaacctgtccaccccgggcgcatcaagatcttccagctgggtacccccgatttgggccgactttgcacctccaaacaaccttagcatgatgtcttatcttaagcaaccgccttacgcagtcaatgggctgagtctgaccacttcgggtatggacttgctgcacccctccgtgggctacccgggtatggtttaagaatcgaagagctaagtgccgccaacaacagcaacaacagcagaatggaggtcaaaacaaagtgagacctgccaaaaagaagacatctccagctcgggaagtgagttcagagagtggaacaagtggccaattcactcccccctctagcacctcagtcccgaccattgccagcagcagtgctcctgtgtctatctggagcccagcttccatctccccactgtcagatcccttgtccacctcctcttcctgcatgcagaggtcctatcccatgacctatactcaggcttcaggttatagtcaaggatatgctggctcaacttcctactttgggggcatggactgtggatcatatttgacccctatgcatcaccagcttcccggaccaggggccacactcagtcccatgggtaccaatgcagtcaccagccatctcaatcagtccccagcttctctttccacccagggatatggagcttcaagcttgggttttaactcaaccactgattgcttggattataaggaccaaactgcctcc

SEQ ID NO: 162805 - DNA, 3669 bp, Homo sapiens
  Payload ID: 12082
  Gene Symbol: OTP
  Gene Name: orthopedia homeobox
  Uniprot ID: Q5XKR4
  ENST ID: ENST00000306422
  CDS Start-End: 1140-2117
tactctggttagaaatatattactaatctaaactttgttgttggctggctctgaaaaatcagaacattagaaatggttcgcttcacttgtgcaaagcactttaaattgttcaagtagtttaacatattcaagaggaaaataaagagcatttaactttatttacagccttaagtggagttgggagccgagctgaacttagaaactttgaccaaaagagcgagttaggggcgaggatgcgggcgtgggccaagcggaagagcaggagccgggaagaagcccggtgagaagagtgcagagcgctcgaacccacactccgcgagggtccccaaagcagacagcgggcgctggcggtgccagggaagccgactcctctttgcgctctaggcccactgtggggttggggctcgtatagaccccagggcacagccagggcgcctggaccctaggcgcaggcctactgagccgcggcgaagtccaggcgttgtctgaaggccgcggtgtgccctcgtcgcgccctgggctggcgggccaatatgagcggcaggcccagagagcgcaggtgggggcgaccctcaggtcacgccagggtcatggcccgctctgacccctgctctgcccctgccctaggaagatgttagctcagaggcacagagctacgccttcgaagcgcgcagcgccggccaaggggaaggaaaggggagcctggagaaaatcgcagggaagaactagagggagccgggcccagaagctcagggcgaggccgaggcggctgaggctgctttagctcctgctccgggctggagctgccagggctgccgccgccgcctccttcaggcgggcgcaggcgagcgggcgggcggagtgggggactctccgggcgctgacatttgcaggctgccctcctgattggtcccctcgccgagctgctcacgggttcattcaactgttaagcacctccccgtctctctaaaggacattataatgcaagaagccccctttttaaccacaaaccgaattttctttcatttaggtgatctatatatatctatatcgtatagcttatagcttatatctattttaaataacttaaagccgctaaaatttgggggggaacagctttcgccctggagcggtgcgcgatgctgtctcatgccgacctcctggacgccaggctaggtatgaaagatgccgccgagcttctgggccaccgggaggcggtgaagtgtaggctgggcgtggggggctccgaccccgggggccatccgggggacctggcgcccaactctgacccagtggagggagccactctgctgcccggggaggacatcaccacagtgggctctactccggcctcgctggcggtgagcgccaaagacccggacaagcagcccgggccccagggcggcccgaaccccagccaagccggccagcagcagggccaacagaagcagaagcgccaccggacgcgcttcacccccgcacagctcaacgagttggagaggagcttcgccaagactcactaccccgacatctttatgcgtgaggagctggcactgcgtatcgggctgaccgagtcccgagtgcaggtctggttccagaaccgacgcgccaagtggaagaagcgcaaaaagacgaccaacgtgttccgtgcgcccggcacactgctgcccacgccaggcctgcctcagttcccgtcggctgccgccgccgctgccgccgccatgggcgacagcctgtgctctttccacgccaacgacacccgctgggcggcggccgccatgcctggcgtgtcacagctgcctctgccgccggcgctgggcaggcagcaggccatggcgcagtcgctgtcccagtgcagcctggcggccggtccgccgcccaactccatgggcctgtccaacagcctggcgggttccaacggcgcggggctgcagtcgcacctctaccagcccgccttccccggcatggtgcccgcctccctccccggccccagcaacgtctccggttcgccccagctctgcagctccccggacagcagcgacgtgtggcggggcaccagcatcgcctccctccgccgcaaggcgctagagcacacagtctctatgagcttcacttaatgcagccgcgccccggcccgctccgcccccagcaccgccccgggggccgccccgaggcccttccggcgcgcacccggaccccggcgccctgccccgtcccgccccggccttcgccccgtctcgtttcgtcctcgcctctctcctccactcgctcgggctcaccccaagccccagcccgcgaggcctcccctccgcctgatttcgatcgcccgcggtcccccgtctcccggccgcccctcttcccttcccacccagctgcgccctcggctcggtctccagcgcctcagcccacccttcccgccaccctggcctccctgcttgcgctggccgtgctcgcgccctcctcctggccttctgacgggcggcgttcccacccacaccttcgacgcgacgcctacgacccccctcgcccgccgcctcccctccggtcccctctttccccacacttcgcgaccctcctcccgcgcccggcaaaaagtatccttcccgccattttacgtaccagggagtcgactcaggatctgaaatcagacaccaatggactggtttgtgggcagaaacacacacactcgcactctcgctcacgctcagacgctacacacgcgcgcgcacagacacggtgcacctaggtcacacacggacgtgttcaagggacagcacaatgttagggatttttgtcttaaaggaggacaagcattgctaccaaccgcctcatctgagggcccaactgatatgatttgatttatccttgtactctccaagctcctgtctttctttcctctcccaccacgctacccttgcccagtccacccagtcacatccgtgcagccctctcttggcttgcaagataacgcttttatttttattttatcttattttcattttcttaagcacaactgtgtgagagtgtagaagggaaggcttctcaggaggaacgtgacagtggattgggtggctggagtagactaaagcagtcatgtgacgaggaagaggtgatctgacccattttgataagtctttataaggaagaataaaataaacgtgtaagcaaaattttcttttgtaaaagcaaaagccacatctcttttctggatccttcaggactggggtttgtttgcttccttttctgtttctgtcttctcgctgctctgtgcccttggttgttttgtggtggtcctgtcgtccctcgtgcccctcggccacctgctggcagccgatgggggcactcggacatctacaaccctgcaactttgtacagagaaacacaatcagctctttctgcatgtgctggtcaaatccaaacccagagaacagaagcgctttctaagaatgaacaaatatgtgaaataggatgttttgtgtagataaagcattcttgttacatactggtcaatttgtgatatgttttaacttaatgtctgtgtttatttatggaattcggttttcttaataaatgtttgagctaatataaagcatattatttgacttttccggacaagtttatatcaagttaaatgtaaatggataaaataaaatcattttcagtatgtga

SEQ ID NO: 162806 - DNA, 2002 bp, Homo sapiens
  Payload ID: 12083
  Gene Symbol: OSGEP
  Gene Name: O-sialoglycoprotein endopeptidase
  Uniprot ID: Q9NPF4
  ENST ID: ENST00000206542
  CDS Start-End: 423-1430
ctcgcctccctcctctaattctctaggacacttaggtccccaaccctccctcgggctgtttatcgttgtgccagatgcacagcacattgtgtgacactgacttaagattctaactatgtgcaagagggaaaaaaacagtggagaaggctgggctggaccacgggaaagagataggaaaacggatacgaatgtaaggcacagagttggctcggcgtccctggcagttaggaagacaggtccctggaggggccttggcgggtctccgctcgcgggagttccgcggtgtctttcccagtgctatctgcaggctggccagcttcctctgcgctccggaaagctgcggcccagcgcggactagtgaggacctccacagctcctgacattgccaggagtcctgtcggcgttttctcccagcctccgccatgccggcggtgctgggttttgaaggcagcgccaataagattggcgtgggcgtggtgcgggatggcaaggtgctggcgaacccgcggcggacttacgtcacgcctcctggcacaggattccttccaggtgatacagccaggcatcaccgagctgttatcctagacctgctgcaggaggcactaacagagtctggattaacctcccaggatatcgactgcattgcatacaccaagggccctggcatgggtgccccactggtttctgtggctgttgtggcccgtactgtggcccaactgtggaataagccattggtgggtgtgaaccactgtataggccacattgagatgggccgcctcatcactggagccaccagcccaaccgtgttgtatgtgagtggaggaaatacgcaggtgattgcatactcggaacatcgttaccgtatctttggggaaaccatcgatattgcagtgggtaattgtctggatcgttttgctcgagtgctgaagatttctaacgacccaagtccaggatacaacattgaacagatggcaaagcgaggcaagaagctagttgagctgccatacactgtaaaggggatggacgtctcattctcagggatcctgtctttcattgaggatgtagcccatcggatgctggccacaggcgagtgtactcctgaggatctgtgtttctccctgcaggaaactgtgtttgcaatgctggtagagatcacagagcgagccatggcacattgtggctcccaggaggccctcattgtgggaggagtggggtgtaatgtgaggctacaggagatgatggcaacaatgtgccaggaacgtggagcccggctttttgctacagatgagagattctgtattgacaatggagcgatgatagcccaggctggctgggagatgtttcgggctggacacaggaccccactcagtgattctggggttacacagaggtatcggacagatgaagtagaggtgacctggagggactaataagatcaacagaatcagagtagatagttccttaatcggaacccaaaggaccccgtgcctcaatctctatcctgatgtcatgggagtcctagcaaagctatagactccaagcaaggcttggggtcctttatggaaccccaggatgactcagcaataaaatatttttggttttttggttttgtatgttggtgattggattgtgttgttcaggaccaatgtagatttggtgctggataaattcttgttggagcttgctgctgtggaaccaagaatgaggtatctttttttttttttttaagaaacggaatcttgctgtgtttcccaggctggtctcgaactgggctcaagcagtcttaccacctcagcctcctgagtaaggatgccattgtgcctggcaacaatagtagtatcataactattattatagcatcgggtcccgtgctaactgctttacattcattctctcatttaaattctttgaagtaggtgtgcaagacttctctcaaaatagcctggaggctcacacctgttatcccagtgctgtgggaggccaagtcaggaggatcccttga

SEQ ID NO: 162807 - DNA, 773 bp, Homo sapiens
  Payload ID: 12083
  Gene Symbol: OSGEP
  Gene Name: O-sialoglycoprotein endopeptidase
  ENST ID: ENST00000555223
  CDS Start-End: 1-335
gattccttccaggtgatacagccaggcatcaccgagctgttatcctagacctgctgcaggaggcactaacagagtctggattaacctcccaggatatcgactgcattgcatacaccaagggccctggcatgggtgccccactggtttctgtggctgttgtggcccgtactgtggcccaactgtggaataagccattggtgggtgtgaaccactgtataggccacattgagatgggccgcctcatcactggagccaccagcccaaccgtgttgtatgtgagtggaggaaatacgcagacttggggtttcatggacttcctcatcacccttaggtgattgcatactcggaacatcgttaccgtatctttggggaaaccatcgatattgcagtgggtaattgtctggatcgttttgctcgagtgctgaagatttctaacgacccaagtccaggatacaacattgaacagatggcaaagcgaggcaagaagctagttgagctgccatacactgtaaaggggatggacgtctcattctcagggatcctgtctttcattgaggatgtagcccatcggatgctggccacaggcgagtgtactcctgaggatctgtgtttctccctgcaggaaactgtgtttgcaatgctggtagagatcacagagcgagccatggcacattgtggctcccaggaggccctcattgtgggaggagtggggtgtaatgtgaggctacaggagatgatggcaacaatgtgccaggaacgtggagcccggcttt

SEQ ID NO: 162808 - DNA, 578 bp, Homo sapiens
  Payload ID: 12083
  Gene Symbol: OSGEP
  Gene Name: O-sialoglycoprotein endopeptidase
  ENST ID: ENST00000553640
  CDS Start-End: 130-578
agtgctatctgcaggctggccagcttcctctgcgctccggaaagctgcggcccagcgcggactagtgaggacctccacagctcctgacattgccaggagtcctgtcggcgttttctcccagcctccgccatgccggcggtgctgggttttgaaggcagcgccaataagattggcgtgggcgtggtgcgggatggcaaggtgctggcgaacccgcggcggacttacgtcacgcctcctggcacaggattccttccaggtgatacagccaggcatcaccgagctgttatcctagacctgctgcaggaggcactaacagagtctggattaacctcccaggatatcgactgcattgcatacaccaagggccctggcatgggtgccccactggtttctgtggctgttgtggcccgtactgtggcccaactgtggaataagccattggtgggtgtgaaccactgtataggccacattgagatgggccgcctcatcactggagccaccagcccaaccgtgttgtatgtgattgcatactcggaacatcgttaccgtatctttggggaaaccatcgatattgcagt

SEQ ID NO: 162809 - DNA, 1885 bp, Homo sapiens
  Payload ID: 12084
  Gene Symbol: OSGEPL1
  Gene Name: O-sialoglycoprotein endopeptidase-like 1
  Uniprot ID: Q9H4B0
  ENST ID: ENST00000264151
  CDS Start-End: 104-1348
ctttctcctgcagcgataagggcagtcgacagtctttagtagggaaaggagacaagtgctagctactgccgcccaagtggaaggaattatctatagagtaagtatgctaatcttgactaagactgcaggagttttttttaaaccatcaaaaaggaaagtttatgaatttttaagaagttttaattttcatcctggaacactatttcttcataaaatagtattgggaattgaaactagttgtgatgatacagcagctgctgtggtggatgaaactggaaatgtgttgggagaagcaatacattcccaaactgaagttcatttaaaaacaggtgggattgttcctccagcagctcaacagcttcacagagaaaatattcaacgaatagtacaagaagctctttctgccagtggagtctctccaagtgacctctcagcaattgcaactaccataaaaccaggacttgctttaagcctgggagtgggcttatcatttagcttacagctggtaggacagttaaaaaagccattcattcccattcatcatatggaggctcatgcacttactattaggttgaccaataaagtagaatttccttttttagttcttttgatttctggaggtcactgtctgttggcattagttcaaggagtttcagattttctgcttcttggaaagtctttggacatagcaccaggtgacatgcttgacaaggtggcaagaagactttctttaataaaacatccagagtgctccaccatgagtggtgggaaagccatagaacatttggccaaacaaggaaatagatttcattttgacatcaaacctcccttgcatcatgctaaaaattgtgatttttcttttactggacttcaacacgttactgataaaataataatgaaaaaggaaaaagaggaaggtattgagaaggggcaaatcctgtcttcagcagcagacattgctgccacagtacagcacacaatggcatgtcatcttgtgaaaagaacacatcgggctattctgttttgtaagcagagagacttgttacctcaaaataatgcagtactggttgcatctggtggtgtcgcaagtaacttctatatccgcagagctctggaaattttaacaaatgcaacacagtgcactttgttgtgtcctcctcccagactatgcactgataatggcattatgattgcatggaatggtattgaaagactacgtgctggcttgggcattttacatgacatagaaggcatccgctatgaaccaaaatgtcctcttggagtagacatatcaaaagaagttggagaagcttccataaaagtaccacaattaaaaatggagatatgatttctgctgttcaaaaaagtccctaaagagacaggctcttgccatgttgcccgggctggtcctgaactgctgaattcaagtgatcctcccaccttggcctccagaagtgctgggattatgggtgtgagccaccatgcctagccaaaatgtttcttaaggtatacattttgggtcttagaagacttatacatttgtaatatttattactaaatatctcaaagtattacaataaatgttaccatgtgagctactttgaatcaggcttcttgcacaccaatttaaaaatgttaactcttgatatatacactagttataccactcatgtcagtcaataaattttaaggtttaagtgcaggcctttgtttacagaaatcctaattttttgaaaccataactctgacctgacactaaattcctgtagacatgctaaggaaaatctgcttagtatcgagatcaagaactttcattcaaaaagattattcagttatgttatttgcatattaccattattaaaaataaaaaaatttttaaaagatg

SEQ ID NO: 162810 - DNA, 2216 bp, Homo sapiens
  Payload ID: 12084
  Gene Symbol: OSGEPL1
  Gene Name: O-sialoglycoprotein endopeptidase-like 1
  Uniprot ID: Q9H4B0
  ENST ID: ENST00000519810
  CDS Start-End: 344-1438
ctttggtaaccctgctagggggcgccgctagattccatcctatttctccgatgaaagtatcagaactctcatcacctgcaaatctgggggaaatgcaggtgcgcacagagagcgttttgggcaaagacggcctttaagcttttcttcactaagcatgccgctcgctagcggaacagcagccagctctggacgggaccttgcacagttccgatgacatcacttccgggcgccaggttcgggctttctcctgcagcgataagggcagtcgacagtctttagtagggaaaggagacaagtgctagctactgccgcccaagtggaaggaattatctatagagtaagtatgctaatcttgactaagactgcaggagttttttttaaaccatcaaaaaggaaagtttatgaatttttaagaagttttaattttcatcctggaacactatttcttcataaaatagtattgggaattgaaactagttgtgatgatacagcagctgctgtggtggatgaaactggaaatgtgttgggagaagcaatacattcccaaactgaagttcatttaaaaacaggtgggattgttcctccagcagctcaacagcttcacagagaaaatattcaacgaatagtacaagaagctctttctgccagtggagtctctccaagtgacctctcagcaattgcaactaccataaaaccaggacttgctttaagcctgggagtgggcttatcatttagcttacagctggtaggacagttaaaaaagccattcattcccattcatcatatggaggctcatgcacttactattaggttgaccaataaagtagaatttccttttttagttcttttgatttctggaggtcactgtctgttggcattagttcaaggagtttcagattttctgcttcttggaaagtctttggacatagcaccaggtgacatgcttgacaaggtggcaagaagactttctttaataaaacatccagagtgctccaccatgagtggtgggaaagccatagaacatttggccaaacaaggaaatagatttcattttgacatcaaacctcccttgcatcatgctaaaaattgtgatttttcttttactggacttcaacacgttactgataaaataataatgaaaaaggaaaaagaggaaggtattgagaaggggcaaatcctgtcttcagcagcagacattgctgccacagtacagcacacaatggcatgtcatcttgtgaaaagaacacatcgggctattctgttttgtaagcagagagacttgttacctcaaaataatgcagtactggttgcatctggtggtgtcgcaagtaacttctatatccgcagagctctggaaattttaacaaatgcaacacagtgcactttgttgtgtcctcctcccagactatgcactgataatggcattatgattgcatgatgtcctcttggagtagacatatcaaaagaagttggagaagcttccataaaagtaccacaattaaaaatggagatatgatttctgctgttcaaaaaagtccctaaagggtctcactctctgacctcagctggagtacagtagccagatcacaactcactgcaaccctgacttcctgaactcaagcaatcctcctgccttagcctcttgaatagccgggactacaggtgtgcatgtccatgcccagccaactttatttctattttttgtagagacaggctcttgccatgttgcccgggctggtcctgaactgctgaattcaagtgatcctcccaccttggcctccagaagtgctgggattatgggtgtgagccaccatgcctagccaaaatgtttcttaaggtatacattttgggtcttagaagacttatacatttgtaatatttattactaaatatctcaaagtattacaataaatgttaccatgtgagctactttgaatcaggcttcttgcacaccaatttaaaaatgttaactcttgatatatacactagttataccactcatgtcagtcaataaattttaaggtttaagtgcaggcctttgtttacagaaatcctaattttttgaaaccataactctgacctgacactaaattcctgtagacatgctaaggaaaatctgcttagtatcgagatcaagaactttcattcaaaaagattattcagttatgttatttgcatattaccattattaaaaataaaaaaatttttaaaagatg

SEQ ID NO: 162811 - DNA, 874 bp, Homo sapiens
  Payload ID: 12084
  Gene Symbol: OSGEPL1
  Gene Name: O-sialoglycoprotein endopeptidase-like 1
  ENST ID: ENST00000521630
  CDS Start-End: 266-874
aggttcgggctttctcctgcagcgataagggcagtcgacagtctttagtagggaaaggagacaagtgctagctactgccgcccaagtggaaggtgggtgaaattgctcactcttcaccccactgacgcttttgcgcacctggaaaagcggttccagtttgcgcccgtcgccgccttacagccgacaggagaccagcgctacccaagtcacgtgggttcagcctgcagctttcttggcccgaaagggaattatctatagagtaagtatgctaatcttgactaagactgcaggagttttttttaaaccatcaaaaaggaaagtttatgaatttttaagaagttttaattttcatcctggaacactatttcttcataaaatagtattgggaattgaaactagttgtgatgatacagcagctgctgtggtggatgaaactggaaatgtgttgggagaagcaatacattcccaaactgaagttcatttaaaaacaggtgggattgttcctccagcagctcaacagcttcacagagaaaatattcaacgaatagtacaagaagctctttctgccagtggagtctctccaagtgacctctcagcaattgcaactaccataaaaccaggacttgctttaagcctgggagtgggcttatcatttagcttacagctggtaggacagttaaaaaagccattcattcccattcatcatatggaggctcatgcacttactattaggttgaccaataaagtagaatttccttttttagttcttttgatttctggaggtcactgtctgttggcattagttcaaggagtttcagattttctgcttcttggaaagtctttggacatagcaccaggtgacatgcttgacaag

SEQ ID NO: 162812 - DNA, 1779 bp, Homo sapiens
  Payload ID: 12084
  Gene Symbol: OSGEPL1
  Gene Name: O-sialoglycoprotein endopeptidase-like 1
  Uniprot ID: Q9H4B0
  ENST ID: ENST00000522700
  CDS Start-End: 535-1779
agattccatcctatttctccgatgaaagtatcaggtacctcacccctaagtttagatttgatgatagttcccttaaaaatgaatgacgaataatctaccccatccttttctcacagtagcaaccaaattccagccaagggcaaaaaaaaaatttctttttaatgtagcttagtgtttggaacttgatgttgtgtagtcagacaaacctgtattcggcctccgctggatcagtcactagctgtgtaattttacagaactctcatcacctgcaaatctgggggaaatgcaggtgcgcacagagagcgttttgggcaaagacggcctttaagcttttcttcactaagcatgccgctcgctagcggaacagcagccagctctggacgggaccttgcacagttccgatgacatcacttccgggcgccaggttcgggctttctcctgcagcgataagggcagtcgacagtctttagtagggaaaggagacaagtgctagctactgccgcccaagtggaaggaattatctatagagtaagtatgctaatcttgactaagactgcaggagttttttttaaaccatcaaaaaggaaagtttatgaatttttaagaagttttaattttcatcctggaacactatttcttcataaaatagtattgggaattgaaactagttgtgatgatacagcagctgctgtggtggatgaaactggaaatgtgttgggagaagcaatacattcccaaactgaagttcatttaaaaacaggtgggattgttcctccagcagctcaacagcttcacagagaaaatattcaacgaatagtacaagaagctctttctgccagtggagtctctccaagtgacctctcagcaattgcaactaccataaaaccaggacttgctttaagcctgggagtgggcttatcatttagcttacagctggtaggacagttaaaaaagccattcattcccattcatcatatggaggctcatgcacttactattaggttgaccaataaagtagaatttccttttttagttcttttgatttctggaggtcactgtctgttggcattagttcaaggagtttcagattttctgcttcttggaaagtctttggacatagcaccaggtgacatgcttgacaaggtggcaagaagactttctttaataaaacatccagagtgctccaccatgagtggtgggaaagccatagaacatttggccaaacaaggaaatagatttcattttgacatcaaacctcccttgcatcatgctaaaaattgtgatttttcttttactggacttcaacacgttactgataaaataataatgaaaaaggaaaaagaggaaggtattgagaaggggcaaatcctgtcttcagcagcagacattgctgccacagtacagcacacaatggcatgtcatcttgtgaaaagaacacatcgggctattctgttttgtaagcagagagacttgttacctcaaaataatgcagtactggttgcatctggtggtgtcgcaagtaacttctatatccgcagagctctggaaattttaacaaatgcaacacagtgcactttgttgtgtcctcctcccagactatgcactgataatggcattatgattgcatggaatggtattgaaagactacgtgctggcttgggcattttacatgacatagaaggcatccgctatgaaccaaaatgtcctcttggagtagacatatcaaaagaagttggagaagcttccataaaagtaccacaattaaaaatggagatatga

SEQ ID NO: 162813 - DNA, 945 bp, Homo sapiens
  Payload ID: 12084
  Gene Symbol: OSGEPL1
  Gene Name: O-sialoglycoprotein endopeptidase-like 1
  ENST ID: ENST00000520350
  CDS Start-End: 424-945
ctttctcctgcagcgataagggcagtcgacagtctttagtagggaaaggagacaagtgctagctactgccgcccaagtggaaggaattatctatagatattgggaattgaaactagttgtgatgatacagcagctgctgtggtggatgaaactggaaatgtgttgggagaagcaatacattcccaaactgaagttcatttaaaaacaggtgggattgttcctccagcagctcaacagcttcacagagaaaatattcaacgaatagtacaagaagctctttctgccagtggagtctctccaagtgacctctcagcaattgcaactaccataaaaccaggacttgctttaagcctgggagtgggcttatcatttagcttacagctggtaggacagttaaaaaagccattcattcccattcatcatatggaggctcatgcacttactattaggttgaccaataaagtagaatttccttttttagttcttttgatttctggaggtcactgtctgttggcattagttcaaggagtttcagattttctgcttcttggaaagtctttggacatagcaccaggtgacatgcttgacaaggtggcaagaagactttctttaataaaacatccagagtgctccaccatgagtggtgggaaagccatagaacatttggccaaacaaggaaatagatttcattttgacatcaaacctcccttgcatcatgctaaaaattgtgatttttcttttactggacttcaacacgttactgataaaataataatgaaaaaggaaaaagaggaaggtattgagaaggggcaaatcctgtcttcagcagcagacattgctgccacagtacagcacacaatggcatgtcatcttgtgaaaagaacacatcgggctattctgttttgtaagcagagagacttgttacctcaaaataatgcagtactg

SEQ ID NO: 162814 - DNA, 914 bp, Homo sapiens
  Payload ID: 12084
  Gene Symbol: OSGEPL1
  Gene Name: O-sialoglycoprotein endopeptidase-like 1
  ENST ID: ENST00000517895
  CDS Start-End: 247-914
atcacttccgggcgccaggttcgggctttctcctgcagcgataagggcagtcgacagtctttagtagggaaaggagacaagtgctagctactgccgcccaagtggaaggtgggtgaaattgctcactcttcaccccactgacgcttttgcgcacctggaaaagcggttccagtttgcgcccgtcgccgccttacagccgacaggagaccagcgctacccaagtcacgaattatctatagagtaagtatgctaatcttgactaagactgcaggagttttttttaaaccatcaaaaaggaaagtttatgaatttttaagaagttttaattttcatcctggaacactatttcttcataaaatagtattgggaattgaaactagttgtgatgatacagcagctgctgtggtggatgaaactggaaatgtgttgggagaagcaatacattcccaaactgaagttcatttaaaaacaggtgggattgttcctccagcagctcaacagcttcacagagaaaatattcaacgaatagtacaagaagctctttctgccagtggagtctctccaagtgacctctcagcaattgcaactaccataaaaccaggacttgctttaagcctgggagtgggcttatcatttagcttacagctggtaggacagttaaaaaagccattcattcccattcatcatatggaggctcatgcacttactattaggttgaccaataaagtagaatttccttttttagttcttttgatttctggaggtcactgtctgttggcattagttcaaggagtttcagattttctgcttcttggaaagtctttggacatagcaccaggtgacatgcttgacaaggtggcaagaagactttctttaataaaacatccagagtgctccaccatgagtggtgggaa

SEQ ID NO: 162815 - DNA, 1375 bp, Homo sapiens
  Payload ID: 12085
  Gene Symbol: OSCAR
  Gene Name: osteoclast associated, immunoglobulin-like receptor
  ENST ID: ENST00000351806
  CDS Start-End: 66-824
atttcctgggaggggagagggtgcgaccaagccctggctccagctctagcgggtatctgcccaccatggccctggtgctgatcctccagctgctgaccctcttccccccagcttcataccaccctaagccatggctgggagctcagccggctacagttgtgacccctggggtcaacgtgaccttgagatgccgggcaccccaacccgcttggagatttggacttttcaagcctggagagatcgctccccttctcttccgggatgtgtcctccgagctggcagaattctttctggaggaggtgactccagcccaagggggaagttaccgctgctgctaccgaaggccagactgggggccgggtgtctggtcccagcccagcgatgtcctggagctgctggtgacagaggagctgccgcggccgtcgctggtggcgctgcccgggccggtggtgggtcctggcgccaacgtgagcctgcgctgcgcgggccgcctgcggaacatgagcttcgtgctgtaccgcgagggcgtggcggccccgctgcagtaccgccactccgcgcagccctgggccgacttcacgctgctgggcgcccgcgcccccggcacctacagctgctactatcacacgccctccgcgccctacgtgctgtcgcagcgcagcgaggtgctggtcatcagctgggaagactctggctcctccgactacacccgggggaacctagtccgcctggggctggccgggctggtcctcatctccctgggcgcgctggtcacttttgactggcgcagtcagaaccgcgctcctgctggtatccgcccctgagccccaggagcactgcagcccgagacttccaacctgagtggcggagaagctgggaccctgggctggactgtcctttcctgcagccccacagtcctgctggctgagctccgcggaacggtccttagaccccgctgtgccctgtgctgtagcttctttccaggcctttcccaaggagtagctgaaaggaagacgcgattagtggttaagacttccaagccagaagacagagggttcgaatcccagcactgccgtctactcactgtagtagtagcagctacagaaaggtagtagtgagacgtgaagccagctggacttcctgggttgaatggggacctggagaacttttctgtcttacaagaggattgtaaaatggaccaatcagcactctgtaagatggaccaatcagcgctctgtaaaatggaccaatcagcaggacacgggcggggacaataagggaataaaagctggcgagcgcggcaccccaccagagtctgcttccacgttgtgggagctttgttctcttgctctacacaataaatcttgctgctgct

SEQ ID NO: 162816 - DNA, 1355 bp, Homo sapiens
  Payload ID: 12085
  Gene Symbol: OSCAR
  Gene Name: osteoclast associated, immunoglobulin-like receptor
  ENST ID: ENST00000356532
  CDS Start-End: 1-804
atggccctggtgctgatcctccagctgctgaccctctggcctctgtgtcacacagacatcactccgtctgtggccattatagtccccccagcttcataccaccctaagccatggctgggagctcagccggctacagttgtgacccctggggtcaacgtgaccttgagatgccgggcaccccaacccgcttggagatttggacttttcaagcctggagagatcgctccccttctcttccgggatgtgtcctccgagctggcagaattctttctggaggaggtgactccagcccaagggggaagttaccgctgctgctaccgaaggccagactgggggccgggtgtctggtcccagcccagcgatgtcctggagctgctggtgacagaggagctgccgcggccgtcgctggtggcgctgcccgggccggtggtgggtcctggcgccaacgtgagcctgcgctgcgcgggccgcctgcggaacatgagcttcgtgctgtaccgcgagggcgtggcggccccgctgcagtaccgccactccgcgcagccctgggccgacttcacgctgctgggcgcccgcgcccccggcacctacagctgctactatcacacgccctccgcgccctacgtgctgtcgcagcgcagcgaggtgctggtcatcagctgggaagactctggctcctccgactacacccgggggaacctagtccgcctggggctggccgggctggtcctcatctccctgggcgcgctggtcacttttgactggcgcagtcagaaccgcgctcctgctggtatccgcccctgagccccaggagcactgcagcccgagacttccaacctgagtggcggagaagctgggaccctgggctggactgtcctttcctgcagccccacagtcctgctggctgagctccgcggaacggtccttagaccccgctgtgccctgtgctgtagcttctttccaggcctttcccaaggagtagctgaaaggaagacgcgattagtggttaagacttccaagccagaagacagagggttcgaatcccagcactgccgtctactcactgtagtagtagcagctacagaaaggtagtagtgagacgtgaagccagctggacttcctgggttgaatggggacctggagaacttttctgtcttacaagaggattgtaaaatggaccaatcagcactctgtaagatggaccaatcagcgctctgtaaaatggaccaatcagcaggacacgggcggggacaataagggaataaaagctggcgagcgcggcaccccaccagagtctgcttccacgttgtgggagctttgttctcttgctctacacaataaatcttgctgctgct

SEQ ID NO: 162817 - DNA, 1389 bp, Homo sapiens
  Payload ID: 12085
  Gene Symbol: OSCAR
  Gene Name: osteoclast associated, immunoglobulin-like receptor
  ENST ID: ENST00000358375
  CDS Start-End: 47-838
ggtgcgaccaagccctggctccagctctagcgggtatctgcccaccatggccctggtgctgatcctccagctgctgaccctctggcctctgtgtcacacagacatcactccgtctgtccccccagcttcataccaccctaagccatggctgggagctcagccggctacagttgtgacccctggggtcaacgtgaccttgagatgccgggcaccccaacccgcttggagatttggacttttcaagcctggagagatcgctccccttctcttccgggatgtgtcctccgagctggcagaattctttctggaggaggtgactccagcccaagggggaagttaccgctgctgctaccgaaggccagactgggggccgggtgtctggtcccagcccagcgatgtcctggagctgctggtgacagaggagctgccgcggccgtcgctggtggcgctgcccgggccggtggtgggtcctggcgccaacgtgagcctgcgctgcgcgggccgcctgcggaacatgagcttcgtgctgtaccgcgagggcgtggcggccccgctgcagtaccgccactccgcgcagccctgggccgacttcacgctgctgggcgcccgcgcccccggcacctacagctgctactatcacacgccctccgcgccctacgtgctgtcgcagcgcagcgaggtgctggtcatcagctgggaagactctggctcctccgactacacccgggggaacctagtccgcctggggctggccgggctggtcctcatctccctgggcgcgctggtcacttttgactggcgcagtcagaaccgcgctcctgctggtatccgcccctgagccccaggagcactgcagcccgagacttccaacctgagtggcggagaagctgggaccctgggctggactgtcctttcctgcagccccacagtcctgctggctgagctccgcggaacggtccttagaccccgctgtgccctgtgctgtagcttctttccaggcctttcccaaggagtagctgaaaggaagacgcgattagtggttaagacttccaagccagaagacagagggttcgaatcccagcactgccgtctactcactgtagtagtagcagctacagaaaggtagtagtgagacgtgaagccagctggacttcctgggttgaatggggacctggagaacttttctgtcttacaagaggattgtaaaatggaccaatcagcactctgtaagatggaccaatcagcgctctgtaaaatggaccaatcagcaggacacgggcggggacaataagggaataaaagctggcgagcgcggcaccccaccagagtctgcttccacgttgtgggagctttgttctcttgctctacacaataaatcttgctgctgct

SEQ ID NO: 162818 - DNA, 1892 bp, Homo sapiens
  Payload ID: 12085
  Gene Symbol: OSCAR
  Gene Name: osteoclast associated, immunoglobulin-like receptor
  ENST ID: ENST00000359649
  CDS Start-End: 24-884
gctctagcgggtatctgcccaccatggccctggtgctgatcctccagctgctgaccctctggcctctgtgtcacacagacatcactccgtctgtggccattatagtccccccagcttcataccaccctaagccatggctgggagctcagccggctacagttgtgacccctggggtcaacgtgaccttgagatgccgggcaccccaacccgcttggagatttggacttttcaagcctggagagatcgctccccttctcttccgggatgtgtcctccgagctggcagaattctttctggaggaggtgactccagcccaagggggaagttaccgctgctgctaccgaaggccagactgggggccgggtgtctggtcccagcccagcgatgtcctggagctgctggtgacagaggagctgccgcggccgtcgctggtggcgctgcccgggccggtggtgggtcctggcgccaacgtgagcctgcgctgcgcgggccgcctgcggaacatgagcttcgtgctgtaccgcgagggcgtggcggccccgctgcagtaccgccactccgcgcagccctgggccgacttcacgctgctgggcgcccgcgcccccggcacctacagctgctactatcacacgccctccgcgccctacgtgctgtcgcagcgcagcgaggtgctggtcatcagctgggaaggtgagggccctgaggcccggcccgcctcctccgccccaggaatgcaggccccaggacctccgccctcagacccaggagcccaggcccccagcctctcctccttcagacccaggggtctagtcctgcagcccctcctccctcagacccaggattcctgggacccagcccctcctccctcagatccaggagtctagtcctccagctcctcctccctcagacccaggattcccgggccccagtacctcctccctcagacccaggactccaggcccccagcccctccttcctggacccaggactccaggcccccagcccctccttcctgatccagcagtccaggccccagccccttcttcctggacccaggagttgaagcctccatcgactccccctcaactttgagactgtagagtcaggtccctaagtccaccccaggggctggaaacctggagttcagggcccagactttggggtccgggagctgatggcccctctctcccggctccgcccgcagactctggctcctccgactacacccgggggaacctagtccgcctggggctggccgggctggtcctcatctccctgggcgcgctggtcacttttgactggcgcagtcagaaccgcgctcctgctggtatccgcccctgagccccaggagcactgcagcccgagacttccaacctgagtggcggagaagctgggaccctgggctggactgtcctttcctgcagccccacagtcctgctggctgagctccgcggaacggtccttagaccccgctgtgccctgtgctgtagcttctttccaggcctttcccaaggagtagctgaaaggaagacgcgattagtggttaagacttccaagccagaagacagagggttcgaatcccagcactgccgtctactcactgtagtagtagcagctacagaaaggtagtagtgagacgtgaagccagctggacttcctgggttgaatggggacctggagaacttttctgtcttacaagaggattgtaaaatggaccaatcagcactctgtaagatggaccaatcagcgctctgtaaaatggaccaatcagcaggacacgggcggggacaataagggaataaaagctggcgagcgcggcaccccaccagagtctgcttccacgttgtgggagctttgttctcttgctctacacaataaatcttgctgctgct

SEQ ID NO: 162819 - DNA, 2055 bp, Homo sapiens
  Payload ID: 12085
  Gene Symbol: OSCAR
  Gene Name: osteoclast associated, immunoglobulin-like receptor
  Uniprot ID: Q8IYS5
  ENST ID: ENST00000284648
  CDS Start-End: 199-1047
gcgtgcgcactcgcgcagaacaaagatggagccgtggagtgccatagggctatgacacagtcacccacaggcccccacctcgatactctcttccgtaaatgaggatctgggtctggttttctgatgttgcctcatttcctgggaggggagagggtgcgaccaagccctggctccagctctagcgggtatctgcccaccatggccctggtgctgatcctccagctgctgaccctctggcctctgtgtcacacagacatcactccgtctgtccccccagcttcataccaccctaagccatggctgggagctcagccggctacagttgtgacccctggggtcaacgtgaccttgagatgccgggcaccccaacccgcttggagatttggacttttcaagcctggagagatcgctccccttctcttccgggatgtgtcctccgagctggcagaattctttctggaggaggtgactccagcccaagggggaagttaccgctgctgctaccgaaggccagactgggggccgggtgtctggtcccagcccagcgatgtcctggagctgctggtgacagaggagctgccgcggccgtcgctggtggcgctgcccgggccggtggtgggtcctggcgccaacgtgagcctgcgctgcgcgggccgcctgcggaacatgagcttcgtgctgtaccgcgagggcgtggcggccccgctgcagtaccgccactccgcgcagccctgggccgacttcacgctgctgggcgcccgcgcccccggcacctacagctgctactatcacacgccctccgcgccctacgtgctgtcgcagcgcagcgaggtgctggtcatcagctgggaaggtgagggccctgaggcccggcccgcctcctccgccccaggaatgcaggccccaggacctccgccctcagacccaggagcccaggcccccagcctctcctccttcagacccaggggtctagtcctgcagcccctcctccctcagacccaggattcctgggacccagcccctcctccctcagatccaggagtctagtcctccagctcctcctccctcagacccaggattcccgggccccagtacctcctccctcagacccaggactccaggcccccagcccctccttcctggacccaggactccaggcccccagcccctccttcctgatccagcagtccaggccccagccccttcttcctggacccaggagttgaagcctccatcgactccccctcaactttgagactgtagagtcaggtccctaagtccaccccaggggctggaaacctggagttcagggcccagactttggggtccgggagctgatggcccctctctcccggctccgcccgcagactctggctcctccgactacacccgggggaacctagtccgcctggggctggccgggctggtcctcatctccctgggcgcgctggtcacttttgactggcgcagtcagaaccgcgctcctgctggtatccgcccctgagccccaggagcactgcagcccgagacttccaacctgagtggcggagaagctgggaccctgggctggactgtcctttcctgcagccccacagtcctgctggctgagctccgcggaacggtccttagaccccgctgtgccctgtgctgtagcttctttccaggcctttcccaaggagtagctgaaaggaagacgcgattagtggttaagacttccaagccagaagacagagggttcgaatcccagcactgccgtctactcactgtagtagtagcagctacagaaaggtagtagtgagacgtgaagccagctggacttcctgggttgaatggggacctggagaacttttctgtcttacaagaggattgtaaaatggaccaatcagcactctgtaagatggaccaatcagcgctctgtaaaatggaccaatcagcaggacacgggcggggacaataagggaataaaagctggcgagcgcggcaccccaccagagtctgcttccacgttgtgggagctttgttctcttgctctacacaataaatcttgctgctgct

SEQ ID NO: 162820 - DNA, 629 bp, Homo sapiens
  Payload ID: 12085
  Gene Symbol: OSCAR
  Gene Name: osteoclast associated, immunoglobulin-like receptor
  ENST ID: ENST00000391760
  CDS Start-End: 50-535
gagggtgcgaccaagccctggctccagctctagcgggtatctgcccaccatggccctggtgctgatcctccagctgctgaccctctggcctctgtgtcacacagacatcactccgtctgctggcagaattctttctggaggaggtgactccagcccaagggggaagttaccgctgctgctaccgaaggccagactgggggccgggtgtctggtcccagcccagcgatgtcctggagctgctggtgacagaggagctgccgcggccgtcgctggtggcgctgcccgggccggtggtgggtcctggcgccaacgtgagcctgcgctgcgcgggccgcctgcggaacatgagcttcgtgctgtaccgcgagggcgtggcggccccgctgcagtaccgccactccgcgcagccctgggccgacttcacgctgctgggcgcccgcgcccccggcacctacagctgctactatcacacgccctccgcgccctacgtgctgtcgcagcgcagcgaggtgctggtcatcagctgggaaggtgagggccctgaggcccggcccgcctcctccgccccaggaatgcaggccccaggacctccgccctcagacccaggagcccaggcccccagcctctcc

SEQ ID NO: 162821 - DNA, 1826 bp, Homo sapiens
  Payload ID: 12085
  Gene Symbol: OSCAR
  Gene Name: osteoclast associated, immunoglobulin-like receptor
  Uniprot ID: Q8IYS5
  ENST ID: ENST00000391761
  CDS Start-End: 1-816
atggccctggtgctgatcctccagctgctgaccctcttccccccagcttcataccaccctaagccatggctgggagctcagccggctacagttgtgacccctggggtcaacgtgaccttgagatgccgggcaccccaacccgcttggagatttggacttttcaagcctggagagatcgctccccttctcttccgggatgtgtcctccgagctggcagaattctttctggaggaggtgactccagcccaagggggaagttaccgctgctgctaccgaaggccagactgggggccgggtgtctggtcccagcccagcgatgtcctggagctgctggtgacagaggagctgccgcggccgtcgctggtggcgctgcccgggccggtggtgggtcctggcgccaacgtgagcctgcgctgcgcgggccgcctgcggaacatgagcttcgtgctgtaccgcgagggcgtggcggccccgctgcagtaccgccactccgcgcagccctgggccgacttcacgctgctgggcgcccgcgcccccggcacctacagctgctactatcacacgccctccgcgccctacgtgctgtcgcagcgcagcgaggtgctggtcatcagctgggaaggtgagggccctgaggcccggcccgcctcctccgccccaggaatgcaggccccaggacctccgccctcagacccaggagcccaggcccccagcctctcctccttcagacccaggggtctagtcctgcagcccctcctccctcagacccaggattcctgggacccagcccctcctccctcagatccaggagtctagtcctccagctcctcctccctcagacccaggattcccgggccccagtacctcctccctcagacccaggactccaggcccccagcccctccttcctggacccaggactccaggcccccagcccctccttcctgatccagcagtccaggccccagccccttcttcctggacccaggagttgaagcctccatcgactccccctcaactttgagactgtagagtcaggtccctaagtccaccccaggggctggaaacctggagttcagggcccagactttggggtccgggagctgatggcccctctctcccggctccgcccgcagactctggctcctccgactacacccgggggaacctagtccgcctggggctggccgggctggtcctcatctccctgggcgcgctggtcacttttgactggcgcagtcagaaccgcgctcctgctggtatccgcccctgagccccaggagcactgcagcccgagacttccaacctgagtggcggagaagctgggaccctgggctggactgtcctttcctgcagccccacagtcctgctggctgagctccgcggaacggtccttagaccccgctgtgccctgtgctgtagcttctttccaggcctttcccaaggagtagctgaaaggaagacgcgattagtggttaagacttccaagccagaagacagagggttcgaatcccagcactgccgtctactcactgtagtagtagcagctacagaaaggtagtagtgagacgtgaagccagctggacttcctgggttgaatggggacctggagaacttttctgtcttacaagaggattgtaaaatggaccaatcagcactctgtaagatggaccaatcagcgctctgtaaaatggaccaatcagcaggacacgggcggggacaataagggaataaaagctggcgagcgcggcaccccaccagagtctgcttccacgttgtgggagctttgttctcttgctctacacaataaatcttgctgctgctaa

SEQ ID NO: 162822 - DNA, 1826 bp, Homo sapiens
  Payload ID: 12085
  Gene Symbol: OSCAR
  Gene Name: osteoclast associated, immunoglobulin-like receptor
  Uniprot ID: Q8IYS5
  ENST ID: ENST00000621284
  CDS Start-End: 1-816
atggccctggtgctgatcctccagctgctgaccctcttccccccagcttcataccaccctaagccatggctgggagctcagccggctacagttgtgacccctggggtcaacgtgaccttgagatgccgggcaccccaacccgcttggagatttggacttttcaagcctggagagatcgctccccttctcttccgggatgtgtcctccgagctggcagaattctttctggaggaggtgactccagcccaagggggaatttaccgctgctgctaccgaaggccagactgggggccgggtgtctggtcccagcccagcgatgtcctggagctgctggtgacagaggagctgccgcggccgtcgctggtggcgctgcccgggccggtggtgggtcctggcgccaacgtgagcctgcgctgcgcgggccgcctgcggaacatgagcttcgtgctgtaccgcgagggcgtggcggccccgctgcagtaccgccactccgcgcagccctgggccgacttcacgctgctgggcgcccgcgcccccggcacctacagctgctactatcacacgccctccgcgccctacgtgctgtcgcagcgcagcgaggtgctggtcatcagctgggaaggtgagggccctgaggcccggcccgcctcctccgccccaggaatgcaggccccaggacctccgccctcagacccaggagcccaggcccccagcctctcctccttcagacccaggggtctagtcctgcagcccctcctccctcagacccaggattcctgggacccagcccctcctccctcagatccaggagtctagtcctccagctcctcctccctcagacccaggattcccgggccccagtacctcctccctcagacccaggactccaggcccccagcccctccttcctggacccaggactccaggcccccagcccctccttcctgatccagcagtccaggccccagccccttcttcctggacccaggagttgaagcctccatcgactccccctcaactttgagactgtagagtcaggtccctaagtccaccccaggggctggaaacctggagttcagggcccagactttggggtccgggagctgatggcccctctctcccggctccgcccgcagactctggctcctccgactacacccgggggaacctagtccgcctggggctggccgggctggtcctcatctccctgggcgcgctggtcacttttgactggcgcagtcagaaccgcgctcctgctggtatccgcccctgagccccaggagcactgcagcccgagacttccaacctgagtggcggagaagctgggaccctgggctggactgtcctttcctgcagccccacagtcctgctggctgagctccgcggaacggtccttagaccccgctgtgccctgtgctgtagcttctttccaggcctttcccaaggagtagctgaaaggaagacgcgattagtggttaagacttccaagccagaagacagagggttcgaatcccagcactgccgtctactcactgtagtagtagcagctacagaaaggtagtagtgagacgtgaagccagctggacttcctgggttgaatggggacctggagaacttttctgtcttacaagaggattgtaaaatggaccaatcagcactctgtaagatggaccaatcagcgctctgtaaaatggaccaatcagcaggacatgggcggggacaataagggaataaaagctggcgagcgcggcaccccaccagagtctgcttccacgctgtgggagctttgttctcttgctctacacaataaatcttgctgctgctaa

SEQ ID NO: 162823 - DNA, 2061 bp, Homo sapiens
  Payload ID: 12085
  Gene Symbol: OSCAR
  Gene Name: osteoclast associated, immunoglobulin-like receptor
  Uniprot ID: Q8IYS5
  ENST ID: ENST00000615074
  CDS Start-End: 193-1053
gcactcgcgcagaacaaagatggagccgtggagtgccatagggctatgacacagtcacccacaggcccccacctcgatactctcttccgtaaatgaggatctgggtctggttttctgatgttgcctcatttcctgggaggggagagggtgcgaccaagccctggctccagctctagcgggtatctgcccaccatggccctggtgctgatcctccagctgctgaccctctggcctctgtgtcacacagacatcactccgtctgtggccattatagtccccccagcttcataccaccctaagccatggctgggagctcagccggctacagttgtgacccctggggtcaacgtgaccttgagatgccgggcaccccaacccgcttggagatttggacttttcaagcctggagagatcgctccccttctcttccgggatgtgtcctccgagctggcagaattctttctggaggaggtgactccagcccaagggggaatttaccgctgctgctaccgaaggccagactgggggccgggtgtctggtcccagcccagcgatgtcctggagctgctggtgacagaggagctgccgcggccgtcgctggtggcgctgcccgggccggtggtgggtcctggcgccaacgtgagcctgcgctgcgcgggccgcctgcggaacatgagcttcgtgctgtaccgcgagggcgtggcggccccgctgcagtaccgccactccgcgcagccctgggccgacttcacgctgctgggcgcccgcgcccccggcacctacagctgctactatcacacgccctccgcgccctacgtgctgtcgcagcgcagcgaggtgctggtcatcagctgggaaggtgagggccctgaggcccggcccgcctcctccgccccaggaatgcaggccccaggacctccgccctcagacccaggagcccaggcccccagcctctcctccttcagacccaggggtctagtcctgcagcccctcctccctcagacccaggattcctgggacccagcccctcctccctcagatccaggagtctagtcctccagctcctcctccctcagacccaggattcccgggccccagtacctcctccctcagacccaggactccaggcccccagcccctccttcctggacccaggactccaggcccccagcccctccttcctgatccagcagtccaggccccagccccttcttcctggacccaggagttgaagcctccatcgactccccctcaactttgagactgtagagtcaggtccctaagtccaccccaggggctggaaacctggagttcagggcccagactttggggtccgggagctgatggcccctctctcccggctccgcccgcagactctggctcctccgactacacccgggggaacctagtccgcctggggctggccgggctggtcctcatctccctgggcgcgctggtcacttttgactggcgcagtcagaaccgcgctcctgctggtatccgcccctgagccccaggagcactgcagcccgagacttccaacctgagtggcggagaagctgggaccctgggctggactgtcctttcctgcagccccacagtcctgctggctgagctccgcggaacggtccttagaccccgctgtgccctgtgctgtagcttctttccaggcctttcccaaggagtagctgaaaggaagacgcgattagtggttaagacttccaagccagaagacagagggttcgaatcccagcactgccgtctactcactgtagtagtagcagctacagaaaggtagtagtgagacgtgaagccagctggacttcctgggttgaatggggacctggagaacttttctgtcttacaagaggattgtaaaatggaccaatcagcactctgtaagatggaccaatcagcgctctgtaaaatggaccaatcagcaggacatgggcggggacaataagggaataaaagctggcgagcgcggcaccccaccagagtctgcttccacgctgtgggagctttgttctcttgctctacacaataaatcttgctgctgct

SEQ ID NO: 162824 - DNA, 1547 bp, Homo sapiens
  Payload ID: 12085
  Gene Symbol: OSCAR
  Gene Name: osteoclast associated, immunoglobulin-like receptor
  ENST ID: ENST00000611143
  CDS Start-End: 193-996
gcactcgcgcagaacaaagatggagccgtggagtgccatagggctatgacacagtcacccacaggcccccacctcgatactctcttccgtaaatgaggatctgggtctggttttctgatgttgcctcatttcctgggaggggagagggtgcgaccaagccctggctccagctctagcgggtatctgcccaccatggccctggtgctgatcctccagctgctgaccctctggcctctgtgtcacacagacatcactccgtctgtggccattatagtccccccagcttcataccaccctaagccatggctgggagctcagccggctacagttgtgacccctggggtcaacgtgaccttgagatgccgggcaccccaacccgcttggagatttggacttttcaagcctggagagatcgctccccttctcttccgggatgtgtcctccgagctggcagaattctttctggaggaggtgactccagcccaagggggaatttaccgctgctgctaccgaaggccagactgggggccgggtgtctggtcccagcccagcgatgtcctggagctgctggtgacagaggagctgccgcggccgtcgctggtggcgctgcccgggccggtggtgggtcctggcgccaacgtgagcctgcgctgcgcgggccgcctgcggaacatgagcttcgtgctgtaccgcgagggcgtggcggccccgctgcagtaccgccactccgcgcagccctgggccgacttcacgctgctgggcgcccgcgcccccggcacctacagctgctactatcacacgccctccgcgccctacgtgctgtcgcagcgcagcgaggtgctggtcatcagctgggaagactctggctcctccgactacacccgggggaacctagtccgcctggggctggccgggctggtcctcatctccctgggcgcgctggtcacttttgactggcgcagtcagaaccgcgctcctgctggtatccgcccctgagccccaggagcactgcagcccgagacttccaacctgagtggcggagaagctgggaccctgggctggactgtcctttcctgcagccccacagtcctgctggctgagctccgcggaacggtccttagaccccgctgtgccctgtgctgtagcttctttccaggcctttcccaaggagtagctgaaaggaagacgcgattagtggttaagacttccaagccagaagacagagggttcgaatcccagcactgccgtctactcactgtagtagtagcagctacagaaaggtagtagtgagacgtgaagccagctggacttcctgggttgaatggggacctggagaacttttctgtcttacaagaggattgtaaaatggaccaatcagcactctgtaagatggaccaatcagcgctctgtaaaatggaccaatcagcaggacatgggcggggacaataagggaataaaagctggcgagcgcggcaccccaccagagtctgcttccacgctgtgggagctttgttctcttgctctacacaataaatcttgctgctgct

SEQ ID NO: 162825 - DNA, 1547 bp, Homo sapiens; identical to SEQ ID NO: 162824
  Payload ID: 12085
  Gene Symbol: OSCAR
  Gene Name: osteoclast associated, immunoglobulin-like receptor
  ENST ID: ENST00000611987
  CDS Start-End: 193-996

SEQ ID NO: 162826 - DNA, 2016 bp, Homo sapiens
  Payload ID: 12085
  Gene Symbol: OSCAR
  Gene Name: osteoclast associated, immunoglobulin-like receptor
  Uniprot ID: Q8IYS5
  ENST ID: ENST00000611719
  CDS Start-End: 193-1008
gcactcgcgcagaacaaagatggagccgtggagtgccatagggctatgacacagtcacccacaggcccccacctcgatactctcttccgtaaatgaggatctgggtctggttttctgatgttgcctcatttcctgggaggggagagggtgcgaccaagccctggctccagctctagcgggtatctgcccaccatggccctggtgctgatcctccagctgctgaccctcttccccccagcttcataccaccctaagccatggctgggagctcagccggctacagttgtgacccctggggtcaacgtgaccttgagatgccgggcaccccaacccgcttggagatttggacttttcaagcctggagagatcgctccccttctcttccgggatgtgtcctccgagctggcagaattctttctggaggaggtgactccagcccaagggggaatttaccgctgctgctaccgaaggccagactgggggccgggtgtctggtcccagcccagcgatgtcctggagctgctggtgacagaggagctgccgcggccgtcgctggtggcgctgcccgggccggtggtgggtcctggcgccaacgtgagcctgcgctgcgcgggccgcctgcggaacatgagcttcgtgctgtaccgcgagggcgtggcggccccgctgcagtaccgccactccgcgcagccctgggccgacttcacgctgctgggcgcccgcgcccccggcacctacagctgctactatcacacgccctccgcgccctacgtgctgtcgcagcgcagcgaggtgctggtcatcagctgggaaggtgagggccctgaggcccggcccgcctcctccgccccaggaatgcaggccccaggacctccgccctcagacccaggagcccaggcccccagcctctcctccttcagacccaggggtctagtcctgcagcccctcctccctcagacccaggattcctgggacccagcccctcctccctcagatccaggagtctagtcctccagctcctcctccctcagacccaggattcccgggccccagtacctcctccctcagacccaggactccaggcccccagcccctccttcctggacccaggactccaggcccccagcccctccttcctgatccagcagtccaggccccagccccttcttcctggacccaggagttgaagcctccatcgactccccctcaactttgagactgtagagtcaggtccctaagtccaccccaggggctggaaacctggagttcagggcccagactttggggtccgggagctgatggcccctctctcccggctccgcccgcagactctggctcctccgactacacccgggggaacctagtccgcctggggctggccgggctggtcctcatctccctgggcgcgctggtcacttttgactggcgcagtcagaaccgcgctcctgctggtatccgcccctgagccccaggagcactgcagcccgagacttccaacctgagtggcggagaagctgggaccctgggctggactgtcctttcctgcagccccacagtcctgctggctgagctccgcggaacggtccttagaccccgctgtgccctgtgctgtagcttctttccaggcctttcccaaggagtagctgaaaggaagacgcgattagtggttaagacttccaagccagaagacagagggttcgaatcccagcactgccgtctactcactgtagtagtagcagctacagaaaggtagtagtgagacgtgaagccagctggacttcctgggttgaatggggacctggagaacttttctgtcttacaagaggattgtaaaatggaccaatcagcactctgtaagatggaccaatcagcgctctgtaaaatggaccaatcagcaggacatgggcggggacaataagggaataaaagctggcgagcgcggcaccccaccagagtctgcttccacgctgtgggagctttgttctcttgctctacacaataaatcttgctgctgct

SEQ ID NO: 162827 - DNA, 2049 bp, Homo sapiens
  Payload ID: 12085
  Gene Symbol: OSCAR
  Gene Name: osteoclast associated, immunoglobulin-like receptor
  Uniprot ID: Q8IYS5
  ENST ID: ENST00000620647
  CDS Start-End: 193-1041
gcactcgcgcagaacaaagatggagccgtggagtgccatagggctatgacacagtcacccacaggcccccacctcgatactctcttccgtaaatgaggatctgggtctggttttctgatgttgcctcatttcctgggaggggagagggtgcgaccaagccctggctccagctctagcgggtatctgcccaccatggccctggtgctgatcctccagctgctgaccctctggcctctgtgtcacacagacatcactccgtctgtccccccagcttcataccaccctaagccatggctgggagctcagccggctacagttgtgacccctggggtcaacgtgaccttgagatgccgggcaccccaacccgcttggagatttggacttttcaagcctggagagatcgctccccttctcttccgggatgtgtcctccgagctggcagaattctttctggaggaggtgactccagcccaagggggaatttaccgctgctgctaccgaaggccagactgggggccgggtgtctggtcccagcccagcgatgtcctggagctgctggtgacagaggagctgccgcggccgtcgctggtggcgctgcccgggccggtggtgggtcctggcgccaacgtgagcctgcgctgcgcgggccgcctgcggaacatgagcttcgtgctgtaccgcgagggcgtggcggccccgctgcagtaccgccactccgcgcagccctgggccgacttcacgctgctgggcgcccgcgcccccggcacctacagctgctactatcacacgccctccgcgccctacgtgctgtcgcagcgcagcgaggtgctggtcatcagctgggaaggtgagggccctgaggcccggcccgcctcctccgccccaggaatgcaggccccaggacctccgccctcagacccaggagcccaggcccccagcctctcctccttcagacccaggggtctagtcctgcagcccctcctccctcagacccaggattcctgggacccagcccctcctccctcagatccaggagtctagtcctccagctcctcctccctcagacccaggattcccgggccccagtacctcctccctcagacccaggactccaggcccccagcccctccttcctggacccaggactccaggcccccagcccctccttcctgatccagcagtccaggccccagccccttcttcctggacccaggagttgaagcctccatcgactccccctcaactttgagactgtagagtcaggtccctaagtccaccccaggggctggaaacctggagttcagggcccagactttggggtccgggagctgatggcccctctctcccggctccgcccgcagactctggctcctccgactacacccgggggaacctagtccgcctggggctggccgggctggtcctcatctccctgggcgcgctggtcacttttgactggcgcagtcagaaccgcgctcctgctggtatccgcccctgagccccaggagcactgcagcccgagacttccaacctgagtggcggagaagctgggaccctgggctggactgtcctttcctgcagccccacagtcctgctggctgagctccgcggaacggtccttagaccccgctgtgccctgtgctgtagcttctttccaggcctttcccaaggagtagctgaaaggaagacgcgattagtggttaagacttccaagccagaagacagagggttcgaatcccagcactgccgtctactcactgtagtagtagcagctacagaaaggtagtagtgagacgtgaagccagctggacttcctgggttgaatggggacctggagaacttttctgtcttacaagaggattgtaaaatggaccaatcagcactctgtaagatggaccaatcagcgctctgtaaaatggaccaatcagcaggacatgggcggggacaataagggaataaaagctggcgagcgcggcaccccaccagagtctgcttccacgctgtgggagctttgttctcttgctctacacaataaatcttgctgctgct

SEQ ID NO: 162828 - DNA, 2061 bp, Homo sapiens; identical to SEQ ID NO: 162823
  Payload ID: 12085
  Gene Symbol: OSCAR
  Gene Name: osteoclast associated, immunoglobulin-like receptor
  ENST ID: ENST00000612406
  CDS Start-End: 193-1053

SEQ ID NO: 162829 - DNA, 1358 bp, Homo sapiens
  Payload ID: 12085
  Gene Symbol: OSCAR
  Gene Name: osteoclast associated, immunoglobulin-like receptor
  ENST ID: ENST00000615745
  CDS Start-End: 1-807
atggccctggtgctgatcctccagctgctgaccctctggcctctgtgtcacacagacatcactccgtctgcagccccgtttattgtccccccagcttcataccaccctaagccatggctgggagctcagccggctacagttgtgacccctggggtcaacgtgaccttgagatgccgggcaccccaacccgcttggagatttggacttttcaagcctggagagatcgctccccttctcttccgggatgtgtcctccgagctggcagaattctttctggaggaggtgactccagcccaagggggaatttaccgctgctgctaccgaaggccagactgggggccgggtgtctggtcccagcccagcgatgtcctggagctgctggtgacagaggagctgccgcggccgtcgctggtggcgctgcccgggccggtggtgggtcctggcgccaacgtgagcctgcgctgcgcgggccgcctgcggaacatgagcttcgtgctgtaccgcgagggcgtggcggccccgctgcagtaccgccactccgcgcagccctgggccgacttcacgctgctgggcgcccgcgcccccggcacctacagctgctactatcacacgccctccgcgccctacgtgctgtcgcagcgcagcgaggtgctggtcatcagctgggaagactctggctcctccgactacacccgggggaacctagtccgcctggggctggccgggctggtcctcatctccctgggcgcgctggtcacttttgactggcgcagtcagaaccgcgctcctgctggtatccgcccctgagccccaggagcactgcagcccgagacttccaacctgagtggcggagaagctgggaccctgggctggactgtcctttcctgcagccccacagtcctgctggctgagctccgcggaacggtccttagaccccgctgtgccctgtgctgtagcttctttccaggcctttcccaaggagtagctgaaaggaagacgcgattagtggttaagacttccaagccagaagacagagggttcgaatcccagcactgccgtctactcactgtagtagtagcagctacagaaaggtagtagtgagacgtgaagccagctggacttcctgggttgaatggggacctggagaacttttctgtcttacaagaggattgtaaaatggaccaatcagcactctgtaagatggaccaatcagcgctctgtaaaatggaccaatcagcaggacatgggcggggacaataagggaataaaagctggcgagcgcggcaccccaccagagtctgcttccacgctgtgggagctttgttctcttgctctacacaataaatcttgctgctgct

SEQ ID NO: 162830 - DNA, 2016 bp, Homo sapiens; identical to SEQ ID NO: 162826
  Payload ID: 12085
  Gene Symbol: OSCAR
  Gene Name: osteoclast associated, immunoglobulin-like receptor
  ENST ID: ENST00000611715
  CDS Start-End: 193-1008

SEQ ID NO: 162831 - DNA, 2061 bp, Homo sapiens; identical to SEQ ID NO: 162823
  Payload ID: 12085
  Gene Symbol: OSCAR
  Gene Name: osteoclast associated, immunoglobulin-like receptor
  ENST ID: ENST00000610577
  CDS Start-End: 193-1053

SEQ ID NO: 162832 - DNA, 2061 bp, Homo sapiens
  Payload ID: 12085
  Gene Symbol: OSCAR
  Gene Name: osteoclast associated, immunoglobulin-like receptor
  ENST ID: ENST00000611261
  CDS Start-End: 193-1053
gcactcgcgcagaacaaagatggagccgtggagtgccatagggctatgacacagtcacccacaggcccccacctcgatactctcttccgtaaatgaggatctgggtctggttttctgatgttgcctcatttcctgggaggggagagggtgcgaccaagccctggctccagctctagcgggtatctgcccaccatggccctggtgctgatcctccagctgctgaccctctggcctctgtgtcacacagacatcactccgtctgtggccattatagtccccccagcttcataccaccctaagccatggctgggagctcagccggctacagttgtgacccctggggtcaacgtgaccttgagatgccgggcaccccaacccgcttggagatttggacttttcaagcctggagagatcgctccccttctcttccgggatgtgtcctccgagctggcagaattctttctggaggaggtgactccagcccaagggggaagttaccgctgctgctaccgaaggccagactgggggccgggtgtctggtcccagcccagcgatgtcctggagctgctggtgacagaggagctgccgcggccgtcgctggtggcgctgcccgggccggtggtgggtcctggcgccaacgtgagcctgcgctgcgcgggccgcctgcggaacatgagcttcgtgctgtaccgcgagggcgtggcggccccgctgcagtaccgccactccgcgcagccctgggccgacttcacgctgctgggcgcccgcgcccccggcacctacagctgctactatcacacgccctccgcgccctacgtgctgtcgcagcgcagcgaggtgctggtcatcagctgggaaggtgagggccctgaggcccggcccgcctcctccgccccaggaatgcaggccccaggacctccgccctcagacccaggagcccaggcccccagcctctcctccttcagacccaggggtctagtcctgcagcccctcctccctcagacccaggattcctgggacccagcccctcctccctcagatccaggagtctagtcctccagctcctcctccctcagacccaggattcccgggccccagtacctcctccctcagacccaggactccaggcccccagcccctccttcctggacccaggactccaggcccccagcccctccttcctgatccagcagtccaggccccagccccttcttcctggacccaggagttgaagcctccatcgactccccctcaactttgagactgtagagtcaggtccctaagtccaccccaggggctggaaacctggagttcagggcccagactttggggtccgggagctgatggcccctctctcccggctccgcccgcagactctggctcctccgactacacccgggggaacctagtccgcctggggctggccgggctggtcctcatctccctgggcgcgctggtcacttttgactggcgcagtcagaaccgcgctcctgctggtatccgcccctgagccccaggagcactgcagcccgagacttccaacctgagtggcggagaagctgggaccctgggctggactgtcctttcctgcagccccacagtcctgctggctgagctccgcggaacggtccttagaccccgctgtgccctgtgctgtagcttctttccaggcctttcccaaggagtagctgaaaggaagacgcgattagtggttaagacttccaagccagaagacagagggttcgaatcccagcactgccgtctactcactgtagtagtagcagctacagaaaggtagtagtgagacgtgaagccagctggacttcctgggttgaatggggacctggagaacttttctgtcttacaagaggattgtaaaatggaccaatcagcactctgtaagatggaccaatcagcgctctgtaaaatggaccaatcagcaggacacgggcggggacaataagggaataaaagctggcgagcgcggcaccccaccagagtctgcttccacgttgtgggagctttgttctcttgctctacacaataaatcttgctgctgct

SEQ ID NO: 162833 - DNA, 2016 bp, Homo sapiens; identical to SEQ ID NO: 162826
  Payload ID: 12085
  Gene Symbol: OSCAR
  Gene Name: osteoclast associated, immunoglobulin-like receptor
  ENST ID: ENST00000610915
  CDS Start-End: 193-1008

SEQ ID NO: 162834 - DNA, 1358 bp, Homo sapiens; identical to SEQ ID NO: 162829
  Payload ID: 12085
  Gene Symbol: OSCAR
  Gene Name: osteoclast associated, immunoglobulin-like receptor
  ENST ID: ENST00000611450
  CDS Start-End: 1-807

SEQ ID NO: 162835 - DNA, 2016 bp, Homo sapiens
  Payload ID: 12085
  Gene Symbol: OSCAR
  Gene Name: osteoclast associated, immunoglobulin-like receptor
  Uniprot ID: Q8IYS5
  ENST ID: ENST00000616215
  CDS Start-End: 193-1008
gcactcgcgcagaacaaagatggagccgtggagtgccatagggctatgacacagtcacccacaggcccccacctcgatactctcttccgtaaatgaggatctgggtctggttttctgatgttgcctcatttcctgggaggggagagggtgcgaccaagccctggctccagctctagcgggtatctgcccaccatggccctggtgctgatcctccagctgctgaccctcttccccccagcttcataccaccctaagccatggctgggagctcagccggctacagttgtgacccctggggtcaacgtgaccttgagatgccgggcaccccaacccgcttggagatttggacttttcaagcctggagagatcgctccccttctcttccgggatgtgtcctccgagctggcagaattctttctggaggaggtgactccagcccaagggggaagttaccgctgctgctaccgaaggccagactgggggccgggtgtctggtcccagcccagcgatgtcctggagctgctggtgacagaggagctgccgcggccgtcgctggtggcgctgcccgggccggtggtgggtcctggcgccaacgtgagcctgcgctgcgcgggccgcctgcggaacatgagcttcgtgctgtaccgcgagggcgtggcggccccgctgcagtaccgccactccgcgcagccctgggccgacttcacgctgctgggcgcccgcgcccccggcacctacagctgctactatcacacgccctccgcgccctacgtgctgtcgcagcgcagcgaggtgctggtcatcagctgggaaggtgagggccctgaggcccggcccgcctcctccgccccaggaatgcaggccccaggacctccgccctcagacccaggagcccaggcccccagcctctcctccttcagacccaggggtctagtcctgcagcccctcctccctcagacccaggattcctgggacccagcccctcctccctcagatccaggagtctagtcctccagctcctcctccctcagacccaggattcccgggccccagtacctcctccctcagacccaggactccaggcccccagcccctccttcctggacccaggactccaggcccccagcccctccttcctgatccagcagtccaggccccagccccttcttcctggacccaggagttgaagcctccatcgactccccctcaactttgagactgtagagtcaggtccctaagtccaccccaggggctggaaacctggagttcagggcccagactttggggtccgggagctgatggcccctctctcccggctccgcccgcagactctggctcctccgactacacccgggggaacctagtccgcctggggctggccgggctggtcctcatctccctgggcgcgctggtcacttttgactggcgcagtcagaaccgcgctcctgctggtatccgcccctgagccccaggagcactgcagcccgagacttccaacctgagtggcggagaagctgggaccctgggctggactgtcctttcctgcagccccacagtcctgctggctgagctccgcggaacggtccttagaccccgctgtgccctgtgctgtagcttctttccaggcctttcccaaggagtagctgaaaggaagacgcgattagtggttaagacttccaagccagaagacagagggttcgaatcccagcactgccgtctactcactgtagtagtagcagctacagaaaggtagtagtgagacgtgaagccagctggacttcctgggttgaatggggacctggagaacttttctgtcttacaagaggattgtaaaatggaccaatcagcactctgtaagatggaccaatcagcgctctgtaaaatggaccaatcagcaggacacgggcggggacaataagggaataaaagctggcgagcgcggcaccccaccagagtctgcttccacgttgtgggagctttgttctcttgctctacacaataaatcttgctgctgct

SEQ ID NO: 162836 - DNA, 1358 bp, Homo sapiens; identical to SEQ ID NO: 162829
  Payload ID: 12085
  Gene Symbol: OSCAR
  Gene Name: osteoclast associated, immunoglobulin-like receptor
  ENST ID: ENST00000611789
  CDS Start-End: 1-807

SEQ ID NO: 162837 - DNA, 1892 bp, Homo sapiens
  Payload ID: 12085
  Gene Symbol: OSCAR
  Gene Name: osteoclast associated, immunoglobulin-like receptor
  Uniprot ID: Q8IYS5
  ENST ID: ENST00000616227
  CDS Start-End: 24-884
gctctagcgggtatctgcccaccatggccctggtgctgatcctccagctgctgaccctctggcctctgtgtcacacagacatcactccgtctgtggccattatagtccccccagcttcataccaccctaagccatggctgggagctcagccggctacagttgtgacccctggggtcaacgtgaccttgagatgccgggcaccccaacccgcttggagatttggacttttcaagcctggagagatcgctccccttctcttccgggatgtgtcctccgagctggcagaattctttctggaggaggtgactccagcccaagggggaatttaccgctgctgctaccgaaggccagactgggggccgggtgtctggtcccagcccagcgatgtcctggagctgctggtgacagaggagctgccgcggccgtcgctggtggcgctgcccgggccggtggtgggtcctggcgccaacgtgagcctgcgctgcgcgggccgcctgcggaacatgagcttcgtgctgtaccgcgagggcgtggcggccccgctgcagtaccgccactccgcgcagccctgggccgacttcacgctgctgggcgcccgcgcccccggcacctacagctgctactatcacacgccctccgcgccctacgtgctgtcgcagcgcagcgaggtgctggtcatcagctgggaaggtgagggccctgaggcccggcccgcctcctccgccccaggaatgcaggccccaggacctccgccctcagacccaggagcccaggcccccagcctctcctccttcagacccaggggtctagtcctgcagcccctcctccctcagacccaggattcctgggacccagcccctcctccctcagatccaggagtctagtcctccagctcctcctccctcagacccaggattcccgggccccagtacctcctccctcagacccaggactccaggcccccagcccctccttcctggacccaggactccaggcccccagcccctccttcctgatccagcagtccaggccccagccccttcttcctggacccaggagttgaagcctccatcgactccccctcaactttgagactgtagagtcaggtccctaagtccaccccaggggctggaaacctggagttcagggcccagactttggggtccgggagctgatggcccctctctcccggctccgcccgcagactctggctcctccgactacacccgggggaacctagtccgcctggggctggccgggctggtcctcatctccctgggcgcgctggtcacttttgactggcgcagtcagaaccgcgctcctgctggtatccgcccctgagccccaggagcactgcagcccgagacttccaacctgagtggcggagaagctgggaccctgggctggactgtcctttcctgcagccccacagtcctgctggctgagctccgcggaacggtccttagaccccgctgtgccctgtgctgtagcttctttccaggcctttcccaaggagtagctgaaaggaagacgcgattagtggttaagacttccaagccagaagacagagggttcgaatcccagcactgccgtctactcactgtagtagtagcagctacagaaaggtagtagtgagacgtgaagccagctggacttcctgggttgaatggggacctggagaacttttctgtcttacaagaggattgtaaaatggaccaatcagcactctgtaagatggaccaatcagcgctctgtaaaatggaccaatcagcaggacatgggcggggacaataagggaataaaagctggcgagcgcggcaccccaccagagtctgcttccacgctgtgggagctttgttctcttgctctacacaataaatcttgctgctgct

SEQ ID NO: 162838 - DNA, 2061 bp, Homo sapiens; identical to SEQ ID NO: 162823
  Payload ID: 12085
  Gene Symbol: OSCAR
  Gene Name: osteoclast associated, immunoglobulin-like receptor
  Uniprot ID: Q8IYS5
  ENST ID: ENST00000612953
  CDS Start-End: 193-1053

SEQ ID NO: 162839 - DNA, 2049 bp, Homo sapiens; identical to SEQ ID NO: 162827
  Payload ID: 12085
  Gene Symbol: OSCAR
  Gene Name: osteoclast associated, immunoglobulin-like receptor
  Uniprot ID: Q8IYS5
  ENST ID: ENST00000611480
  CDS Start-End: 193-1041

SEQ ID NO: 162840 - DNA, 2016 bp, Homo sapiens; identical to SEQ ID NO: 162826
  Payload ID: 12085
  Gene Symbol: OSCAR
  Gene Name: osteoclast associated, immunoglobulin-like receptor
  ENST ID: ENST00000621506
  CDS Start-End: 193-1008

SEQ ID NO: 162841 - DNA, 2049 bp, Homo sapiens; identical to SEQ ID NO: 162827
  Payload ID: 12085
  Gene Symbol: OSCAR
  Gene Name: osteoclast associated, immunoglobulin-like receptor
  ENST ID: ENST00000617622
  CDS Start-End: 193-1041

SEQ ID NO: 162842 - DNA, 2055 bp, Homo sapiens
  Payload ID: 12085
  Gene Symbol: OSCAR
  Gene Name: osteoclast associated, immunoglobulin-like receptor
  Uniprot ID: Q8IYS5
  ENST ID: ENST00000613426
  CDS Start-End: 199-1047
gcgtgcgcactcgcgcagaacaaagatggagccgtggagtgccatagggctatgacacagtcacccacaggcccccacctcgatactctcttccgtaaatgaggatctgggtctggttttctgatgttgcctcatttcctgggaggggagagggtgcgaccaagccctggctccagctctagcgggtatctgcccaccatggccctggtgctgatcctccagctgctgaccctctggcctctgtgtcacacagacatcactccgtctgtccccccagcttcataccaccctaagccatggctgggagctcagccggctacagttgtgacccctggggtcaacgtgaccttgagatgccgggcaccccaacccgcttggagatttggacttttcaagcctggagagatcgctccccttctcttccgggatgtgtcctccgagctggcagaattctttctggaggaggtgactccagcccaagggggaatttaccgctgctgctaccgaaggccagactgggggccgggtgtctggtcccagcccagcgatgtcctggagctgctggtgacagaggagctgccgcggccgtcgctggtggcgctgcccgggccggtggtgggtcctggcgccaacgtgagcctgcgctgcgcgggccgcctgcggaacatgagcttcgtgctgtaccgcgagggcgtggcggccccgctgcagtaccgccactccgcgcagccctgggccgacttcacgctgctgggcgcccgcgcccccggcacctacagctgctactatcacacgccctccgcgccctacgtgctgtcgcagcgcagcgaggtgctggtcatcagctgggaaggtgagggccctgaggcccggcccgcctcctccgccccaggaatgcaggccccaggacctccgccctcagacccaggagcccaggcccccagcctctcctccttcagacccaggggtctagtcctgcagcccctcctccctcagacccaggattcctgggacccagcccctcctccctcagatccaggagtctagtcctccagctcctcctccctcagacccaggattcccgggccccagtacctcctccctcagacccaggactccaggcccccagcccctccttcctggacccaggactccaggcccccagcccctccttcctgatccagcagtccaggccccagccccttcttcctggacccaggagttgaagcctccatcgactccccctcaactttgagactgtagagtcaggtccctaagtccaccccaggggctggaaacctggagttcagggcccagactttggggtccgggagctgatggcccctctctcccggctccgcccgcagactctggctcctccgactacacccgggggaacctagtccgcctggggctggccgggctggtcctcatctccctgggcgcgctggtcacttttgactggcgcagtcagaaccgcgctcctgctggtatccgcccctgagccccaggagcactgcagcccgagacttccaacctgagtggcggagaagctgggaccctgggctggactgtcctttcctgcagccccacagtcctgctggctgagctccgcggaacggtccttagaccccgctgtgccctgtgctgtagcttctttccaggcctttcccaaggagtagctgaaaggaagacgcgattagtggttaagacttccaagccagaagacagagggttcgaatcccagcactgccgtctactcactgtagtagtagcagctacagaaaggtagtagtgagacgtgaagccagctggacttcctgggttgaatggggacctggagaacttttctgtcttacaagaggattgtaaaatggaccaatcagcactctgtaagatggaccaatcagcgctctgtaaaatggaccaatcagcaggacatgggcggggacaataagggaataaaagctggcgagcgcggcaccccaccagagtctgcttccacgctgtgggagctttgttctcttgctctacacaataaatcttgctgctgct

SEQ ID NO: 162843 - DNA, 1358 bp, Homo sapiens; identical to SEQ ID NO: 162829
  Payload ID: 12085
  Gene Symbol: OSCAR
  Gene Name: osteoclast associated, immunoglobulin-like receptor
  ENST ID: ENST00000614057
  CDS Start-End: 1-807

SEQ ID NO: 162844 - DNA, 1547 bp, Homo sapiens; identical to SEQ ID NO: 162824
  Payload ID: 12085
  Gene Symbol: OSCAR
  Gene Name: osteoclast associated, immunoglobulin-like receptor
  Uniprot ID: Q8IYS5
  ENST ID: ENST00000617834
  CDS Start-End: 193-996

SEQ ID NO: 162845 - DNA, 1358 bp, Homo sapiens; identical to SEQ ID NO: 162829
  Payload ID: 12085
  Gene Symbol: OSCAR
  Gene Name: osteoclast associated, immunoglobulin-like receptor
  ENST ID: ENST00000612543
  CDS Start-End: 1-807

SEQ ID NO: 162846 - DNA, 2049 bp, Homo sapiens; identical to SEQ ID NO: 162827
  Payload ID: 12085
  Gene Symbol: OSCAR
  Gene Name: osteoclast associated, immunoglobulin-like receptor
  ENST ID: ENST00000622326
  CDS Start-End: 193-1041

SEQ ID NO: 162847 - DNA, 2061 bp, Homo sapiens; identical to SEQ ID NO: 162823
  Payload ID: 12085
  Gene Symbol: OSCAR
  Gene Name: osteoclast associated, immunoglobulin-like receptor
  ENST ID: ENST00000617993
  CDS Start-End: 193-1053

SEQ ID NO: 162848 - DNA, 629 bp, Homo sapiens
  Payload ID: 12085
  Gene Symbol: OSCAR
  Gene Name: osteoclast associated, immunoglobulin-like receptor
  ENST ID: ENST00000622843
  CDS Start-End: 50-535
gagggtgcgaccaagccctggctccagctctagcgggtatctgcccaccatggccctggtgctgatcctccagctgctgaccctctggcctctgtgtcacacagacatcactccgtctgctggcagaattctttctggaggaggtgactccagcccaagggggaatttaccgctgctgctaccgaaggccagactgggggccgggtgtctggtcccagcccagcgatgtcctggagctgctggtgacagaggagctgccgcggccgtcgctggtggcgctgcccgggccggtggtgggtcctggcgccaacgtgagcctgcgctgcgcgggccgcctgcggaacatgagcttcgtgctgtaccgcgagggcgtggcggccccgctgcagtaccgccactccgcgcagccctgggccgacttcacgctgctgggcgcccgcgcccccggcacctacagctgctactatcacacgccctccgcgccctacgtgctgtcgcagcgcagcgaggtgctggtcatcagctgggaaggtgagggccctgaggcccggcccgcctcctccgccccaggaatgcaggccccaggacctccgccctcagacccaggagcccaggcccccagcctctcc

SEQ ID NO: 162849 - DNA, 2049 bp, Homo sapiens; identical to SEQ ID NO: 162827
  Payload ID: 12085
  Gene Symbol: OSCAR
  Gene Name: osteoclast associated, immunoglobulin-like receptor
  ENST ID: ENST00000614003
  CDS Start-End: 193-1041

SEQ ID NO: 162850 - DNA, 2049 bp, Homo sapiens; identical to SEQ ID NO: 162827
  Payload ID: 12085
  Gene Symbol: OSCAR
  Gene Name: osteoclast associated, immunoglobulin-like receptor
  ENST ID: ENST00000616758
  CDS Start-End: 193-1041

SEQ ID NO: 162851 - DNA, 2061 bp, Homo sapiens; identical to SEQ ID NO: 162823
  Payload ID: 12085
  Gene Symbol: OSCAR
  Gene Name: osteoclast associated, immunoglobulin-like receptor
  Uniprot ID: Q8IYS5
  ENST ID: ENST00000617187
  CDS Start-End: 193-1053

SEQ ID NO: 162852 - DNA, 1547 bp, Homo sapiens; identical to SEQ ID NO: 162824
  Payload ID: 12085
  Gene Symbol: OSCAR
  Gene Name: osteoclast associated, immunoglobulin-like receptor
  Uniprot ID: Q8IYS5
  ENST ID: ENST00000621788
  CDS Start-End: 193-996

SEQ ID NO: 162853 - DNA, 1358 bp, Homo sapiens; identical to SEQ ID NO: 162829
  Payload ID: 12085
  Gene Symbol: OSCAR
  Gene Name: osteoclast associated, immunoglobulin-like receptor
  ENST ID: ENST00000622275
  CDS Start-End: 1-807

SEQ ID NO: 162854 - DNA, 1547 bp, Homo sapiens; identical to SEQ ID NO: 162824
  Payload ID: 12085
  Gene Symbol: OSCAR
  Gene Name: osteoclast associated, immunoglobulin-like receptor
  ENST ID: ENST00000617210
  CDS Start-End: 193-996

SEQ ID NO: 162855 - DNA, 2016 bp, Homo sapiens; identical to SEQ ID NO: 162826
  Payload ID: 12085
  Gene Symbol: OSCAR
  Gene Name: osteoclast associated, immunoglobulin-like receptor
  Uniprot ID: Q8IYS5
  ENST ID: ENST00000615546
  CDS Start-End: 193-1008

SEQ ID NO: 162856 - DNA, 2049 bp, Homo sapiens; identical to SEQ ID NO: 162827
  Payload ID: 12085
  Gene Symbol: OSCAR
  Gene Name: osteoclast associated, immunoglobulin-like receptor
  ENST ID: ENST00000612289
  CDS Start-End: 193-1041

SEQ ID NO: 162857 - DNA, 1358 bp, Homo sapiens; identical to SEQ ID NO: 162829
  Payload ID: 12085
  Gene Symbol: OSCAR
  Gene Name: osteoclast associated, immunoglobulin-like receptor
  ENST ID: ENST00000618058
  CDS Start-End: 1-807

SEQ ID NO: 162858 - DNA, 2016 bp, Homo sapiens; identical to SEQ ID NO: 162826
  Payload ID: 12085
  Gene Symbol: OSCAR
  Gene Name: osteoclast associated, immunoglobulin-like receptor
  ENST ID: ENST00000611918
  CDS Start-End: 193-1008

SEQ ID NO: 162859 - DNA, 1547 bp, Homo sapiens; identical to SEQ ID NO: 162824
  Payload ID: 12085
  Gene Symbol: OSCAR
  Gene Name: osteoclast associated, immunoglobulin-like receptor
  ENST ID: ENST00000619170
  CDS Start-End: 193-996

SEQ ID NO: 162860 - DNA, 2061 bp, Homo sapiens; identical to SEQ ID NO: 162823
  Payload ID: 12085
  Gene Symbol: OSCAR
  Gene Name: osteoclast associated, immunoglobulin-like receptor
  ENST ID: ENST00000616461
  CDS Start-End: 193-1053

SEQ ID NO: 162861 - DNA, 2061 bp, Homo sapiens; identical to SEQ ID NO: 162823
  Payload ID: 12085
  Gene Symbol: OSCAR
  Gene Name: osteoclast associated, immunoglobulin-like receptor
  ENST ID: ENST00000614380
  CDS Start-End: 193-1053

SEQ ID NO: 162862 - DNA, 1355 bp, Homo sapiens
  Payload ID: 12085
  Gene Symbol: OSCAR
  Gene Name: osteoclast associated, immunoglobulin-like receptor
  Uniprot ID: Q8IYS5
  ENST ID: ENST00000621290
  CDS Start-End: 1-804
atggccctggtgctgatcctccagctgctgaccctctggcctctgtgtcacacagacatcactccgtctgtggccattatagtccccccagcttcataccaccctaagccatggctgggagctcagccggctacagttgtgacccctggggtcaacgtgaccttgagatgccgggcaccccaacccgcttggagatttggacttttcaagcctggagagatcgctccccttctcttccgggatgtgtcctccgagctggcagaattctttctggaggaggtgactccagcccaagggggaatttaccgctgctgctaccgaaggccagactgggggccgggtgtctggtcccagcccagcgatgtcctggagctgctggtgacagaggagctgccgcggccgtcgctggtggcgctgcccgggccggtggtgggtcctggcgccaacgtgagcctgcgctgcgcgggccgcctgcggaacatgagcttcgtgctgtaccgcgagggcgtggcggccccgctgcagtaccgccactccgcgcagccctgggccgacttcacgctgctgggcgcccgcgcccccggcacctacagctgctactatcacacgccctccgcgccctacgtgctgtcgcagcgcagcgaggtgctggtcatcagctgggaagactctggctcctccgactacacccgggggaacctagtccgcctggggctggccgggctggtcctcatctccctgggcgcgctggtcacttttgactggcgcagtcagaaccgcgctcctgctggtatccgcccctgagccccaggagcactgcagcccgagacttccaacctgagtggcggagaagctgggaccctgggctggactgtcctttcctgcagccccacagtcctgctggctgagctccgcggaacggtccttagaccccgctgtgccctgtgctgtagcttctttccaggcctttcccaaggagtagctgaaaggaagacgcgattagtggttaagacttccaagccagaagacagagggttcgaatcccagcactgccgtctactcactgtagtagtagcagctacagaaaggtagtagtgagacgtgaagccagctggacttcctgggttgaatggggacctggagaacttttctgtcttacaagaggattgtaaaatggaccaatcagcactctgtaagatggaccaatcagcgctctgtaaaatggaccaatcagcaggacatgggcggggacaataagggaataaaagctggcgagcgcggcaccccaccagagtctgcttccacgctgtgggagctttgttctcttgctctacacaataaatcttgctgctgct

SEQ ID NO: 162863 - DNA, 1358 bp, Homo sapiens; identical to SEQ ID NO: 162829
  Payload ID: 12085
  Gene Symbol: OSCAR
  Gene Name: osteoclast associated, immunoglobulin-like receptor
  ENST ID: ENST00000613895
  CDS Start-End: 1-807

SEQ ID NO: 162864 - DNA, 1547 bp, Homo sapiens; identical to SEQ ID NO: 162824
  Payload ID: 12085
  Gene Symbol: OSCAR
  Gene Name: osteoclast associated, immunoglobulin-like receptor
  Uniprot ID: Q8IYS5
  ENST ID: ENST00000621328
  CDS Start-End: 193-996

SEQ ID NO: 162865 - DNA, 1547 bp, Homo sapiens; identical to SEQ ID NO: 162824
  Payload ID: 12085
  Gene Symbol: OSCAR
  Gene Name: osteoclast associated, immunoglobulin-like receptor
  ENST ID: ENST00000620283
  CDS Start-End: 193-996

SEQ ID NO: 162866 - DNA, 1358 bp, Homo sapiens
  Payload ID: 12085
  Gene Symbol: OSCAR
  Gene Name: osteoclast associated, immunoglobulin-like receptor
  ENST ID: ENST00000616447
  CDS Start-End: 1-807
atggccctggtgctgatcctccagctgctgaccctctggcctctgtgtcacacagacatcactccgtctgcagccccgtttattgtccccccagcttcataccaccctaagccatggctgggagctcagccggctacagttgtgacccctggggtcaacgtgaccttgagatgccgggcaccccaacccgcttggagatttggacttttcaagcctggagagatcgctccccttctcttccgggatgtgtcctccgagctggcagaattctttctggaggaggtgactccagcccaagggggaagttaccgctgctgctaccgaaggccagactgggggccgggtgtctggtcccagcccagcgatgtcctggagctgctggtgacagaggagctgccgcggccgtcgctggtggcgctgcccgggccggtggtgggtcctggcgccaacgtgagcctgcgctgcgcgggccgcctgcggaacatgagcttcgtgctgtaccgcgagggcgtggcggccccgctgcagtaccgccactccgcgcagccctgggccgacttcacgctgctgggcgcccgcgcccccggcacctacagctgctactatcacacgccctccgcgccctacgtgctgtcgcagcgcagcgaggtgctggtcatcagctgggaagactctggctcctccgactacacccgggggaacctagtccgcctggggctggccgggctggtcctcatctccctgggcgcgctggtcacttttgactggcgcagtcagaaccgcgctcctgctggtatccgcccctgagccccaggagcactgcagcccgagacttccaacctgagtggcggagaagctgggaccctgggctggactgtcctttcctgcagccccacagtcctgctggctgagctccgcggaacggtccttagaccccgctgtgccctgtgctgtagcttctttccaggcctttcccaaggagtagctgaaaggaagacgcgattagtggttaagacttccaagccagaagacagagggttcgaatcccagcactgccgtctactcactgtagtagtagcagctacagaaaggtagtagtgagacgtgaagccagctggacttcctgggttgaatggggacctggagaacttttctgtcttacaagaggattgtaaaatggaccaatcagcactctgtaagatggaccaatcagcgctctgtaaaatggaccaatcagcaggacacgggcggggacaataagggaataaaagctggcgagcgcggcaccccaccagagtctgcttccacgttgtgggagctttgttctcttgctctacacaataaatcttgctgctgct

SEQ ID NO: 162867 - DNA, 1389 bp, Homo sapiens
  Payload ID: 12085
  Gene Symbol: OSCAR
  Gene Name: osteoclast associated, immunoglobulin-like receptor
  Uniprot ID: Q8IYS5
  ENST ID: ENST00000611535
  CDS Start-End: 47-838
ggtgcgaccaagccctggctccagctctagcgggtatctgcccaccatggccctggtgctgatcctccagctgctgaccctctggcctctgtgtcacacagacatcactccgtctgtccccccagcttcataccaccctaagccatggctgggagctcagccggctacagttgtgacccctggggtcaacgtgaccttgagatgccgggcaccccaacccgcttggagatttggacttttcaagcctggagagatcgctccccttctcttccgggatgtgtcctccgagctggcagaattctttctggaggaggtgactccagcccaagggggaatttaccgctgctgctaccgaaggccagactgggggccgggtgtctggtcccagcccagcgatgtcctggagctgctggtgacagaggagctgccgcggccgtcgctggtggcgctgcccgggccggtggtgggtcctggcgccaacgtgagcctgcgctgcgcgggccgcctgcggaacatgagcttcgtgctgtaccgcgagggcgtggcggccccgctgcagtaccgccactccgcgcagccctgggccgacttcacgctgctgggcgcccgcgcccccggcacctacagctgctactatcacacgccctccgcgccctacgtgctgtcgcagcgcagcgaggtgctggtcatcagctgggaagactctggctcctccgactacacccgggggaacctagtccgcctggggctggccgggctggtcctcatctccctgggcgcgctggtcacttttgactggcgcagtcagaaccgcgctcctgctggtatccgcccctgagccccaggagcactgcagcccgagacttccaacctgagtggcggagaagctgggaccctgggctggactgtcctttcctgcagccccacagtcctgctggctgagctccgcggaacggtccttagaccccgctgtgccctgtgctgtagcttctttccaggcctttcccaaggagtagctgaaaggaagacgcgattagtggttaagacttccaagccagaagacagagggttcgaatcccagcactgccgtctactcactgtagtagtagcagctacagaaaggtagtagtgagacgtgaagccagctggacttcctgggttgaatggggacctggagaacttttctgtcttacaagaggattgtaaaatggaccaatcagcactctgtaagatggaccaatcagcgctctgtaaaatggaccaatcagcaggacatgggcggggacaataagggaataaaagctggcgagcgcggcaccccaccagagtctgcttccacgctgtgggagctttgttctcttgctctacacaataaatcttgctgctgct

SEQ ID NO: 162868 - DNA, 2016 bp, Homo sapiens; identical to SEQ ID NO: 162826
  Payload ID: 12085
  Gene Symbol: OSCAR
  Gene Name: osteoclast associated, immunoglobulin-like receptor
  Uniprot ID: Q8IYS5
  ENST ID: ENST00000613814
  CDS Start-End: 193-1008

SEQ ID NO: 162869 - DNA, 2049 bp, Homo sapiens; identical to SEQ ID NO: 162827
  Payload ID: 12085
  Gene Symbol: OSCAR
  Gene Name: osteoclast associated, immunoglobulin-like receptor
  ENST ID: ENST00000618710
  CDS Start-End: 193-1041

SEQ ID NO: 162870 - DNA, 1547 bp, Homo sapiens
  Payload ID: 12085
  Gene Symbol: OSCAR
  Gene Name: osteoclast associated, immunoglobulin-like receptor
  ENST ID: ENST00000617140
  CDS Start-End: 193-996
gcactcgcgcagaacaaagatggagccgtggagtgccatagggctatgacacagtcacccacaggcccccacctcgatactctcttccgtaaatgaggatctgggtctggttttctgatgttgcctcatttcctgggaggggagagggtgcgaccaagccctggctccagctctagcgggtatctgcccaccatggccctggtgctgatcctccagctgctgaccctctggcctctgtgtcacacagacatcactccgtctgtggccattatagtccccccagcttcataccaccctaagccatggctgggagctcagccggctacagttgtgacccctggggtcaacgtgaccttgagatgccgggcaccccaacccgcttggagatttggacttttcaagcctggagagatcgctccccttctcttccgggatgtgtcctccgagctggcagaattctttctggaggaggtgactccagcccaagggggaagttaccgctgctgctaccgaaggccagactgggggccgggtgtctggtcccagcccagcgatgtcctggagctgctggtgacagaggagctgccgcggccgtcgctggtggcgctgcccgggccggtggtgggtcctggcgccaacgtgagcctgcgctgcgcgggccgcctgcggaacatgagcttcgtgctgtaccgcgagggcgtggcggccccgctgcagtaccgccactccgcgcagccctgggccgacttcacgctgctgggcgcccgcgcccccggcacctacagctgctactatcacacgccctccgcgccctacgtgctgtcgcagcgcagcgaggtgctggtcatcagctgggaagactctggctcctccgactacacccgggggaacctagtccgcctggggctggccgggctggtcctcatctccctgggcgcgctggtcacttttgactggcgcagtcagaaccgcgctcctgctggtatccgcccctgagccccaggagcactgcagcccgagacttccaacctgagtggcggagaagctgggaccctgggctggactgtcctttcctgcagccccacagtcctgctggctgagctccgcggaacggtccttagaccccgctgtgccctgtgctgtagcttctttccaggcctttcccaaggagtagctgaaaggaagacgcgattagtggttaagacttccaagccagaagacagagggttcgaatcccagcactgccgtctactcactgtagtagtagcagctacagaaaggtagtagtgagacgtgaagccagctggacttcctgggttgaatggggacctggagaacttttctgtcttacaagaggattgtaaaatggaccaatcagcactctgtaagatggaccaatcagcgctctgtaaaatggaccaatcagcaggacacgggcggggacaataagggaataaaagctggcgagcgcggcaccccaccagagtctgcttccacgttgtgggagctttgttctcttgctctacacaataaatcttgctgctgct

SEQ ID NO: 162871 - DNA, 2016 bp, Homo sapiens; identical to SEQ ID NO: 162826
  Payload ID: 12085
  Gene Symbol: OSCAR
  Gene Name: osteoclast associated, immunoglobulin-like receptor
  ENST ID: ENST00000616232
  CDS Start-End: 193-1008

SEQ ID NO: 162872 - DNA, 1547 bp, Homo sapiens; identical to SEQ ID NO: 162824
  Payload ID: 12085
  Gene Symbol: OSCAR
  Gene Name: osteoclast associated, immunoglobulin-like receptor
  ENST ID: ENST00000622288
  CDS Start-End: 193-996

SEQ ID NO: 162873 - DNA, 1358 bp, Homo sapiens; identical to SEQ ID NO: 162829
  Payload ID: 12085
  Gene Symbol: OSCAR
  Gene Name: osteoclast associated, immunoglobulin-like receptor
  ENST ID: ENST00000611322
  CDS Start-End: 1-807

SEQ ID NO: 162874 - DNA, 2061 bp, Homo sapiens; identical to SEQ ID NO: 162823
  Payload ID: 12085
  Gene Symbol: OSCAR
  Gene Name: osteoclast associated, immunoglobulin-like receptor
  ENST ID: ENST00000610985
  CDS Start-End: 193-1053

SEQ ID NO: 162875 - DNA, 2016 bp, Homo sapiens; identical to SEQ ID NO: 162826
  Payload ID: 12085
  Gene Symbol: OSCAR
  Gene Name: osteoclast associated, immunoglobulin-like receptor
  ENST ID: ENST00000619631
  CDS Start-End: 193-1008

SEQ ID NO: 162876 - DNA, 1375 bp, Homo sapiens
  Payload ID: 12085
  Gene Symbol: OSCAR
  Gene Name: osteoclast associated, immunoglobulin-like receptor
  Uniprot ID: Q8IYS5
  ENST ID: ENST00000619287
  CDS Start-End: 66-824
atttcctgggaggggagagggtgcgaccaagccctggctccagctctagcgggtatctgcccaccatggccctggtgctgatcctccagctgctgaccctcttccccccagcttcataccaccctaagccatggctgggagctcagccggctacagttgtgacccctggggtcaacgtgaccttgagatgccgggcaccccaacccgcttggagatttggacttttcaagcctggagagatcgctccccttctcttccgggatgtgtcctccgagctggcagaattctttctggaggaggtgactccagcccaagggggaatttaccgctgctgctaccgaaggccagactgggggccgggtgtctggtcccagcccagcgatgtcctggagctgctggtgacagaggagctgccgcggccgtcgctggtggcgctgcccgggccggtggtgggtcctggcgccaacgtgagcctgcgctgcgcgggccgcctgcggaacatgagcttcgtgctgtaccgcgagggcgtggcggccccgctgcagtaccgccactccgcgcagccctgggccgacttcacgctgctgggcgcccgcgcccccggcacctacagctgctactatcacacgccctccgcgccctacgtgctgtcgcagcgcagcgaggtgctggtcatcagctgggaagactctggctcctccgactacacccgggggaacctagtccgcctggggctggccgggctggtcctcatctccctgggcgcgctggtcacttttgactggcgcagtcagaaccgcgctcctgctggtatccgcccctgagccccaggagcactgcagcccgagacttccaacctgagtggcggagaagctgggaccctgggctggactgtcctttcctgcagccccacagtcctgctggctgagctccgcggaacggtccttagaccccgctgtgccctgtgctgtagcttctttccaggcctttcccaaggagtagctgaaaggaagacgcgattagtggttaagacttccaagccagaagacagagggttcgaatcccagcactgccgtctactcactgtagtagtagcagctacagaaaggtagtagtgagacgtgaagccagctggacttcctgggttgaatggggacctggagaacttttctgtcttacaagaggattgtaaaatggaccaatcagcactctgtaagatggaccaatcagcgctctgtaaaatggaccaatcagcaggacatgggcggggacaataagggaataaaagctggcgagcgcggcaccccaccagagtctgcttccacgctgtgggagctttgttctcttgctctacacaataaatcttgctgctgct

SEQ ID NO: 162877 - DNA, 1319 bp, Homo sapiens
  Payload ID: 12086
  Gene Symbol: OSTF1
  Gene Name: osteoclast stimulating factor 1
  Uniprot ID: Q92882
  ENST ID: ENST00000346234
  CDS Start-End: 151-795
ctcttcccgcagccaagggtgggcgccggtcctaggaggcgcacggttgtaagccagacaaaaagaactggggtgcccggagtgccaggtggcgggcaagcggtgggcttttcggcggggtctttaggatttgcagctccaggaagcgagatgtcgaagccgccacccaaaccagtcaaaccagggcaagttaaagtcttcagagccctgtatacgtttgaacccagaactccagatgaattatactttgaggaaggtgatattatctacattactgacatgagcgataccaattggtggaaaggcacctccaaaggcaggactggactaattccaagcaactatgtggctgagcaggcagaatccattgacaatccattgcatgaagcagcaaaaagaggcaacttgagctggttgagagagtgtttggacaacagagtgggtgttaatggcttagacaaagctggaagcactgccttatactgggcttgccacgggggccacaaagatatagtggaaatgctatttactcaaccaaatattgaactgaaccagcagaacaagttgggagatacagctttgcatgctgctgcctggaagggttatgcagatatcgtccagttgcttctggcaaaaggtgctagaacagacttaagaaacattgagaagaagctggccttcgacatggctaccaatgctgcctgtgcatctctcctgaaaaagaaacagggaacagatgcagttcgaacattaagcaatgccgaggactatctcgatgatgaagactcagattaattcctttctggagctttgagatctaaaacttctgttgcttttgccattccaaaactttgtctttgccagaaaagtgttggtaactataaagaaaattatatatgaacacggcagtgttgcactgtgtttgagtagaacgtgtaaatgaattgttcccacctttggtttgccagtaagtgactggattcttggcacatttatgttcaccaaagtagaacaagaagatattatttctatttatcaagcaaaaggaattttaagatttttttttttctttaaaaacaaattaggattttttttttttttttttttttagttaaaatgctttacctcaatggttgagatattttgaatggatttttcaagggggggaaatgcttattataataataaaccaaaatacttaacagaaaattgtcagctattctgacaaaaataaacattttgagagactttatttcttttgtccgtttctgtggtatcactcattgtcgttaagtaagtaaagctttttatatttaggt

SEQ ID NO: 162878 - DNA, 2043 bp, Homo sapiens
  Payload ID: 12087
  Gene Symbol: OCSTAMP
  Gene Name: osteoclast stimulatory transmembrane protein
  Uniprot ID: Q9BR26
  ENST ID: ENST00000279028
  CDS Start-End: 15-1715
gccatttggacagcatgccaggccacccaggagcagctgagcaacttgtcaagaccgggtggaggtcctggcacttggggttctggaaggcccttgccccactgcaggctgcctgggacgccttctcccagcctgttccagccagctgtggccagctgctgacccagctcctcctgtgtgcctccctggctgctgctgctgcaggtctggtttatcactggctggcatccttgctgctttatcctcctggaccttcagccatggttgccactgtctgtggcctcctggtcttcctgagcctgggcctggtacccccagtccgctgcctgtttgcactcagcgtgcccaccctgggtatggagcagggccgccggctgctcctgtcctacagcactgccaccctggccattgctgtggtgcccaacgtcctggccaacgtgggtgcggccgggcaggtgctgaggtgtgtcaccgagggctccctggagagtctcctcaataccactcaccagctgcatgcagcatccagggctctgggccccacaggccaggcaggcagccggggcctgacatttgaggcccaggacaatggctctgccttctaccttcacatgctcagggtcactcagcaggtcctggaggatttctctggcctggagtccctggcccgggcagcagcgctagggacccagcgagtggtcacagggctgtttatgttgggcctcctggtggagtcggcatggtacctccattgctacctgacagacctgcggtttgacaatatctacgccactcaacagctgacccagcggttggcacaggcccaggctacacacctcctggcccctccacccacctggctgctccaggcggctcagctgaggctgtcacaggaggagctgttgagttgtcttctaaggctggggctgcttgccctgctcctcgtggccacggctgtggcggtggccacagaccatgtagccttcctcctggcacaggctactgtggactgggctcagaagttgccaactgtgcccatcacgctcacggtcaagtatgatgtggcatacactgtcctgggcttcatccctttcctcttcaaccagctggctccggagagccccttcctctccgtccacagctcctaccaatgggagctccgcctcacctccgcccgctgcccactgctacccgcccggcgtccccgcgcagctgccccgctggccgcgggggccctgcagctcctggcgggctccacggtgctcctggaggcctacgcccgccgcctgcggcatgccatcgccgcttccttcttcacagcccaggaggcgaggagggtccgccacctgcacgcccggctccagcgaagacacgacaggcaccaaggccagcagctgcccctaggggatccttcttgcgtccccacacccagacctgcctgcaagcctccggcatggatagactacaggctggatgccttaagaaccgagagcagtgagggagaagggaaagagctttggagttgcagagacctgagttgtaaccttggtcctgtgccgcctccctgtgtgaccttgggtaagtcacttcacctctctgagcctcggtttctacatctgcataacgacagcatatttaccattgatgtgacctacttcccacgcagggatgtggtcaggatggaaggaaatactgggcatgataggcctggataaccggtaaagaaccatgcaaaggcgaagacaaggagtgcagagagagctcatggttcctccaggctggttggcgatcaggctcatctcatctgcaccaactgctctacttgttagatggagaccttgcatcatgaatttctcgaaatgctcctggaacttatttatatgcctcaaaatcctctaaactcatttatagtaacccatagttttaattttataaataaacgtatttattaaatcttagattacgttattcctctgcctcaaattccttcagggcctttccattgccaggattagattttgccaaattaaaatataggacact

SEQ ID NO: 162879 - DNA, 402 bp, Homo sapiens
  Payload ID: 12088
  Gene Symbol: OSTN
  Gene Name: osteocrin
  Uniprot ID: P61366
  ENST ID: ENST00000339051
  CDS Start-End: 1-402
atgctggactggagattggcaagtgcacatttcatcctggctgtgacactgacactgtggagctcaggaaaagtcctctcagtagatgtaacaacaacagaggcctttgattctggagtcatagatgtgcagtcaacacccacagtcagggaagagaaatcagccactgacctgacagcaaaactcttgcttcttgatgaattggtgtccctagaaaatgatgtgattgagacaaagaagaaaaggagtttctctggttttgggtctccccttgacagactctcagctggctctgtagatcacaaaggtaaacagaggaaagtagtagatcatccaaaaaggcgatttggtatccccatggatcggattggtagaaaccggctttcaaattccagaggctaa

SEQ ID NO: 162880 - DNA, 3134 bp, Homo sapiens
  Payload ID: 12088
  Gene Symbol: OSTN
  Gene Name: osteocrin
  ENST ID: ENST00000445281
  CDS Start-End: 68-403
agggctgagttttggagaaactgcagagacagtactctaaagttagaatctcctgatctttcacgagatgctggactggagattggcaagtgcacatttcatcctggctgtgacactgacactgtggagctcaggaaaagtcctctcagtagatgtaacaacaacagaggcctttgattctggagtcatagatgtgcagtcaacacccacagtcagggaagagaaatcagccactgacctgacagcaaaactcttgcttcttgatgaattggtgtccctagaaaatgatgtgattgagacaaagaagaaaaggagtttctctggttttgggtctccccttgacagactctcagctggctctgtagatcacaaaggtaaacagagatgcaacttccttgggtgaaatgtcacagcaatatggaagatgcttcactgaagttattcacacttcttaatgattaaacttttaaggaactgaccttctgcaaatcctttccaaagcttgaacttcagtccatcacattacagcattgttacagcttcaattaaattgtgtaaatcattttgatgcacgtacattttaaaattatatattttaattattcaagaatggttaacttccccttaaaccttacttttaaaaataataattaaatacacaatacagtgaaatgccttctgtatggatttaccatgcacatgtttgtagtcaaagaataataacaaaagacagatttgcttctgtaaaatttagttataatctgtccattattggggaatgaggaaaggcaatgctgtgtattttctgttgagtactttcacttccctgtattccatttttccaagagtctgatcggtaataattatgaaattaggcttctcttttcatattcaagtttcagtcatgttcagaaaaataaaacacagccccaatgagcctattgacttagaattaagaaagtgaaggacattactcatttgtcaaacttagatatcacttgtcccctaaaaactttccatttttctaaattctgacagttaagagcagtagtgtctcattaggaggggagtaagctcacacagaggtaaaaatgaaagtaggagggaagtcaaagaattaccaccagaacaggttaggaccagctaagcacacatcattttagctcagtacacttcagcatagtacaatgtgatctttttgatatcttggattaatctaagaaactgtttactgtgtttcacatattggcttctttggcttcaattgtcttattatccttagtaagccaattgaagagcataatgattttgagaatgatttcttaaaaatcattcagattatttttgaatgacttattaaaacataagttttcgtattgtagaaaactcagttctcagtaataactatgatgttactgtagcttggacacataggtccattgtgcattggatatactttgaaaacacacaaaaaaaactttctatggaacagagattcatcataagttacttagcagaagtttataaagcatcgaaaaacacttcctctgtaaaccctaaaaatcactgtctgatacgtgggaggaaaaaagttttgtccagtagagcaaaggcttatttcagcataaaaagagagtgttgtgagttgtgagaaggtgtcttaattttaaaggaagaggagagaaatgggcaattgctaatcttaactaaaaattaatggacttgtatgatccaaagaataaaataaactcaaagaaacataacaaaaatatattagaaaaagagttaaactaagaaattgacctttatgaaggactaatttttcagttatccaatgtgctttttaaagataaagtttaaaagaggcaaaaagaggtgaaagaaatgaacatgtgtacttagaatatatatattggttttgtatgtaacttcttagtttttctggatatttttaaaattgaaagtcttcaaaattaatttaggaaaaatagtaaataattttttttcattgtagtagagggctgtagccaagagaagtgaattttgggaaatctaaccaattctttttttcataaacttgtgttagaaagctagcaatagcacatagggaagtatcctggaggactcaggagttgaaagaattatttaagaagttgtgatatccttgtctgcctttccccaaccttgtgatgaactatagaaatgtttcctattgcttagaagctctttctttccttgtatgcacatttgggtatttgtaagcttctaatccaattgggttctgcttcatgctttgacaaaaggtattaaaacctactttagcctaaaactttctcatggtaaatattggaagttggattatgcaaattgatttcctccattctttattttttaattcaaaattagactatgacatccaacttaattaaaataagaagtcacaatatagtgatttatgctatagtttcatgtgtaatgtattttcacctaatatacacacaatttccatgaagggaagaaaatgttttctccacttataactctattttatttcatattttaatttttaccactacttcattcagagtagaaaataagtcagcaatatactaaataatggggctattcttttaacatagcagtaaattaagacagaatttttgttaagaatatgacaagtcatctcacttatttatccaatgcattaggtattactaatccaactatatttcaacttgaagggacttttttgttttgtttcaaaataatgcattacttttttctctttgcttctgtatgaacctttatagagcaaatgaatatatgtatatggagttctgggttctagtgtcaattacataatcaaatttcataaaaggatgttagttactggctatgttgtcctaaaatttacacacactaaaaaatgtctgtcaagttgtacctttaacctgttcatagctttagggaattaagtttcttaaaccaaattatgaaaaaataacttaatggaatcttctaaaaggaaaaagtataaaaagctttctgaatgatattaccccttatacctaaaggctcaagatgcttgaatatggttcaacttttccaaagttaataaacaagggatgatgaaa

SEQ ID NO: 162881 - DNA, 2971 bp, Homo sapiens
  Payload ID: 12089
  Gene Symbol: OGN
  Gene Name: osteoglycin
  Uniprot ID: P20774
  ENST ID: ENST00000262551
  CDS Start-End: 422-1318
gctaatgcacagacatgaacatctattgaggaaaaccacaaaaaacttcaaaacagctacaacggtatcctaagaatatttcaattaaatattagtatgtctgctgaaggcacttaattattaagaaacttaaaattatcaatctttcttgaatttctgatagagaagtaaaactattttccaaaactatttttcagaatgttcactgatacataaaaactgctagcatctaattaaagatcactaagggttaaatactgttctctggcccttactgcgcacaccctgccaaaacatcctctaagcttttaaatattgcttcgatggtctgaatttttatttccagggaaaaagagagttttgtcccacagtcagcaggccactagtttattaacttccagtcaccttgatttttgctaaaatgaagactctgcagtctacacttctcctgttactgcttgtgcctctgataaagccagcaccaccaacccagcaggactcacgcattatctatgattatggaacagataattttgaagaatccatatttagccaagattatgaggataaatacctggatggaaaaaatattaaggaaaaagaaactgtgataatacccaatgagaaaagtcttcaattacaaaaagatgaggcaataacaccattacctcccaagaaagaaaatgatgaaatgcccacgtgtctgctgtgtgtttgtttaagtggctctgtatactgtgaagaagttgacattgatgctgtaccacccttaccaaaggaatcagcctatctttacgcacgattcaacaaaattaaaaagctgactgccaaagattttgcagacatacctaacttaagaagactcgattttacaggaaatttgatagaagatatagaagatggtactttttcaaaactttctctgttagaagaactttcacttgctgaaaatcaactactaaaacttccagttcttcctcccaagctcactttatttaatgcaaaatacaacaaaatcaagagtaggggaatcaaagcaaatgcattcaaaaaactgaataacctcaccttcctctacttggaccataatgccctggaatccgtgcctcttaatttaccagaaagtctacgtgtaattcatcttcagttcaacaacatagcttcaattacagatgacacattctgcaaggctaatgacaccagttacatccgggaccgcattgaagagatacgcctggagggcaatccaatcgtcctgggaaagcatccaaacagttttatttgcttaaaaagattaccgatagggtcatacttttaacctctattggtacaacatataaatgaaagtacacctacactaatagtctgtctcaacaatgagtaaaggaacttaagtattggtttaatattaaccttgtatctcattttgaaggaatttaatattttaagcaaggatgttcaaaatcttacatataataagtaaaaagtaagactgaatgtctacgttcgaaacaaagtaatatgaaaatatttaaacagcattacaaaatcctagtttatactagactaccatttaaaaatcatgtttttatataaatgcccaaatttgagatgcattattcctattactaatgatgtaagtacgaggataaatccaagaaactttcaactctttgcctttcctggcctttactggatcccaaaagcatttaaggtacatgttccaaaaactttgaaaagctaaatgtttcccatgatcgctcattcttcttttatgattcatacgttattccttataaagtaagaactttgttttcctcctatcaaggcagctattttattaaatttttcacttagtctgagaaatagcagatagtctcatatttaggaaaactttccaaataaaataaatgttattctctgataaagagctaatacagaaatgttcaagttattttactttctggtaatgtcttcagtaaaatattttctttatctaaatattaacattctaagtctaccaaaaaaagttttaaactcaagcaggccaaaaccaatatgcttataagaaataatgaaaagttcatccatttctgataaagttctctatggcaaagtctttcaaatacgagataactgcaaaatattttccttttatactacagaaatgagaatctcatcaataaattagttcaagcataagatgaaaacagaatattctgtggtgccagtgcacactaccttcccacccatacacatccatgttcactgtaacaaactgaatattcacaataaagcttctgagtaacactttctgattactcatgataaactgacatggctaactgcaagaattaaatcttctatctgagagtaataatttatgatgactcagtggtgccagagtaaagtttctaaaataacattcctctcacttgtaccccactaaaagtattagactacacattacattgaagttaaacacaaaattatcagtgttttagaaacatgagtccggactgtgtaagtaaaagtacaaacattatttccaccataaagtatgtattgaaatcaagttgtctctgtgtacagaatacatacttattcccatttttaagcatttgcttctgttttccctacctagaatgtcagatgtttttcagttatctccccatttgtcaaagttgacctcaagataacatttttcattaaagcatctgagatctaagaacacaattattattctaacaatgattattagctcattcacttattttgataactaatgatcacagctattatactactttctcgttattttgtgtgcatgcctcatttccctgacttaaacctcactgagagcgcaaaatgcagctttatactttttactttcaattgcctagcacaatagtgagtacatttgaattgaatatataataaatattgcaaaataaaatccatctaaatagaa

SEQ ID NO: 162882 - DNA, 2743 bp, Homo sapiens
  Payload ID: 12089
  Gene Symbol: OGN
  Gene Name: osteoglycin
  Uniprot ID: P20774
  ENST ID: ENST00000375561
  CDS Start-End: 194-1090
actcagcagtttgaaatcaagacatagcttttctcattcaccctcccacttggggctaatgcacagacatgaacatctattgaggaaaaccacaaaaaacttcaaaacagctacaacgggaaaaagagagttttgtcccacagtcagcaggccactagtttattaacttccagtcaccttgatttttgctaaaatgaagactctgcagtctacacttctcctgttactgcttgtgcctctgataaagccagcaccaccaacccagcaggactcacgcattatctatgattatggaacagataattttgaagaatccatatttagccaagattatgaggataaatacctggatggaaaaaatattaaggaaaaagaaactgtgataatacccaatgagaaaagtcttcaattacaaaaagatgaggcaataacaccattacctcccaagaaagaaaatgatgaaatgcccacgtgtctgctgtgtgtttgtttaagtggctctgtatactgtgaagaagttgacattgatgctgtaccacccttaccaaaggaatcagcctatctttacgcacgattcaacaaaattaaaaagctgactgccaaagattttgcagacatacctaacttaagaagactcgattttacaggaaatttgatagaagatatagaagatggtactttttcaaaactttctctgttagaagaactttcacttgctgaaaatcaactactaaaacttccagttcttcctcccaagctcactttatttaatgcaaaatacaacaaaatcaagagtaggggaatcaaagcaaatgcattcaaaaaactgaataacctcaccttcctctacttggaccataatgccctggaatccgtgcctcttaatttaccagaaagtctacgtgtaattcatcttcagttcaacaacatagcttcaattacagatgacacattctgcaaggctaatgacaccagttacatccgggaccgcattgaagagatacgcctggagggcaatccaatcgtcctgggaaagcatccaaacagttttatttgcttaaaaagattaccgatagggtcatacttttaacctctattggtacaacatataaatgaaagtacacctacactaatagtctgtctcaacaatgagtaaaggaacttaagtattggtttaatattaaccttgtatctcattttgaaggaatttaatattttaagcaaggatgttcaaaatcttacatataataagtaaaaagtaagactgaatgtctacgttcgaaacaaagtaatatgaaaatatttaaacagcattacaaaatcctagtttatactagactaccatttaaaaatcatgtttttatataaatgcccaaatttgagatgcattattcctattactaatgatgtaagtacgaggataaatccaagaaactttcaactctttgcctttcctggcctttactggatcccaaaagcatttaaggtacatgttccaaaaactttgaaaagctaaatgtttcccatgatcgctcattcttcttttatgattcatacgttattccttataaagtaagaactttgttttcctcctatcaaggcagctattttattaaatttttcacttagtctgagaaatagcagatagtctcatatttaggaaaactttccaaataaaataaatgttattctctgataaagagctaatacagaaatgttcaagttattttactttctggtaatgtcttcagtaaaatattttctttatctaaatattaacattctaagtctaccaaaaaaagttttaaactcaagcaggccaaaaccaatatgcttataagaaataatgaaaagttcatccatttctgataaagttctctatggcaaagtctttcaaatacgagataactgcaaaatattttccttttatactacagaaatgagaatctcatcaataaattagttcaagcataagatgaaaacagaatattctgtggtgccagtgcacactaccttcccacccatacacatccatgttcactgtaacaaactgaatattcacaataaagcttctgagtaacactttctgattactcatgataaactgacatggctaactgcaagaattaaatcttctatctgagagtaataatttatgatgactcagtggtgccagagtaaagtttctaaaataacattcctctcacttgtaccccactaaaagtattagactacacattacattgaagttaaacacaaaattatcagtgttttagaaacatgagtccggactgtgtaagtaaaagtacaaacattatttccaccataaagtatgtattgaaatcaagttgtctctgtgtacagaatacatacttattcccatttttaagcatttgcttctgttttccctacctagaatgtcagatgtttttcagttatctccccatttgtcaaagttgacctcaagataacatttttcattaaagcatctgagatctaagaacacaattattattctaacaatgattattagctcattcacttattttgataactaatgatcacagctattatactactttctcgttattttgtgtgcatgcctcatttccctgacttaaacctcactgagagcgcaaaatgcagctttatactttttactttcaattgcctagcacaatagtgagtacatttgaattgaatatataataaatattgcaaaataaaatccatctaaatagaa

SEQ ID NO: 162883 - DNA, 825 bp, Homo sapiens
  Payload ID: 12089
  Gene Symbol: OGN
  Gene Name: osteoglycin
  ENST ID: ENST00000447356
  CDS Start-End: 22-825
gcatttcaccctagagaaagaatgctggcaaagatctctaccacatggaaactgttcttaaagctgctgggccctgaaattttactcagcagtttgaaatcaagacatagcttttctcattcaccctcccacttggggctaatgcacagacatgaacatctattgaggaaaaccacaaaaaacttcaaaacagctacaacgactctgcagtctacacttctcctgttactgcttgtgcctctgataaagccagcaccaccaacccagcaggactcacgcattatctatgattatggaacagataattttgaagaatccatatttagccaagattatgaggataaatacctggatggaaaaaatattaaggaaaaagaaactgtgataatacccaatgagaaaagtcttcaattacaaaaagatgaggcaataacaccattacctcccaagaaagaaaatgatgaaatgcccacgtgtctgctgtgtgtttgtttaagtggctctgtatactgtgaagaagttgacattgatgctgtaccacccttaccaaaggaatcagcctatctttacgcacgattcaacaaaattaaaaagctgactgccaaagattttgcagacatacctaacttaagaagactcgattttacaggaaatttgatagaagatatagaagatggtactttttcaaaactttctctgttagaagaactttcacttgctgaaaatcaactactaaaacttccagttcttcctcccaagctcactttatttaatgcaaaatacaacaaaatcaagagtaggggaatcaaagcaaatgcattcaaa

SEQ ID NO: 162884 - DNA, 2449 bp, Homo sapiens
  Payload ID: 12090
  Gene Symbol: OMD
  Gene Name: osteomodulin
  Uniprot ID: Q99983
  ENST ID: ENST00000375550
  CDS Start-End: 277-1542
gaccaagaacacaagcatcttaatttgaatccacaaagtttcatgtaatgaaaagaaatacataattttaattcaacccgagtgttttccaagaagattgtatttgcttaaattgctacagtaattcaagagacagccctgtctggacacagagttactgtggatttttaagagactcagttaaagaatttaggaatttctgattcatttaaaggatttacaaattcatcaacccctgaaaactaaagcaaattgaacaggaaaaaaaaaaagaagatgggttttttaagtccaatatatgttattttcttcttttttggagtcaaagtacattgccaatatgaaacttatcagtgggatgaagactatgaccaagagccagatgatgattaccaaacaggattcccatttcgtcaaaatgtagactacggagttccttttcatcagtatactttaggctgtgtcagtgaatgcttctgtccaactaactttccatcatcaatgtactgtgataatcgcaaactcaagactatcccaaatattccgatgcacattcagcaactctaccttcagttcaatgaaattgaggctgtgactgcaaattcattcatcaatgcaactcatcttaaagaaattaacctcagccacaacaaaattaaatctcaaaagattgattatggtgtgtttgctaagcttccaaatctactacaacttcatctagagcataataatttagaagaatttccatttcctcttcctaaatctctggaaagactccttcttggttacaatgaaatctccaaactgcagacaaatgctatggatgggctagtaaacttgaccatgcttgatctctgttataattatcttcatgattctctgctaaaagacaaaatctttgccaaaatggaaaaactaatgcagctcaacctctgcagtaacagattagaatcaatgcctcctggtttgccttcttcacttatgtatctgtctttagaaaataattcaatttcttctatacccgaaaaatacttcgacaaacttccaaaacttcatactctaagaatgtcacacaacaaactacaagacatcccatataatatttttaatcttcccaacattgtagaactcagtgttggacacaacaaattgaagcaagcattctatattccaagaaatttggaacacctatacctacaaaataatgaaatagaaaagatgaatcttacagtgatgtgtccttctattgacccactacattaccaccatttaacatacattcgtgtggaccaaaataaactaaaagaaccaataagctcatacatcttcttctgcttccctcatatacacactatttattatggtgaacaacgaagcactaatggtcaaacaatacaactaaagacacaagttttcaggagatttccagatgatgatgatgaaagtgaagatcacgatgatcctgacaatgctcatgagagcccagaacaagaaggagcagaagggcactttgaccttcattattatgaaaatcaagaatagcaagaaactatataggtatacacttacgacttcacaaaacctatacttaatatagtaaatctaagtaaacatgtattactcaaagtaatatatttagaattatgtattagtataagatcagaattgaatttaagttgttggtgacatctgcatcatttcataggattagaacttactcaaaataatgtaaatctttaaaaatataaattagaatgacaagtgggaatcataaattaaacgttaatggtttcttatgctctttttaaatatagaaatatcatgttaaagaaagtgagtgtatcatttctattaacagtaatttttctaaaaatgaggaaggaagtagcattagcagtaaagacccacaggccatgacctttttgatcactctgaggacaatatttaaatgacaggaaggtatattaatgtaacaagcattcatttaaggaatagaccattttctctgacctcttcttcaggaaagctttcacactggtatttgtgatctcaccattatgacatccatccccctagctcaccacatagcacatagaatgatatttttgatttgtaagaggccatccaggtactaaggacccaaggcatacagattcacaaaattaactaatctttttgcctcagaataccaaaacaacaaaattataaagctgtatttggacaactaaaaaacaccaaactatctcattgcaatttgtattttagcagatttcagcaactatcctaaacaatgttattgtgttccattttaactgggataaatgtttttgtaaaaatacaaccatagaaaggcctctttgttacaaaatgatttgcaaagaaataactgctttgtttgcaagattaaattagtgttggcaaaataaagttctaaagataatactaaaca

SEQ ID NO: 162885 - DNA, 4467 bp, Homo sapiens
  Payload ID: 12091
  Gene Symbol: OSTM1
  Gene Name: osteopetrosis associated transmembrane protein 1
  Uniprot ID: Q86WC4
  ENST ID: ENST00000193322
  CDS Start-End: 87-1091
gcggaaaccggaagcggcggctgtccgcggtgccggctgggggcggagaggcggcggtgggctccctggggtgtgtgagcccggtgatggagccgggcccgacagccgcgcagcggaggtgttcgttgccgccgtggctgccgctggggctgctgctgtggtcggggctggccctgggcgcgctccccttcggcagcagtccgcacagggtcttccacgacctcctgtcggagcagcagttgctggaggtggaggacttgtccctgtccctcctgcagggtggagggctggggcctctgtcgctgcccccggacctgccggatctggatcctgagtgccgggagctcctgctggacttcgccaacagcagcgcagagctgacagggtgtctggtgcgcagcgcccggcccgtgcgcctctgtcagacctgctaccccctcttccaacaggtcgtcagcaagatggacaacatcagccgagccgcggggaatacttcagagagtcagagttgtgccagaagtctcttaatggcagatagaatgcaaatagttgtgattctctcagaattttttaataccacatggcaggaggcaaattgtgcaaattgtttaacaaacaacagtgaagaattatcaaacagcacagtatatttccttaatctatttaatcacaccctgacctgctttgaacataaccttcaggggaatgcacatagtcttttacagacaaaaaattattcagaagtatgcaaaaactgccgtgaagcatacaaaactctgagtagtctgtacagtgaaatgcaaaaaatgaatgaacttgagaataaggctgaacctggaacacatttatgcattgatgtggaagatgcaatgaacatcactcgaaaactatggagtcgaactttcaactgttcagtcccttgcagtgacacagtgcctgtaattgctgtttctgtgttcattctctttctacctgttgtcttctaccttagtagctttcttcactcagagcaaaagaaacgcaaactcattctgcccaaacgtctcaagtccagtaccagttttgcaaatattcaggaaaattcaaactgagacctacaaaatggagaattgacatatcacgtgaatgaatggtggaagacacaacttggtttcagaaagaagataaactgtgatttgacaagtcaagctcttaagaaatacaaggacttcagatccatttttaaataagaattttcgatttttctttccttttccacttctttctaacagatttggatatttttaatttccaggcatagcaatgttatctattttaatgtgtatttgtcacaataacagaacatgcaagaacaatcattattttattttataggcatttgattactattctagacttctggtatcttcttactaacataaatatctcaagtagaaaagtttttgaaaactaacatttaaaaattaatcagttacagtaaagactttgaaaaagaaatgtacttgttaggaagtagcttaattaccccccattgcagtattattgttatatatatagttaatatgttgtacatcacaataatatataattcagtctctagtttccctagagtcatttttgaaaccactgattgcaaacctccctgacaatttttaaaagtagtaagccacattacatttatctttgtaaaaagatttatggtaactggtttcttacttgacttttataaatagtattttacatcttatttttgcctttatttcataagtaatttaaaaatcactggattgctttattatattcagggcaatatggattatttttataccaaggatttgcatcgtgaattacattaagttatttggcaatttataatttattactactttaaatcaaatgtagcattatcacactgtatttaaattgtcattttttaaaggaatattttcttcttaagatatatagaggattttggagaagagagacaggaggggtaaaaccagcttaaggttcagcgagcagaaagggacctgagaggatgctcactgtaagactgttggacagtggtgtgtattgaggggatgaatcggaacgatagtctcatgcagaaaatagtgagattaagatcatccttattgtttctaaattatttcaatcagatgaaagtgatacgattgaaatgaaatcacatagttcgtgctcagaaattctattttggtatgtttgtattagcctttagaaaaaacactccgtttcagaattgttcacagttttatttcttaggtttttagagttcaggatttcatttattaatttcttcttgcttttttggtggaaataggctttgttgtaaacattaagaatataaaatctcctctatatagaaacaagaattttgttaaaaagagaatttgaatcccttcctatactataaaatgctctatagggagacaaagtgtttcttttttcttttatgtttactgtttatgtggagtgaaatataaggctcttggatgtataacatactcaaaagctgttacactttctctgatctgctgtgatccactgaaaatgtgctggggtttgttctgctgtcactgtttatgctgctggaacttagcactgtcttgatttgaagcatatgattgagagccatttgaagcaatcttcattaatgcagataaaacaagtttacatgtgcagagttagaaaatgacatgttcaattctgtaagtggtgactttttgagcacctttcagtattatgtatttgtaaaaaccattgtttttggatataaagctaataagcactttaaaaaggaaaaggcagcctttactattttttctggttgagtcattgctctttagacctagcatcagcaatagatttcaaagataagtattaagcgctaccctaaagtgtgtaagtttttcattttgtcatattgaaaaatgatttgcatagtactgaatgttgacacacagcttatatgtatttacaagaatatctttaagtgtttttttgacacattaaaataaaggaaataaggaaattgtaagctttatttggatttttaaatacatttttaaaatttcagatgtaatttaacatcacatttgtttttcaggtattgagtttagatgcctacttttatgagtaccatcagctggacacagtgtctcatacctgtatttgcagcactttgggaggctgaagcagatcgctggagcttatgagttcgagaccagcctggacaacatagtgaaacactgtctctgcaaaaaatacaaaaattagctgggtatggtggtaagtgcctgtagtcctagctacttgggaggctgagatgggaggatgtcttgagcccgggaggtggaggttgcaatgagccaagattgtaccactgcattccaacctgggcgacagagccagaccttgtctcaaaaaaaaaaaaaaaaaaagaaaaaagaaagtactgtctgtcttaaattttgctgcaaataaaaatgtactttggattatttattgttgaacttgagagatagaaataacatcagatatattttttcttttttttttataattaattttttttttttttttttttgtagagacagtgtctcactatgttgcccaagctggtcttgaactcctgagttcaagagatcctcctgccttagcctcccaaagtgctgggattacaagcataagcaccacacctggctgaacatcagatattttaaagtgtagcccagagtctagttggtaaatgttacttatattgggactagtattttctaatgtttctgggatatgctccctataaaatgaaatgttttcctggaacaatgctaattaggattgcattcctggccaaagacatgacatcaaataagtaatagacatcaccagcaatgaattttgaaaagcaaaaaatactattaacctatataaccatttaaaatttaaaaaattatgttccaagtacctctattttctgagctagaagaaaccttagaggccatctgatgatagattcccagagctggatggatccctagggactacctaatctgactttctgtccactgcatggattcttctaaaaagtatgtcacttatttccctaccttattaagactaaataagtggaacatcatagagctctttatttataacagtcattctttgatagtcaactcttaaatggagacttgagatgcttaaatattgtactactgtgcttatcttgtaaagatttcataaaatgatagtattggttattttaaaaaggctttggcttatgctgaattatacatgtagcaccaaaatgttacaactctactaaatttccttgttctaaactattatattagctataataaatattagtcatacatgtaacatgtttaatgacaaataactttctttatctccttggaattaaagagggcttttaaaagataa

SEQ ID NO: 162886 - DNA, 724 bp, Homo sapiens
  Payload ID: 12091
  Gene Symbol: OSTM1
  Gene Name: osteopetrosis associated transmembrane protein 1
  ENST ID: ENST00000440575
  CDS Start-End: 207-724
tgggagtgtggctctgtgcgtgcgtgatgagtgccagatagattcgcggaagaaattgggtggctgtgtgctggcgtgtgattgtgcgcgccggacatggccatgtgagttggttcattcttggtccggtgccccttctgttgggtaaaacttggatctggcccgagaatacttcagagagtcagagttgtgccagaagtctcttaatggcagatagaatgcaaatagttgtgattctctcagaattttttaataccacatggcaggaggcaaattgtgcaaattgtttaacaaacaacagtgaagaattatcaaacagcacagtatatttccttaatctatttaatcacaccctgacctgctttgaacataaccttcaggggaatgcacatagtcttttacagacaaaaaattattcagaagtatgcaaaaactgccgtgaagcatacaaaactctgagtagtctgtacagtgaaatgcaaaaaatgaatgaacttgagaataaggctgaacctggaacacatttatgcattgatgtggaagatgcaatgaacatcactcgaaaactatggagtcgaactttcaactgttcagtcccttgcagtgacacagtgcctgtaattgctgtttctgtgttcattctctttctacctgttgtcttctaccttagtagctttcttcactcagagcaaaagaaacgcaaactcattctgcccaaacgtct

SEQ ID NO: 162887 - DNA, 2505 bp, Homo sapiens
  Payload ID: 12092
  Gene Symbol: OS9
  Gene Name: osteosarcoma amplified 9, endoplasmic reticulum lectin
  Uniprot ID: Q13438
  ENST ID: ENST00000257966
  CDS Start-End: 18-1859
aagaaggggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaagtcctctatctcggctactaccaatcagccttcgactgggatgatgaaacagccaaggcctccaagcagcatcgtcttaaacgctaccacagccagacctatggcaatgggtccaagtgcgaccttaatgggaggccccgggaggccgaggttcggttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccgtagactcaaagcagtatggagataaaatcatagaggagctgcaagatctaggcccccaagtgtggagtgagaccaagtctggggtggcaccccaaaagatggcaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggaggtgaaggctggcatggagcgggaactggaaaacatcatccaggagacagagaaagagctggacccagatgggctgaagaaggagtcagagcgggatcgggcaatgctggctctcacatccactctcaacaaactcatcaaaagactggaggaaaaacagagtccagagctggtgaagaagcacaagaaaaagagggttgtccccaaaaagcctcccccatcaccccaacctacagggaaaattgagatcaaaattgtccgcccatgggctgaagggactgaagagggtgcacgttggctgactgatgaggacacgagaaacctcaaggagatcttcttcaatatcttggtgccgggagctgaagaggcccagaaggaacgccagcggcagaaagagctggagagcaattaccgccgggtgtggggctctccaggtggggagggcacaggggacctggacgaatttgacttctgagaccaacactacacttgacccttcacggaatccagactcttcctggactggcttgcctcctccccacctccccaccctggaacccctgagggccaaacagcagagtggagctgagctgtggacctctcgggcaactctgtgggtgtgggggccctgggtgaatgctgctgcccctgctggcagccaccttgagacctcaccgggcctgtgatatttgctctcctgaactctcactcaatcctcttcctctcctctgtggcttttcctgttattgtcccctaatgataggatattccctgctgcctacctggagattcagtaggatcttttgagtggaggtgggtagagagagcaaggagggcaggacacttagcaggcactgagcaagcaggcccccacctgcccttagtgatgtttggagtcgttttaccctcttctattgaattgccttgggatttccttctccctttccctgcccaccctgtcccctacaatttgtgcttctgagttgaggagccttcacctctgttgctgaggaaatggtagaatgctgcctatcacctccagcacaatcccagtgaaaaaggtgtgaagcacccaccatgttcttgaacaatcaggtttctaaataaacaactggaccatc

SEQ ID NO: 162888 - DNA, 2691 bp, Homo sapiens
  Payload ID: 12092
  Gene Symbol: OS9
  Gene Name: osteosarcoma amplified 9, endoplasmic reticulum lectin
  Uniprot ID: Q13438
  ENST ID: ENST00000315970
  CDS Start-End: 42-2045
agggcggaaacagattctctgcataagaaggggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaagtcctctatctcggctactaccaatcagccttcgactgggatgatgaaacagccaaggcctccaagcagcatcgtcttaaacgctaccacagccagacctatggcaatgggtccaagtgcgaccttaatgggaggccccgggaggccgaggttcggttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccgactcaaagcagtatggagataaaatcatagaggagctgcaagatctaggcccccaagtgtggagtgagaccaagtctggggtggcaccccaaaagatggcaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggaggtgaaggctggcatggagcgggaactggaaaacatcatccaggagacagagaaagagctggacccagatgggctgaagaaggagtcagagcgggatcgggcaatgctggctctcacatccactctcaacaaactcatcaaaagactggaggaaaaacagagtccagagctggtgaagaagcacaagaaaaagagggttgtccccaaaaagcctcccccatcaccccaacctacagaggaggatcctgagcacagagtccgggtccgggtcaccaagctccgtctcggaggccctaatcaggatctgactgtcctcgagatgaaacgggaaaacccacagctgaaacaaatcgaggggctggtgaaggagctgctggagagggagggactcacagctgcagggaaaattgagatcaaaattgtccgcccatgggctgaagggactgaagagggtgcacgttggctgactgatgaggacacgagaaacctcaaggagatcttcttcaatatcttggtgccgggagctgaagaggcccagaaggaacgccagcggcagaaagagctggagagcaattaccgccgggtgtggggctctccaggtggggagggcacaggggacctggacgaatttgacttctgagaccaacactacacttgacccttcacggaatccagactcttcctggactggcttgcctcctccccacctccccaccctggaacccctgagggccaaacagcagagtggagctgagctgtggacctctcgggcaactctgtgggtgtgggggccctgggtgaatgctgctgcccctgctggcagccaccttgagacctcaccgggcctgtgatatttgctctcctgaactctcactcaatcctcttcctctcctctgtggcttttcctgttattgtcccctaatgataggatattccctgctgcctacctggagattcagtaggatcttttgagtggaggtgggtagagagagcaaggagggcaggacacttagcaggcactgagcaagcaggcccccacctgcccttagtgatgtttggagtcgttttaccctcttctattgaattgccttgggatttccttctccctttccctgcccaccctgtcccctacaatttgtgcttctgagttgaggagccttcacctctgttgctgaggaaatggtagaatgctgcctatcacctccagcacaatcccagtgaaaaaggtgtgaagcacccaccatgttcttgaacaatcaggtttctaaataaacaactggaccatc

SEQ ID NO: 162889 - DNA, 2457 bp, Homo sapiens
  Payload ID: 12092
  Gene Symbol: OS9
  Gene Name: osteosarcoma amplified 9, endoplasmic reticulum lectin
  Uniprot ID: Q13438
  ENST ID: ENST00000389142
  CDS Start-End: 16-1809
gaaggggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaagtcctctatctcggctactaccaatcagccttcgactgggatgatgaaacagccaaggcctccaagcagcatcgtcttaaacgctaccacagccagacctatggcaatgggtccaagtgcgaccttaatgggaggccccgggaggccgaggttcggttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccgactcaaagcagtatggagataaaatcatagaggagctgcaagatctaggcccccaagtgtggagtgagaccaagtctggggtggcaccccaaaagatggcaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggagacagagaaagagctggacccagatgggctgaagaaggagtcagagcgggatcgggcaatgctggctctcacatccactctcaacaaactcatcaaaagactggaggaaaaacagagtccagagctggtgaagaagcacaagaaaaagagggttgtccccaaaaagcctcccccatcaccccaacctacagggaaaattgagatcaaaattgtccgcccatgggctgaagggactgaagagggtgcacgttggctgactgatgaggacacgagaaacctcaaggagatcttcttcaatatcttggtgccgggagctgaagaggcccagaaggaacgccagcggcagaaagagctggagagcaattaccgccgggtgtggggctctccaggtggggagggcacaggggacctggacgaatttgacttctgagaccaacactacacttgacccttcacggaatccagactcttcctggactggcttgcctcctccccacctccccaccctggaacccctgagggccaaacagcagagtggagctgagctgtggacctctcgggcaactctgtgggtgtgggggccctgggtgaatgctgctgcccctgctggcagccaccttgagacctcaccgggcctgtgatatttgctctcctgaactctcactcaatcctcttcctctcctctgtggcttttcctgttattgtcccctaatgataggatattccctgctgcctacctggagattcagtaggatcttttgagtggaggtgggtagagagagcaaggagggcaggacacttagcaggcactgagcaagcaggcccccacctgcccttagtgatgtttggagtcgttttaccctcttctattgaattgccttgggatttccttctccctttccctgcccaccctgtcccctacaatttgtgcttctgagttgaggagccttcacctctgttgctgaggaaatggtagaatgctgcctatcacctccagcacaatcccagtgaaaaaggtgtgaagcacccaccatgttcttgaacaatcaggtttctaaataaacaactggaccatcaa

SEQ ID NO: 162890 - DNA, 2091 bp, Homo sapiens
  Payload ID: 12092
  Gene Symbol: OS9
  Gene Name: osteosarcoma amplified 9, endoplasmic reticulum lectin
  Uniprot ID: Q13438
  ENST ID: ENST00000389146
  CDS Start-End: 18-1976
aagaaggggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaagtcctctatctcggctactaccaatcagccttcgactgggatgatgaaacagccaaggcctccaagcagcatcgtcttaaacgctaccacagccagacctatggcaatgggtccaagtgcgaccttaatgggaggccccgggaggccgaggttcggttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccgactcaaagcagtatggagataaaatcatagaggagctgcaagatctaggcccccaagtgtggagtgagaccaagtctggggtggcaccccaaaagatggcaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggagacagagaaagagctggacccagatgggctgaagaaggagtcagagcgggatcgggcaatgctggctctcacatccactctcaacaaactcatcaaaagactggaggaaaaacagagtccagagctggtgaagaagcacaagaaaaagagggttgtccccaaaaagcctcccccatcaccccaacctacagaggaggatcctgagcacagagtccgggtccgggtcaccaagctccgtctcggaggccctaatcaggatctgactgtcctcgagatgaaacgggaaaacccacagctgaaacaaatcgaggggctggtgaaggagctgctggagagggagggactcacagctgcagggaaaattgagatcaaaattgtccgcccatgggctgaagggactgaagagggtgcacgttggctgactgatgaggacacgagaaacctcaaggagatcttcttcaatatcttggtgccgggagctgaagaggcccagaaggaacgccagcggcagaaagagctggagagcaattaccgccgggtgtggggctctccaggtggggagggcacaggggacctggacgaatttgacttctgagaccaacactacacttgacccttcacggaatccagactcttcctggactggcttgcctcctccccacctccccaccctggaacccctgagggccaaacagcagagtggagctgag

SEQ ID NO: 162891 - DNA, 2346 bp, Homo sapiens
  Payload ID: 12092
  Gene Symbol: OS9
  Gene Name: osteosarcoma amplified 9, endoplasmic reticulum lectin
  Uniprot ID: Q13438
  ENST ID: ENST00000435406
  CDS Start-End: 18-1700
aagaaggggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaattcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccgactcaaagcagtatggagataaaatcatagaggagctgcaagatctaggcccccaagtgtggagtgagaccaagtctggggtggcaccccaaaagatggcaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggaggtgaaggctggcatggagcgggaactggaaaacatcatccaggagacagagaaagagctggacccagatgggctgaagaaggagtcagagcgggatcgggcaatgctggctctcacatccactctcaacaaactcatcaaaagactggaggaaaaacagagtccagagctggtgaagaagcacaagaaaaagagggttgtccccaaaaagcctcccccatcaccccaacctacagggaaaattgagatcaaaattgtccgcccatgggctgaagggactgaagagggtgcacgttggctgactgatgaggacacgagaaacctcaaggagatcttcttcaatatcttggtgccgggagctgaagaggcccagaaggaacgccagcggcagaaagagctggagagcaattaccgccgggtgtggggctctccaggtggggagggcacaggggacctggacgaatttgacttctgagaccaacactacacttgacccttcacggaatccagactcttcctggactggcttgcctcctccccacctccccaccctggaacccctgagggccaaacagcagagtggagctgagctgtggacctctcgggcaactctgtgggtgtgggggccctgggtgaatgctgctgcccctgctggcagccaccttgagacctcaccgggcctgtgatatttgctctcctgaactctcactcaatcctcttcctctcctctgtggcttttcctgttattgtcccctaatgataggatattccctgctgcctacctggagattcagtaggatcttttgagtggaggtgggtagagagagcaaggagggcaggacacttagcaggcactgagcaagcaggcccccacctgcccttagtgatgtttggagtcgttttaccctcttctattgaattgccttgggatttccttctccctttccctgcccaccctgtcccctacaatttgtgcttctgagttgaggagccttcacctctgttgctgaggaaatggtagaatgctgcctatcacctccagcacaatcccagtgaaaaaggtgtgaagcacccaccatgttcttgaacaatcaggtttctaaataaacaactggaccatc

SEQ ID NO: 162892 - DNA, 1946 bp, Homo sapiens
  Payload ID: 12092
  Gene Symbol: OS9
  Gene Name: osteosarcoma amplified 9, endoplasmic reticulum lectin
  Uniprot ID: Q13438
  ENST ID: ENST00000439210
  CDS Start-End: 20-1636
ataagaaggggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagacaaaggactggtggacatatgaattctgttatggacgccacatccagcaataccacatggaagattcagagatcaaaggtgaagtcctctatctcggctactaccaatcagccttcgactgggatgatgaaacagccaaggcctccaagcagcatcgtcttaaacgctaccacagccagacctatggcaatgggtccaagtgcgaccttaatgggaggccccgggaggccgaggttcggttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccgactcaaagcagtatggagataaaatcatagaggagctgcaagatctaggcccccaagtgtggagtgagaccaagtctggggtggcaccccaaaagatggcaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggagacagagaaagagctggacccagatgggctgaagaaggagtcagagcgggatcgggcaatgctggctctcacatccactctcaacaaactcatcaaaagactggaggaaaaacagagtccagagctggtgaagaagcacaagaaaaagagggttgtccccaaaaagcctcccccatcaccccaacctacagggaaaattgagatcaaaattgtccgcccatgggctgaagggactgaagagggtgcacgttggctgactgatgaggacacgagaaacctcaaggagatcttcttcaatatcttggtgccgggagctgaagaggcccagaaggaacgccagcggcagaaagagctggagagcaattaccgccgggtgtggggctctccaggtggggagggcacaggggacctggacgaatttgacttctgagaccaacactacacttgacccttcacggaatccagactcttcctggactggcttgcctcctccccacctccccaccctggaacccctgagggccaaacagcagagtggagctgagctgtggacctctcgggcaactctgtgggtgtgggggccctgggtgaatgctgctgcccctgctggcagccaccttgagacctcaccgggcctgtgatatttgctctcctgaactctcactcaatcctcttcctctcctctgtggcttttcctgttattgtcccctaatgataggatattccctgctgcctacctg

SEQ ID NO: 162893 - DNA, 1660 bp, Homo sapiens
  Payload ID: 12092
  Gene Symbol: OS9
  Gene Name: osteosarcoma amplified 9, endoplasmic reticulum lectin
  ENST ID: ENST00000413095
  CDS Start-End: 18-1238
aagaaggggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggaggtgaaggctggcatggagcgggaactggaaaacatcatccaggagacagagaaagagctggacccagatgggctgaagaaggagtcagagcgggatcgggcaatgctggctctcacatccactctcaacaaactcatcaaaagactggaggaaaaacagagtccagagctggtgaagaagcacaagaaaaagagggttgtccccaaaaagcctcccccatcaccccaacctacagggaaaattgagatcaaaattgtccgcccatgggctgaagggactgaagagggtgcacgttggctgactgatgaggacacgagaaacctcaaggagatcttcttcaatatcttggtgccgggagctgaagaggcccagaaggaacgccagcggcagaaagagctggagagcaattaccgccgggtgtggggctctccaggtggggagggcacaggggacctggacgaatttgacttctgagaccaacactacacttgacccttcacggaatccagactcttcctggactggcttgcctcctccccacctccccaccctggaacccctgagggccaaacagcagagtggagctgagctgtggacctctcgggcaactctgtgggtgtgggggccctgggtgaatgctgctgcccctgctggcagccaccttgagacctcaccgggcctgtgatatttgctctcctgaactctcactcaatcctcttcctctcctctgtggcttttcctgttattgtcccctaatgataggatattccctgctgcctacctggagattcagtaggatcttttgagtggaggtgggtagagagagcaaggagggcaggacacttagcaggcactgagcaagcaggcccccacctgcccttagtgatgtttggagt

SEQ ID NO: 162894 - DNA, 583 bp, Homo sapiens
  Payload ID: 12092
  Gene Symbol: OS9
  Gene Name: osteosarcoma amplified 9, endoplasmic reticulum lectin
  ENST ID: ENST00000547079
  CDS Start-End: 26-583
ctctgcataagaaggggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagggatcctgcttccgtcagaccgagaccggctccgttcggaggtgaaggctggcatggagcgggaactggaaaacatcatccaggagacagagaaagagctggacccagatgggctgaagaaggagtcagagcgggatcgggcaatgctggctctc

SEQ ID NO: 162895 - DNA, 609 bp, Homo sapiens
  Payload ID: 12092
  Gene Symbol: OS9
  Gene Name: osteosarcoma amplified 9, endoplasmic reticulum lectin
  ENST ID: ENST00000552423
  CDS Start-End: 3-380
agatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagggaggaatggaaagaccacaagtggaaaacagactttagagatatctctccaagtcacagaaggaaagcagccctccctccttactgaaagtctggagaattgagagtggaagtgaagggaagagaattgagtgtacaaaggactggtggacatatgaattctgttatggacgccacatccagcaataccacatggaagattcagagatcaaaggtgaagtcctctatctcggctactaccaatcagccttcgactgggatgatgaaa

SEQ ID NO: 162896 - DNA, 962 bp, Homo sapiens
  Payload ID: 12092
  Gene Symbol: OS9
  Gene Name: osteosarcoma amplified 9, endoplasmic reticulum lectin
  ENST ID: ENST00000552787
  CDS Start-End: 24-464
ctgcataagaaggggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggcctccaagcagcatcgtcttaaacgctaccacagccagacctatggcaatgggtccaagtgcgaccttaatgggaggccccgggaggccgaggttcggttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccggtgagtaattagagaaggaggagaagacggggagatacgggggcagggggtggcaaaagatcaagtattgaatagctggaggaatgtgttcctggcctgcttgcatgctgtttctcagtagactcaaagcagtatggagataaaatcatagaggagctgcaagatctaggcccccaagtgtggagtgagaccaagtctggggtggcacccc

SEQ ID NO: 162897 - DNA, 503 bp, Homo sapiens
  Payload ID: 12092
  Gene Symbol: OS9
  Gene Name: osteosarcoma amplified 9, endoplasmic reticulum lectin
  ENST ID: ENST00000550372
  CDS Start-End: 17-503
agaaggggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacctatggcaatgggtccaagtgcgaccttaatgggaggccccgggaggccgaggttcggttcctctgtgacgagggtgcaggtatctctggggactacatcgatcgcgtggacgagcccttgtcctgctcttatgtgctgaccattc

SEQ ID NO: 162898 - DNA, 2246 bp, Homo sapiens
  Payload ID: 12092
  Gene Symbol: OS9
  Gene Name: osteosarcoma amplified 9, endoplasmic reticulum lectin
  Uniprot ID: Q13438
  ENST ID: ENST00000551035
  CDS Start-End: 18-1760
aagaaggggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaagtcctctatctcggctactaccaatcagccttcgactgggatgatgaaacagccaagttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccgtagactcaaagcagtatggagataaaatcatagaggagctgcaagatctaggcccccaagtgtggagtgagaccaagtctggggtggcaccccaaaagatggcaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggaggtgaaggctggcatggagcgggaactggaaaacatcatccaggagacagagaaagagctggacccagatgggctgaagaaggagtcagagcgggatcgggcaatgctggctctcacatccactctcaacaaactcatcaaaagactggaggaaaaacagagtccagagctggtgaagaagcacaagaaaaagagggttgtccccaaaaagcctcccccatcaccccaacctacagggaaaattgagatcaaaattgtccgcccatgggctgaagggactgaagagggtgcacgttggctgactgatgaggacacgagaaacctcaaggagatcttcttcaatatcttggtgccgggagctgaagaggcccagaaggaacgccagcggcagaaagagctggagagcaattaccgccgggtgtggggctctccaggtggggagggcacaggggacctggacgaatttgacttctgagaccaacactacacttgacccttcacggaatccagactcttcctggactggcttgcctcctccccacctccccaccctggaacccctgagggccaaacagcagagtggagctgagctgtggacctctcgggcaactctgtgggtgtgggggccctgggtgaatgctgctgcccctgctggcagccaccttgagacctcaccgggcctgtgatatttgctctcctgaactctcactcaatcctcttcctctcctctgtggcttttcctgttattgtcccctaatgataggatattccctgctgcctacctggagattcagtaggatcttttgagtggaggtgggtagagagagcaaggagggcaggacacttagcaggcactgagcaagcaggcccccacctgcccttagtgatgtttggagtcgttttaccctcttctattgaattgccttgggatttccttctccctttccctgcccaccctgtc

SEQ ID NO: 162899 - DNA, 558 bp, Homo sapiens
  Payload ID: 12092
  Gene Symbol: OS9
  Gene Name: osteosarcoma amplified 9, endoplasmic reticulum lectin
  ENST ID: ENST00000550848
  CDS Start-End: 31-258
agattctctgcataagaaggggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagcctttctttgcttccttgccccccgaccctcccttctttcccagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaagtcctctatctcggctactaccaatcagccttcgactgggatgatgaaacagccaaggcct

SEQ ID NO: 162900 - DNA, 583 bp, Homo sapiens
  Payload ID: 12092
  Gene Symbol: OS9
  Gene Name: osteosarcoma amplified 9, endoplasmic reticulum lectin
  ENST ID: ENST00000551285
  CDS Start-End: 20-247
ataagaaggggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagcctttctttgcttccttgccccccgaccctcccttctttcccagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaagtcctctatctcggctactaccaatcagccttcgactgggatgatgaaacagccaaggtggcaagagtgtgggattcaggaagaaagggttctggcc

SEQ ID NO: 162901 - DNA, 2135 bp, Homo sapiens
  Payload ID: 12092
  Gene Symbol: OS9
  Gene Name: osteosarcoma amplified 9, endoplasmic reticulum lectin
  Uniprot ID: Q13438
  ENST ID: ENST00000552285
  CDS Start-End: 208-2046
ctgaccaatcacggacagcgattgatatttctaatcgtcgtgatccacctccccaggaccttggagccacgtttacaaataggaatagggtacgtgggagggatagaacgtacagccaataaaatcatgtggcgccgatgggcgtgttgaggccgctgcctggcttagggcggaaacagattctctgcataagaaggggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaagtcctctatctcggctactaccaatcagccttcgactgggatgatgaaacagccaaggcctccaagcagcatcgtcttaaacgctaccacagccagacctatggcaatgggtccaagtgcgaccttaatgggaggccccgggaggccgaggttcggttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccgactcaaagcagtatggagataaaatcatagaggagctgcaagatctaggcccccaagtgtggagtgagaccaagtctggggtggcaccccaaaagatggcaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggaggtgaaggctggcatggagcgggaactggaaaacatcatccaggagacagagaaagagctggacccagatgggctgaagaaggagtcagagcgggatcgggcaatgctggctctcacatccactctcaacaaactcatcaaaagactggaggaaaaacagagtccagagctggtgaagaagcacaagaaaaagagggttgtccccaaaaagcctcccccatcaccccaacctacagggaaaattgagatcaaaattgtccgcccatgggctgaagggactgaagagggtgcacgttggctgactgatgaggacacgagaaacctcaaggagatcttcttcaatatcttggtgccgggagctgaagaggcccagaaggaacgccagcggcagaaagagctggagagcaattaccgccgggtgtggggctctccaggtggggagggcacaggggacctggacgaatttgacttctgagaccaacactacacttgacccttcacggaatccagactcttcctggactggcttgcctcctccccacctccccaccctggaacccctga

SEQ ID NO: 162902 - DNA, 3471 bp, Homo sapiens
  Payload ID: 12093
  Gene Symbol: OTOA
  Gene Name: otoancorin
  Uniprot ID: Q7RTW8
  ENST ID: ENST00000286149
  CDS Start-End: 2-3463
aatgtctcaggaacctacgacatactcccttttcctattcctttttctgagccatggagtgtcgagttatacagtgccaaattccaggcaggatttgcatccattgttgcaaaacatggcggaagaaataatagatggaagctatctgaatgcactgctggatctcatacagtttcaaagctcccacgtgtggacggatgacctgtcccacagagtcctggcctatctgaattcccggaatgttgccttcaccatccccagcctgcaggcagccgtggaaaaccacctggagcagcgtctgcaccagccccagaagctgctggaggacctgaggaagacagacgcccagcagttccgcactgccatgaaatgcctcttagaagacaagaaggacggcttggacctgaaagacatcatcatcgacttaggagagattcgagaacgagccttgcagagccctggcgtgaaccgcagcctgtttctcatcacactggagaggtgtttccagatgctgaactccctggagtgtgtggagatcctgggcaaggtgctgagggggtcctcagggagctttctccagccagacatcacagagcggctccctcgggacctgcgcgaggatgcctttaagaacctatctgcagtgttcaaagatctctacgacaaaacctcggctcattcccagagagctctctattcctggatgactggaatactgcagacatcctccaatgccactgatgactctgcttcatgggtcagtgcggaacacttatgggttttgggcagatacatggttcacctatcgtttgaagaaattacgaaaattagtcctatagaaattgggctgtttatcagctatgacaacgccaccaagcagctggacatggtctatgacatcacacctgagctggcccaggcgtttctggagaggatcagctcctccaactttaacatgaggaatacctccaccatccacaggcaagcgcatgagctctgggccttggagccctttcccaagatgctggggctgctggtttgtttctacaatgacctggaattgctggatgccactgtggctcaagtcctgctttaccagatgatcaagtgcagccacctgaggggcttccaggctggcgtccagaagctcaaagcagaactcctggacattgccatggagaaccagaccctcaatgagaccctgggttctttgtcggatgcagttgtaggtttgacctacagccaactggaatccctctcccccgaggctgtgcacggagccatctccaccctcaaccaggtctcaggttgggccaagagccaggtcatcatcttgtctgccaaatacttggcccatgagaaggtgctgtctttctacaatgtcagccagatgggcgcactgctggctggggtcagcacccaggccttctgcagcatgaaacgcaaggacatctcgcaggtcctgagaagtgccgtctcccagtatgtatccgacttgtcacctgcccagcagcaaggtatcctcagcaagatggtccaagcggaagacactgccccaggcatcgtggagatacaaggggctttctttaaggaagtgtctctctttgatttaaggaggcaacctggattcaactctacagtcctgaaggataaggaacttggaaggagccaggctctgttcctgtatgagcttctgttaaagaccaccagaaggcctgaggagcttttgagtgctgggcagctggtcaaaggcgtgacctgctcacacattgatgccatgagcactgacttctttctggcccatttccaggattttcagaacaacttcgccctgctttcaccctatcaggttaattgtttggcgtggaaatactgggaagtttccagattgtctatgccacctttcctcttggctgcactcccggcccgctacctggcttctgtcccagcctcccagtgtgtgccctttctgatcagcctggggaagagctggttggactccttggttttagattcccacaaaaagacttcagtcctcaggaaagtgcagcagtgcctggacgactccattgctgatgagtacactgtggacatcatggggaacctgctgtgtcacttgccggcagccatcatcgacagggggatctcccccagggcttgggcgactgctctacacggcctcagagactgcccagacctcaaccctgagcaaaaggctgcagtgaggctcaagctcctgggacagtatggactccctcagcactggacagccgagaccacgaaggacttgggaccctttctagtacttttctcaggagatgaattaagctctatagccacaaagtttcctgagatccttctgcaagcagcttccaagatggccaggaccctgcccactaaagaattcctctgggctgtctttcagtctgttcggaacagcagtgataagatccccagctatgaccctatgcctggttgccatggagtcgtggccccctcttctgatgacatcttcaagttggccgaagccaacgcctgctgggccctggaggacctgcggtgcatggaggaagacacattcatcaggaccgtggaactgctgggagctgtccagggtttcagccggcctcagctgatgaccctgaaggagaaagcaatacaggtttgggacatgccatcttactggagagaacaccatatcgtctccctggggcgcattgctctggctcttaatgagagtgagctggagcagctggacctcagctccatagacactgtggcttccctaagctggcaaacagaatggaccccgggacaggctgaatccattttgcaagggtacctggatgattcaggatacagtatccaggacctgaagagctttcatttggtaggacttggtgcaaccctgtgtgctataaacatcactgaaatcccacttataaagatctcagaattcagggtggtagtggccagaattgggaccctgctctgcagcacacatgtcttagccgagtttaagaggaaggctgaagttgtgtttggggatcccactgagtggaccagttctgtcttgcaggagcttgggaccattgcagctggattaactaaggcagagctccggatgcttgacaaggatttgatgccatatttccagccatcagcaataaaatgccttcctgatgagatattcaaagagctgtccgcggagcagatcgcctccctgggtccggagaacgccgcggcggtgacccacgcccagcgccggcggctcagtccactgcagctgcagagcctccagcaggcgctagatggcgccaagactcactcctggcaggacgcgcccgctagcgccggtcccactagaacctcatcctcgcgttctcccgcaggagctctccagtcgtggggtctttggcttggttgtcccctgctggttctaatggccaagctcctgtggtgagtggcctg

SEQ ID NO: 162903 - DNA, 3466 bp, Homo sapiens
  Payload ID: 12093
  Gene Symbol: OTOA
  Gene Name: otoancorin
  Uniprot ID: Q7RTW8
  ENST ID: ENST00000388956
  CDS Start-End: 95-3277
ttcgcctgtattttgctcctgcgctggtagcttgggtttgggcacagtgccatctggggttctaaacttcctggacaaaggccagctgctgctgatgggaaactcaatcacctacagggaccaggcagccgtggaaaaccacctggagcagcgtctgcaccagccccagaagctgctggaggacctgaggaagacagacgcccagcagttccgcactgccatgaaatgcctcttagaagacaagaaggacggcttggacctgaaagacatcatcatcgacttaggagagattcgagaacgagccttgcagagccctggcgtgaaccgcagcctgtttctcatcacactggagaggtgtttccagatgctgaactccctggagtgtgtggagatcctgggcaaggtgctgagggggtcctcagggagctttctccagccagacatcacagagcggctccctcgggacctgcgcgaggatgcctttaagaacctatctgcagtgttcaaagatctctacgacaaaacctcggctcattcccagagagctctctattcctggatgactggaatactgcagacatcctccaatgccactgatgactctgcttcatgggtcagtgcggaacacttatgggttttgggcagatacatggttcacctatcgtttgaagaaattacgaaaattagtcctatagaaattgggctgtttatcagctatgacaacgccaccaagcagctggacatggtctatgacatcacacctgagctggcccaggcgtttctggagaggatcagctcctccaactttaacatgaggaatacctccaccatccacaggctggggctgctggtttgtttctacaatgacctggaattgctggatgccactgtggctcaagtcctgctttaccagatgatcaagtgcagccacctgaggggcttccaggctggcgtccagaagctcaaagcagaactcctggacattgccatggagaaccagaccctcaatgagaccctgggttctttgtcggatgcagttgtaggtttgacctacagccaactggaatccctctcccccgaggctgtgcacggagccatctccaccctcaaccaggtctcaggttgggccaagagccaggtcatcatcttgtctgccaaatacttggcccatgagaaggtgctgtctttctacaatgtcagccagatgggcgcactgctggctggggtcagcacccaggccttctgcagcatgaaacgcaaggacatctcgcaggtcctgagaagtgccgtctcccagtatgtatccgacttgtcacctgcccagcagcaaggtatcctcagcaagatggtccaagcggaagacactgccccaggcatcgtggagatacaaggggctttctttaaggaagtgtctctctttgatttaaggaggcaacctggattcaactctacagtcctgaaggataaggaacttggaaggagccaggctctgttcctgtatgagcttctgttaaagaccaccagaaggcctgaggagcttttgagtgctgggcagctggtcaaaggcgtgacctgctcacacattgatgccatgagcactgacttctttctggcccatttccaggattttcagaacaacttcgccctgctttcaccctatcaggttaattgtttggcgtggaaatactgggaagtttccagattgtctatgccacctttcctcttggctgcactcccggcccgctacctggcttctgtcccagcctcccagtgtgtgccctttctgatcagcctggggaagagctggttggactccttggttttagattcccacaaaaagacttcagtcctcaggaaagtgcagcagtgcctggacgactccattgctgatgagtacactgtggacatcatggggaacctgctgtgtcacttgccggcagccatcatcgacagggggatctcccccagggcttgggcgactgctctacacggcctcagagactgcccagacctcaaccctgagcaaaaggctgcagtgaggctcaagctcctgggacagtatggactccctcagcactggacagccgagaccacgaaggacttgggaccctttctagtacttttctcaggagatgaattaagctctatagccacaaagtttcctgagatccttctgcaagcagcttccaagatggccaggaccctgcccactaaagaattcctctgggctgtctttcagtctgttcggaacagcagtgataagatccccagctatgaccctatgcctggttgccatggagtcgtggccccctcttctgatgacatcttcaagttggccgaagccaacgcctgctgggccctggaggacctgcggtgcatggaggaagacacattcatcaggaccgtggaactgctgggagctgtccagggtttcagccggcctcagctgatgaccctgaaggagaaagcaatacaggtttgggacatgccatcttactggagagaacaccatatcgtctccctggggcgcattgctctggctcttaatgagagtgagctggagcagctggacctcagctccatagacactgtggcttccctaagctggcaaacagaatggaccccgggacaggctgaatccattttgcaagggtacctggatgattcaggatacagtatccaggacctgaagagctttcatttggtaggacttggtgcaaccctgtgtgctataaacatcactgaaatcccacttataaagatctcagaattcagggtggtagtggccagaattgggaccctgctctgcagcacacatgtcttagccgagtttaagaggaaggctgaagttgtgtttggggatcccactgagtggaccagttctgtcttgcaggagcttgggaccattgcagctggattaactaaggcagagctccggatgcttgacaaggatttgatgccatatttccagccatcagcaataaaatgccttcctgatgagatattcaaagagctgtccgcggagcagatcgcctccctgggtccggagaacgccgcggcggtgacccacgcccagcgccggcggctcagtccactgcagctgcagagcctccagcaggcgctagatggcgccaagactcactcctggcaggacgcgcccgctagcgccggtcccactagaacctcatcctcgcgttctcccgcaggagctctccagtcgtggggtctttggcttggttgtcccctgctggttctaatggccaagctcctgtggtgagtggcctgagcgcatcgtcctgtgttgccccaagcagctggccaacatgtgtagagacaggatgctccagatggtgggacacccttccctggatccagaccctcatctagggcagggaaaccctggggccttgatggtgaaaatgcaccccaaatgaaaaataattattaaaaatgatcttgcaaatta

SEQ ID NO: 162904 - DNA, 2703 bp, Homo sapiens
  Payload ID: 12093
  Gene Symbol: OTOA
  Gene Name: otoancorin
  Uniprot ID: Q7RTW8
  ENST ID: ENST00000388957
  CDS Start-End: 68-2515
ccccattccttggtctcgtctgagcagttaggttccgcctgtggttgcacatttggttcatctgaggatgttcaggctggggctgctggtttgtttctacaatgacctggaattgctggatgccactgtggctcaagtcctgctttaccagatgatcaagtgcagccacctgaggggcttccaggctggcgtccagaagctcaaagcagaactcctggacattgccatggagaaccagaccctcaatgagaccctgggttctttgtcggatgcagttgtaggtttgacctacagccaactggaatccctctcccccgaggctgtgcacggagccatctccaccctcaaccaggtctcaggttgggccaagagccaggtcatcatcttgtctgccaaatacttggcccatgagaaggtgctgtctttctacaatgtcagccagatgggcgcactgctggctggggtcagcacccaggccttctgcagcatgaaacgcaaggacatctcgcaggtcctgagaagtgccgtctcccagtatgtatccgacttgtcacctgcccagcagcaaggtatcctcagcaagatggtccaagcggaagacactgccccaggcatcgtggagatacaaggggctttctttaaggaagtgtctctctttgatttaaggaggcaacctggattcaactctacagtcctgaaggataaggaacttggaaggagccaggctctgttcctgtatgagcttctgttaaagaccaccagaaggcctgaggagcttttgagtgctgggcagctggtcaaaggcgtgacctgctcacacattgatgccatgagcactgacttctttctggcccatttccaggattttcagaacaacttcgccctgctttcaccctatcaggttaattgtttggcgtggaaatactgggaagtttccagattgtctatgccacctttcctcttggctgcactcccggcccgctacctggcttctgtcccagcctcccagtgtgtgccctttctgatcagcctggggaagagctggttggactccttggttttagattcccacaaaaagacttcagtcctcaggaaagtgcagcagtgcctggacgactccattgctgatgagtacactgtggacatcatggggaacctgctgtgtcacttgccggcagccatcatcgacagggggatctcccccagggcttgggcgactgctctacacggcctcagagactgcccagacctcaaccctgagcaaaaggctgcagtgaggctcaagctcctgggacagtatggactccctcagcactggacagccgagaccacgaaggacttgggaccctttctagtacttttctcaggagatgaattaagctctatagccacaaagtttcctgagatccttctgcaagcagcttccaagatggccaggaccctgcccactaaagaattcctctgggctgtctttcagtctgttcggaacagcagtgataagatccccagctatgaccctatgcctggttgccatggagtcgtggccccctcttctgatgacatcttcaagttggccgaagccaacgcctgctgggccctggaggacctgcggtgcatggaggaagacacattcatcaggaccgtggaactgctgggagctgtccagggtttcagccggcctcagctgatgaccctgaaggagaaagcaatacaggtttgggacatgccatcttactggagagaacaccatatcgtctccctggggcgcattgctctggctcttaatgagagtgagctggagcagctggacctcagctccatagacactgtggcttccctaagctggcaaacagaatggaccccgggacaggctgaatccattttgcaagggtacctggatgattcaggatacagtatccaggacctgaagagctttcatttggtaggacttggtgcaaccctgtgtgctataaacatcactgaaatcccacttataaagatctcagaattcagggtggtagtggccagaattgggaccctgctctgcagcacacatgtcttagccgagtttaagaggaaggctgaagttgtgtttggggatcccactgagtggaccagttctgtcttgcaggagcttgggaccattgcagctggattaactaaggcagagctccggatgcttgacaaggatttgatgccatatttccagccatcagcaataaaatgccttcctgatgagatattcaaagagctgtccgcggagcagatcgcctccctgggtccggagaacgccgcggcggtgacccacgcccagcgccggcggctcagtccactgcagctgcagagcctccagcaggcgctagatggcgccaagactcactcctggcaggacgcgcccgctagcgccggtcccactagaacctcatcctcgcgttctcccgcaggagctctccagtcgtggggtctttggcttggttgtcccctgctggttctaatggccaagctcctgtggtgagtggcctgagcgcatcgtcctgtgttgccccaagcagctggccaacatgtgtagagacaggatgctccagatggtgggacacccttccctggatccagaccctcatctagggcagggaaaccctggggccttgatggtgaaaatgcaccccaaatgaaaaataattattaaaaatgatcttgcaaatt

SEQ ID NO: 162905 - DNA, 3610 bp, Homo sapiens
  Payload ID: 12093
  Gene Symbol: OTOA
  Gene Name: otoancorin
  Uniprot ID: Q7RTW8
  ENST ID: ENST00000388958
  CDS Start-End: 2-3421
aatgtctcaggaacctacgacatactcccttttcctattcctttttctgagccatggagtgtcgagttatacagtgccaaattccaggcaggatttgcatccattgttgcaaaacatggcggaagaaataatagatggaagctatctgaatgcactgctggatctcatacagtttcaaagctcccacgtgtggacggatgacctgtcccacagagtcctggcctatctgaattcccggaatgttgccttcaccatccccagcctgcaggcagccgtggaaaaccacctggagcagcgtctgcaccagccccagaagctgctggaggacctgaggaagacagacgcccagcagttccgcactgccatgaaatgcctcttagaagacaagaaggacggcttggacctgaaagacatcatcatcgacttaggagagattcgagaacgagccttgcagagccctggcgtgaaccgcagcctgtttctcatcacactggagaggtgtttccagatgctgaactccctggagtgtgtggagatcctgggcaaggtgctgagggggtcctcagggagctttctccagccagacatcacagagcggctccctcgggacctgcgcgaggatgcctttaagaacctatctgcagtgttcaaagatctctacgacaaaacctcggctcattcccagagagctctctattcctggatgactggaatactgcagacatcctccaatgccactgatgactctgcttcatgggtcagtgcggaacacttatgggttttgggcagatacatggttcacctatcgtttgaagaaattacgaaaattagtcctatagaaattgggctgtttatcagctatgacaacgccaccaagcagctggacatggtctatgacatcacacctgagctggcccaggcgtttctggagaggatcagctcctccaactttaacatgaggaatacctccaccatccacaggctggggctgctggtttgtttctacaatgacctggaattgctggatgccactgtggctcaagtcctgctttaccagatgatcaagtgcagccacctgaggggcttccaggctggcgtccagaagctcaaagcagaactcctggacattgccatggagaaccagaccctcaatgagaccctgggttctttgtcggatgcagttgtaggtttgacctacagccaactggaatccctctcccccgaggctgtgcacggagccatctccaccctcaaccaggtctcaggttgggccaagagccaggtcatcatcttgtctgccaaatacttggcccatgagaaggtgctgtctttctacaatgtcagccagatgggcgcactgctggctggggtcagcacccaggccttctgcagcatgaaacgcaaggacatctcgcaggtcctgagaagtgccgtctcccagtatgtatccgacttgtcacctgcccagcagcaaggtatcctcagcaagatggtccaagcggaagacactgccccaggcatcgtggagatacaaggggctttctttaaggaagtgtctctctttgatttaaggaggcaacctggattcaactctacagtcctgaaggataaggaacttggaaggagccaggctctgttcctgtatgagcttctgttaaagaccaccagaaggcctgaggagcttttgagtgctgggcagctggtcaaaggcgtgacctgctcacacattgatgccatgagcactgacttctttctggcccatttccaggattttcagaacaacttcgccctgctttcaccctatcaggttaattgtttggcgtggaaatactgggaagtttccagattgtctatgccacctttcctcttggctgcactcccggcccgctacctggcttctgtcccagcctcccagtgtgtgccctttctgatcagcctggggaagagctggttggactccttggttttagattcccacaaaaagacttcagtcctcaggaaagtgcagcagtgcctggacgactccattgctgatgagtacactgtggacatcatggggaacctgctgtgtcacttgccggcagccatcatcgacagggggatctcccccagggcttgggcgactgctctacacggcctcagagactgcccagacctcaaccctgagcaaaaggctgcagtgaggctcaagctcctgggacagtatggactccctcagcactggacagccgagaccacgaaggacttgggaccctttctagtacttttctcaggagatgaattaagctctatagccacaaagtttcctgagatccttctgcaagcagcttccaagatggccaggaccctgcccactaaagaattcctctgggctgtctttcagtctgttcggaacagcagtgataagatccccagctatgaccctatgcctggttgccatggagtcgtggccccctcttctgatgacatcttcaagttggccgaagccaacgcctgctgggccctggaggacctgcggtgcatggaggaagacacattcatcaggaccgtggaactgctgggagctgtccagggtttcagccggcctcagctgatgaccctgaaggagaaagcaatacaggtttgggacatgccatcttactggagagaacaccatatcgtctccctggggcgcattgctctggctcttaatgagagtgagctggagcagctggacctcagctccatagacactgtggcttccctaagctggcaaacagaatggaccccgggacaggctgaatccattttgcaagggtacctggatgattcaggatacagtatccaggacctgaagagctttcatttggtaggacttggtgcaaccctgtgtgctataaacatcactgaaatcccacttataaagatctcagaattcagggtggtagtggccagaattgggaccctgctctgcagcacacatgtcttagccgagtttaagaggaaggctgaagttgtgtttggggatcccactgagtggaccagttctgtcttgcaggagcttgggaccattgcagctggattaactaaggcagagctccggatgcttgacaaggatttgatgccatatttccagccatcagcaataaaatgccttcctgatgagatattcaaagagctgtccgcggagcagatcgcctccctgggtccggagaacgccgcggcggtgacccacgcccagcgccggcggctcagtccactgcagctgcagagcctccagcaggcgctagatggcgccaagactcactcctggcaggacgcgcccgctagcgccggtcccactagaacctcatcctcgcgttctcccgcaggagctctccagtcgtggggtctttggcttggttgtcccctgctggttctaatggccaagctcctgtggtgagtggcctgagcgcatcgtcctgtgttgccccaagcagctggccaacatgtgtagagacaggatgctccagatggtgggacacccttccctggatccagaccctcatctagggcagggaaaccctggggccttgatggtgaaaatgcaccccaaatgaaaaataattattaaaaatgatcttgcaaatta

SEQ ID NO: 162906 - DNA, 1782 bp, Homo sapiens
  Payload ID: 12094
  Gene Symbol: OC90
  Gene Name: otoconin 90
  Uniprot ID: Q02509
  ENST ID: ENST00000254627
  CDS Start-End: 88-1521
agcatcattcatccagctgcactccagtggagccttcacggagtccgttccagttgctgcctaagccccatcctttgttctcctgctatgattgcgtttctcctcaccagtgtgctgatgatcccccatgccggaggccatcctctggacactccacatcttccacaggagctgcctccaggactcccaaacaatatcaatatcactttcttcagtgggatgtttaaaaatgtggaaagtgtggctgaaatttttgattgcctgggcccccacttcacctggctgcaggctgtcttcaccaatttccctgtgctgatccagtttgtcaatggtatgaagtgtgtggctggtctctgcccccgagactttgaagactatggttgcacctgcaggtttgagatggaagggttgcctgtggatgaatctgacagctgctgcttccagcaccgcaggtgctatgaggaggccgctgagatggactgtctccaagaccccgccaaacttagcacagaggtcaattgtgtcagcaagaagatcatatgtgagtccaaggacaactgtgagcacctgctgtgtacctgtgataaggctgccatagagtgcttggctcgatccagcctcaactcttccctgaaccttctggacacctccttctgcctggctcagactccagagacaaccatcaaggaagacttgacaacacttctgcccagagtggttcctgtggagcccacagacaccagcctgacagccctttcaggagaagaagcaggccacgatcaggaaggagtgggagctgctagggctacgtcccctccaggatctgcagagatagttgcaacaagggttacagctaaaattgtaacccttgtccctgctggcattaaatctctggggctggcagtgtcatctgttgaaaatgatcctgaggagaccactgaaaaagcctgtgacagattcaccttcctgcacctgggaagtggggacaacatgcaggtgatgccacagcttggagagatgctcttttgtctgacatcccggtgcccggaggaatttgagtcttatggctgttactgtggacaagaaggaagaggcgagccaagggatgacctagacaggtgctgcttgtcccatcactgctgcctagagcaagtgagaaggctgggctgcctgcttgagaggcttccttggtcaccggtggtgtgtgtggatcatacgcccaagtgtgggggccaaagcctgtgtgagaagttgctctgtgcctgtgaccagacggcagctgagtgcatgacctctgcctcctttaaccaaagcctcaagtccccaagcagactcgggtgccctgggcagccagcagcctgtgaagacagcctgcaccctgtgcccgcagcccccaccctgggctccagctctgaggaggacagcgaggaggaccctccacaggaggacctcggcagagccaagaggtttctgcggaagtcactgggtcccttggggatcgggcctcttcatggaagatagatgcccagagaaaatggctaacaccttcagtagcgtggctcctgctccaccttcagctctttatctctcagcctcctctgtcccttggagccttcttcccttcctttaactcagaggcggggagggaacagaggccgtgagccctgcccatgcctcatcagctgtggtcacctcacaagccaatgtacacttggagaaggcacaccatggtacctccatgctcctttagtgcactgtggaagctcaataaatactccaatc

SEQ ID NO: 162907 - DNA, 7156 bp, Homo sapiens
  Payload ID: 12095
  Gene Symbol: OTOF
  Gene Name: otoferlin
  Uniprot ID: Q9HC10
  ENST ID: ENST00000272371
  CDS Start-End: 128-6121
atcggaggggggtcgggaggaggaggaggaggcagcggcagagaagagagaggcgtgtgagccgtgctccaccggctagctccttcccgctgctcctgcctggcagtgccaggcagcccacaccagcatggccttgctcatccacctcaagacagtctcggagctgcggggcaggggcgaccggatcgccaaagtgactttccgagggcaatccttctactctcgggtcctggagaactgtgaggatgtggctgactttgatgagacatttcggtggccggtggccagcagcatcgacagaaatgagatgctggagattcaggttttcaactacagcaaagtcttcagcaacaagctcatcgggaccttccgcatggtgctgcagaaggtggtagaggagagccatgtggaggtgactgacacgctgattgatgacaacaatgctatcatcaagaccagcctgtgcgtggaggtccggtatcaggccactgacggcacagtgggctcctgggacgatggggacttcctgggagatgagtctcttcaagaggaagagaaggacagccaagagacggatggactgctcccaggctcccggcccagctcccggcccccaggagagaagagcttccggagagccgggaggagcgtgttctccgccatgaagctcggcaaaaaccggtctcacaaggaggagccccaaagaccagatgaaccggcggtgctggagatggaagaccttgaccatctggccattcggctaggagatggactggatcccgactcggtgtctctagcctcagtcacagctctcaccactaatgtctccaacaagcgatctaagccagacattaagatggagccaagtgctgggcggcccatggattaccaggtcagcatcacggtgatcgaggcccggcagctggtgggcttgaacatggaccctgtggtgtgcgtggaggtgggtgacgacaagaagtacacatccatgaaggagtccactaactgcccctattacaacgagtacttcgtcttcgacttccatgtctctccggatgtcatgtttgacaagatcatcaagatttcggtgattcactccaagaacctgctgcgcagtggcaccctggtgggctccttcaaaatggacgtgggaaccgtgtactcgcagccagagcaccagttccatcacaagtgggccatcctgtctgaccccgatgacatctcctcggggctgaagggctacgtgaagtgtgacgttgccgtggtgggcaaaggggacaacatcaagacgccccacaaggccaatgagaccgacgaagatgacattgaggggaacttgctgctccccgagggggtgccccccgaacgccagtgggcccggttctatgtgaaaatttaccgagcagaggggctgccccgtatgaacacaagcctcatggccaatgtaaagaaggctttcatcggtgaaaacaaggacctcgtggacccctacgtgcaagtcttctttgctggccagaagggcaagacttcagtgcagaagagcagctatgagcccctgtggaatgagcaggtcgtctttacagacctcttccccccactctgcaaacgcatgaaggtgcagatccgagactcggacaaggtcaacgacgtggccatcggcacccacttcattgacctgcgcaagatttctaatgacggagacaaaggcttcctgcccacactgggcccagcctgggtgaacatgtacggctccacacgtaactacacgctgctggatgagcatcaggacctgaacgagggcctgggggagggtgtgtccttccgggcccggctcctgctgggcctggctgtggagatcgtagacacctccaaccctgagctcaccagctccacagaggtgcaggtggagcaggccacgcccatctcggagagctgtgcaggtaaaatggaagaattctttctctttggagccttcctggaggcctcaatgatcgaccggagaaacggagacaagcccatcacctttgaggtcaccataggcaactatgggaacgaagttgatggcctgtcccggccccagcggcctcggccccggaaggagccgggggatgaggaagaagtagacctgattcagaacgcaagtgatgacgaggccggtgatgccggggacctggcctcagtctcctccactccaccaatgcggccccaggtcaccgacaggaactacttccatctgccctacctggagcgaaagccctgcatctacatcaagagctggtggccggaccagcgccgccgcctctacaatgccaacatcatggaccacattgccgacaagctggaagaaggcctgaacgacatacaggagatgatcaaaacggagaagtcctaccctgagcgtcgcctgcggggcgtcctggaggagctgagctgtggctgctgccgcttcctctccctcgctgacaaggaccagggccactcatcccgcaccaggcttgaccgggagcgcctcaagtcctgcatgagggagctggaaaacatggggcagcaggccaggatgctgcgggcccaggtgaagcggcacacggtgcgggacaagctgaggctgtgccagaacttcctgcagaagctgcgcttcctggcggacgagccccagcacagcattcccgacatcttcatctggatgatgagcaacaacaagcgtgtcgcctatgcccgtgtgccctccaaggacctgctcttctccatcgtggaggaggagactggcaaggactgcgccaaggtcaagacgctcttccttaagctgccagggaagcggggcttcggctcggcaggctggacagtgcaggccaaggtggagctgtacctgtggctgggcctcagcaaacagcgcaaggagttcctgtgcggcctgccctgtggcttccaggaggtcaaggcagcccagggcctgggcctgcatgccttcccacccgtcagcctggtctacaccaagaagcaggcgttccagctccgagcgcacatgtaccaggcccgcagcctctttgccgccgacagcagcggactctcagacccctttgcccgcgtcttcttcatcaatcagagtcagtgcacagaggtgctgaatgagaccctgtgtcccacctgggaccagatgctggtgttcgacaacctggagctctatggtgaagctcatgagctgagggacgatccgcccatcattgtcattgaaatctatgaccaggattccatgggcaaagctgacttcatgggccggaccttcgccaaacccctggtgaagatggcagacgaggcgtactgcccaccccgcttcccacctcagctcgagtactaccagatctaccgtggcaacgccacagctggagacctgctggcggccttcgagctgctgcagattggaccagcagggaaggctgacctgccccccatcaatggcccggtggacgtggaccgaggtcccatcatgcccgtgcccatgggcatccggcccgtgctcagcaagtaccgagtggaggtgctgttctggggcctacgggacctaaagcgggtgaacctggcccaggtggaccggccacgggtggacatcgagtgtgcagggaagggggtgcagtcgtccctgatccacaattataagaagaaccccaacttcaacaccctcgtcaagtggtttgaagtggacctcccagagaacgagctgctgcacccgcccttgaacatccgtgtggtggactgccgggccttcggtcgctacacactggtgggctcccatgccgtcagctccctgcgacgcttcatctaccggcccccagaccgctcggcccccagctggaacaccacggtcaggcttctccggcgctgccgtgtgctgtgcaatgggggctcctcctctcactccacaggggaggttgtggtgactatggagccagaggtacccatcaagaaactggagaccatggtgaagctggacgcgacttctgaagctgttgtcaaggtggatgtggctgaggaggagaaggagaagaagaagaagaagaagggcactgcggaggagccagaggaggaggagccagacgagagcatgctggactggtggtccaagtactttgcctccattgacaccatgaaggagcaacttcgacaacaagagccctctggaattgacttggaggagaaggaggaagtggacaataccgagggcctgaaggggtcaatgaagggcaaggagaaggcaagggctgccaaagaggagaagaagaagaaaactcagagctctggctctggccaggggtccgaggcccccgagaagaagaaacccaagattgatgagcttaaggtataccccaaagagctggagtccgagtttgataactttgaggactggctgcacactttcaacttgcttcggggcaagaccggggatgatgaggatggctccaccgaggaggagcgcattgtgggacgcttcaagggctccctctgcgtgtacaaagtgccactcccagaggacgtgtcccgggaagccggctacgactccacctacggcatgttccagggcatcccgagcaatgaccccatcaatgtgctggtccgagtctatgtggtccgggccacggacctgcaccctgctgacatcaacggcaaagctgacccctacatcgccatccggctaggcaagactgacatccgcgacaaggagaactacatctccaagcagctcaaccctgtctttgggaagtcctttgacatcgaggcctccttccccatggaatccatgctgacggtggctgtgtatgactgggacctggtgggcactgatgacctcattggggaaaccaagatcgacctggagaaccgcttctacagcaagcaccgcgccacctgcggcatcgcccagacctactccacacatggctacaatatctggcgggaccccatgaagcccagccagatcctgacccgcctctgcaaagacggcaaagtggacggcccccactttgggccccctgggagagtgaaggtggccaaccgcgtcttcactgggccctctgagattgaggacgagaacggtcagaggaagcccacagacgagcatgtggcgctgttggccctgaggcactgggaggacatcccccgcgcaggctgccgcctggtgccagagcatgtggagacgaggccgctgctcaaccccgacaagccgggcatcgagcagggccgcctggagctgtgggtggacatgttccccatggacatgccagcccctgggacgcctctggacatctcacctcggaagcccaagaagtacgagctgcgggtcatcatctggaacacagatgaggtggtcttggaggacgacgacttcttcacaggggagaagtccagtgacatcttcgtgagggggtggctgaagggccagcaggaggacaagcaggacacagacgtccactaccactccctcactggcgagggcaacttcaactggcgctacctgttccccttcgactacctggcggcggaggagaagatcgtcatctccaagaaggagtccatgttctcctgggacgagaccgagtacaagatccccgcgcggctcaccctgcagatctgggatgcggaccacttctccgctgacgacttcctgggggccatcgagctggacctgaaccggttcccgcggggcgcaaagacagccaagcagtgcaccatggagatggccaccggggaggtggacgtgcccctcgtgtccatcttcaagcaaaagcgcgtcaaaggctggtggcccctcctggcccgcaatgagaacgatgagtttgagctcacgggcaaggtggaggctgagctgcatttactgacagcagaggaggcagagaagaacccagtgggcctggcccgcaatgaacctgaccccctagagaaacccaaccggcccgacacgagcttcatctggttcctgaaccctctcaagtcggctcgctacttcttgtggcacacgtatcgctggctgctcctcaaactgttgctgctcctgctgctgctcctcctcctcgccctgttcctctactctgtgcctggctacctggtcaagaaaatcctcggggcctgagcccagtggcctcctggccggcccgacacggccttcgtctggttcctcaaccctctcaagtccatcaagtacctcatctgcacccggtacaagtggctcatcatcaagatcgtgctggcgctgttggggctgctcatgttggggctcttcctctacagcctccctggctacatggtcaaaaagctccttggggcatgaaggccgccagctcccgccagccgctccccagccctgccgcatttcctttcagtggcttggactctttcccatctcccctggggagcctgaggagcccagcgtccactcttcatgccttgggccgagcctgcctcctgcttgcgggggccgcctgtcctcactgccccaggctgcggcttgcccagtcccgcccctctgacccctgcctgtgggctggggagccttggatggggtggggacctggaatgggtctctcttgccccacctggctgaggcgccacccttcttcaggcccaggctccagaggaagactcctgaaaccctccccaggtcttccaagtacaggattgaagctttagtgaaattaaccaaggaccatgggtcagtgcccagggctttaaaaagaatgaacgagcaaaaggtatccccgccgtgacccctgcagatagcaccggtctttgatccgcagcaggggccagaccctgcccacaagtcccagcgcggctgcttctgccactgctgggctccacttggctcctctcacttcccagggggtcgcctgtcctgcctgtgggtttccatggcttcccagagctccctctgccccagccagcgcctccaggcccagctgaggagctgtgagaagcagcagaggggactccccatcccgggcacaccctgtcctcccacccctgcccccttgcccttccagccctttcagctgcagctgggagctggcccgtcaagtgctgcccctgcctgtgtctgggtttctgttggctgtttttcttttcttgagtggtgatttttctctaaataaaagaagtcaagcactga

SEQ ID NO: 162908 - DNA, 4756 bp, Homo sapiens
  Payload ID: 12095
  Gene Symbol: OTOF
  Gene Name: otoferlin
  Uniprot ID: Q9HC10
  ENST ID: ENST00000339598
  CDS Start-End: 227-3919
ccgtgagttctgcccaggccctgtgagctcaccagagccacagactcacagcccagaggtggcttcttccttcaggaactgaagaacccccatgaacaccaacatctccaggttctgagaacagaacctgggaaattgatgacttcctcatgatgaccgatactcaggatggccctagcgagagctcccagatcatgaggaagaaggcctgaacgacatacaggagatgatcaaaacggagaagtcctaccctgagcgtcgcctgcggggcgtcctggaggagctgagctgtggctgctgccgcttcctctccctcgctgacaaggaccagggccactcatcccgcaccaggcttgaccgggagcgcctcaagtcctgcatgagggagctggaaaacatggggcagcaggccaggatgctgcgggcccaggtgaagcggcacacggtgcgggacaagctgaggctgtgccagaacttcctgcagaagctgcgcttcctggcggacgagccccagcacagcattcccgacatcttcatctggatgatgagcaacaacaagcgtgtcgcctatgcccgtgtgccctccaaggacctgctcttctccatcgtggaggaggagactggcaaggactgcgccaaggtcaagacgctcttccttaagctgccagggaagcggggcttcggctcggcaggctggacagtgcaggccaaggtggagctgtacctgtggctgggcctcagcaaacagcgcaaggagttcctgtgcggcctgccctgtggcttccaggaggtcaaggcagcccagggcctgggcctgcatgccttcccacccgtcagcctggtctacaccaagaagcaggcgttccagctccgagcgcacatgtaccaggcccgcagcctctttgccgccgacagcagcggactctcagacccctttgcccgcgtcttcttcatcaatcagagtcagtgcacagaggtgctgaatgagaccctgtgtcccacctgggaccagatgctggtgttcgacaacctggagctctatggtgaagctcatgagctgagggacgatccgcccatcattgtcattgaaatctatgaccaggattccatgggcaaagctgacttcatgggccggaccttcgccaaacccctggtgaagatggcagacgaggcgtactgcccaccccgcttcccacctcagctcgagtactaccagatctaccgtggcaacgccacagctggagacctgctggcggccttcgagctgctgcagattggaccagcagggaaggctgacctgccccccatcaatggcccggtggacgtggaccgaggtcccatcatgcccgtgcccatgggcatccggcccgtgctcagcaagtaccgagtggaggtgctgttctggggcctacgggacctaaagcgggtgaacctggcccaggtggaccggccacgggtggacatcgagtgtgcagggaagggggtgcagtcgtccctgatccacaattataagaagaaccccaacttcaacaccctcgtcaagtggtttgaagtggacctcccagagaacgagctgctgcacccgcccttgaacatccgtgtggtggactgccgggccttcggtcgctacacactggtgggctcccatgccgtcagctccctgcgacgcttcatctaccggcccccagaccgctcggcccccagctggaacaccacgggggaggttgtggtgactatggagccagaggtacccatcaagaaactggagaccatggtgaagctggacgcgacttctgaagctgttgtcaaggtggatgtggctgaggaggagaaggagaagaagaagaagaagaagggcactgcggaggagccagaggaggaggagccagacgagagcatgctggactggtggtccaagtactttgcctccattgacaccatgaaggagcaacttcgacaacaagagccctctggaattgacttggaggagaaggaggaagtggacaataccgagggcctgaaggggtcaatgaagggcaaggagaaggcaagggctgccaaagaggagaagaagaagaaaactcagagctctggctctggccaggggtccgaggcccccgagaagaagaaacccaagattgatgagcttaaggtataccccaaagagctggagtccgagtttgataactttgaggactggctgcacactttcaacttgcttcggggcaagaccggggatgatgaggatggctccaccgaggaggagcgcattgtgggacgcttcaagggctccctctgcgtgtacaaagtgccactcccagaggacgtgtcccgggaagccggctacgactccacctacggcatgttccagggcatcccgagcaatgaccccatcaatgtgctggtccgagtctatgtggtccgggccacggacctgcaccctgctgacatcaacggcaaagctgacccctacatcgccatccggctaggcaagactgacatccgcgacaaggagaactacatctccaagcagctcaaccctgtctttgggaagtcctttgacatcgaggcctccttccccatggaatccatgctgacggtggctgtgtatgactgggacctggtgggcactgatgacctcattggggaaaccaagatcgacctggagaaccgcttctacagcaagcaccgcgccacctgcggcatcgcccagacctactccacacatggctacaatatctggcgggaccccatgaagcccagccagatcctgacccgcctctgcaaagacggcaaagtggacggcccccactttgggccccctgggagagtgaaggtggccaaccgcgtcttcactgggccctctgagattgaggacgagaacggtcagaggaagcccacagacgagcatgtggcgctgttggccctgaggcactgggaggacatcccccgcgcaggctgccgcctggtgccagagcatgtggagacgaggccgctgctcaaccccgacaagccgggcatcgagcagggccgcctggagctgtgggtggacatgttccccatggacatgccagcccctgggacgcctctggacatctcacctcggaagcccaagaagtacgagctgcgggtcatcatctggaacacagatgaggtggtcttggaggacgacgacttcttcacaggggagaagtccagtgacatcttcgtgagggggtggctgaagggccagcaggaggacaagcaggacacagacgtccactaccactccctcactggcgagggcaacttcaactggcgctacctgttccccttcgactacctggcggcggaggagaagatcgtcatctccaagaaggagtccatgttctcctgggacgagaccgagtacaagatccccgcgcggctcaccctgcagatctgggatgcggaccacttctccgctgacgacttcctgggggccatcgagctggacctgaaccggttcccgcggggcgcaaagacagccaagcagtgcaccatggagatggccaccggggaggtggacgtgcccctcgtgtccatcttcaagcaaaagcgcgtcaaaggctggtggcccctcctggcccgcaatgagaacgatgagtttgagctcacgggcaaggtggaggctgagctgcatttactgacagcagaggaggcagagaagaacccagtgggcctggcccgcaatgaacctgaccccctagagaaacccaaccggcccgacacggccttcgtctggttcctcaaccctctcaagtccatcaagtacctcatctgcacccggtacaagtggctcatcatcaagatcgtgctggcgctgttggggctgctcatgttggggctcttcctctacagcctccctggctacatggtcaaaaagctccttggggcatgaaggccgccagctcccgccagccgctccccagccctgccgcatttcctttcagtggcttggactctttcccatctcccctggggagcctgaggagcccagcgtccactcttcatgccttgggccgagcctgcctcctgcttgcgggggccgcctgtcctcactgccccaggctgcggcttgcccagtcccgcccctctgacccctgcctgtgggctggggagccttggatggggtggggacctggaatgggtctctcttgccccacctggctgaggcgccacccttcttcaggcccaggctccagaggaagactcctgaaaccctccccaggtcttccaagtacaggattgaagctttagtgaaattaaccaaggaccatgggtcagtgcccagggctttaaaaagaatgaacgagcaaaaggtatccccgccgtgacccctgcagatagcaccggtctttgatccgcagcaggggccagaccctgcccacaagtcccagcgcggctgcttctgccactgctgggctccacttggctcctctcacttcccagggggtcgcctgtcctgcctgtgggtttccatggcttcccagagctccctctgccccagccagcgcctccaggcccagctgaggagctgtgagaagcagcagaggggactccccatcccgggcacaccctgtcctcccacccctgcccccttgcccttccagccctttcagctgcagctgggagctggcccgtcaagtgctgcccctgcctgtgtctgggtttctgttggctgtttttcttttcttgagtggtgatttttctctaaataaaagaagtcaagcactga

SEQ ID NO: 162909 - DNA, 4954 bp, Homo sapiens
  Payload ID: 12095
  Gene Symbol: OTOF
  Gene Name: otoferlin
  Uniprot ID: Q9HC10
  ENST ID: ENST00000338581
  CDS Start-End: 227-3919
ccgtgagttctgcccaggccctgtgagctcaccagagccacagactcacagcccagaggtggcttcttccttcaggaactgaagaacccccatgaacaccaacatctccaggttctgagaacagaacctgggaaattgatgacttcctcatgatgaccgatactcaggatggccctagcgagagctcccagatcatgaggaagaaggcctgaacgacatacaggagatgatcaaaacggagaagtcctaccctgagcgtcgcctgcggggcgtcctggaggagctgagctgtggctgctgccgcttcctctccctcgctgacaaggaccagggccactcatcccgcaccaggcttgaccgggagcgcctcaagtcctgcatgagggagctggaaaacatggggcagcaggccaggatgctgcgggcccaggtgaagcggcacacggtgcgggacaagctgaggctgtgccagaacttcctgcagaagctgcgcttcctggcggacgagccccagcacagcattcccgacatcttcatctggatgatgagcaacaacaagcgtgtcgcctatgcccgtgtgccctccaaggacctgctcttctccatcgtggaggaggagactggcaaggactgcgccaaggtcaagacgctcttccttaagctgccagggaagcggggcttcggctcggcaggctggacagtgcaggccaaggtggagctgtacctgtggctgggcctcagcaaacagcgcaaggagttcctgtgcggcctgccctgtggcttccaggaggtcaaggcagcccagggcctgggcctgcatgccttcccacccgtcagcctggtctacaccaagaagcaggcgttccagctccgagcgcacatgtaccaggcccgcagcctctttgccgccgacagcagcggactctcagacccctttgcccgcgtcttcttcatcaatcagagtcagtgcacagaggtgctgaatgagaccctgtgtcccacctgggaccagatgctggtgttcgacaacctggagctctatggtgaagctcatgagctgagggacgatccgcccatcattgtcattgaaatctatgaccaggattccatgggcaaagctgacttcatgggccggaccttcgccaaacccctggtgaagatggcagacgaggcgtactgcccaccccgcttcccacctcagctcgagtactaccagatctaccgtggcaacgccacagctggagacctgctggcggccttcgagctgctgcagattggaccagcagggaaggctgacctgccccccatcaatggcccggtggacgtggaccgaggtcccatcatgcccgtgcccatgggcatccggcccgtgctcagcaagtaccgagtggaggtgctgttctggggcctacgggacctaaagcgggtgaacctggcccaggtggaccggccacgggtggacatcgagtgtgcagggaagggggtgcagtcgtccctgatccacaattataagaagaaccccaacttcaacaccctcgtcaagtggtttgaagtggacctcccagagaacgagctgctgcacccgcccttgaacatccgtgtggtggactgccgggccttcggtcgctacacactggtgggctcccatgccgtcagctccctgcgacgcttcatctaccggcccccagaccgctcggcccccagctggaacaccacgggggaggttgtggtgactatggagccagaggtacccatcaagaaactggagaccatggtgaagctggacgcgacttctgaagctgttgtcaaggtggatgtggctgaggaggagaaggagaagaagaagaagaagaagggcactgcggaggagccagaggaggaggagccagacgagagcatgctggactggtggtccaagtactttgcctccattgacaccatgaaggagcaacttcgacaacaagagccctctggaattgacttggaggagaaggaggaagtggacaataccgagggcctgaaggggtcaatgaagggcaaggagaaggcaagggctgccaaagaggagaagaagaagaaaactcagagctctggctctggccaggggtccgaggcccccgagaagaagaaacccaagattgatgagcttaaggtataccccaaagagctggagtccgagtttgataactttgaggactggctgcacactttcaacttgcttcggggcaagaccggggatgatgaggatggctccaccgaggaggagcgcattgtgggacgcttcaagggctccctctgcgtgtacaaagtgccactcccagaggacgtgtcccgggaagccggctacgactccacctacggcatgttccagggcatcccgagcaatgaccccatcaatgtgctggtccgagtctatgtggtccgggccacggacctgcaccctgctgacatcaacggcaaagctgacccctacatcgccatccggctaggcaagactgacatccgcgacaaggagaactacatctccaagcagctcaaccctgtctttgggaagtcctttgacatcgaggcctccttccccatggaatccatgctgacggtggctgtgtatgactgggacctggtgggcactgatgacctcattggggaaaccaagatcgacctggagaaccgcttctacagcaagcaccgcgccacctgcggcatcgcccagacctactccacacatggctacaatatctggcgggaccccatgaagcccagccagatcctgacccgcctctgcaaagacggcaaagtggacggcccccactttgggccccctgggagagtgaaggtggccaaccgcgtcttcactgggccctctgagattgaggacgagaacggtcagaggaagcccacagacgagcatgtggcgctgttggccctgaggcactgggaggacatcccccgcgcaggctgccgcctggtgccagagcatgtggagacgaggccgctgctcaaccccgacaagccgggcatcgagcagggccgcctggagctgtgggtggacatgttccccatggacatgccagcccctgggacgcctctggacatctcacctcggaagcccaagaagtacgagctgcgggtcatcatctggaacacagatgaggtggtcttggaggacgacgacttcttcacaggggagaagtccagtgacatcttcgtgagggggtggctgaagggccagcaggaggacaagcaggacacagacgtccactaccactccctcactggcgagggcaacttcaactggcgctacctgttccccttcgactacctggcggcggaggagaagatcgtcatctccaagaaggagtccatgttctcctgggacgagaccgagtacaagatccccgcgcggctcaccctgcagatctgggatgcggaccacttctccgctgacgacttcctgggggccatcgagctggacctgaaccggttcccgcggggcgcaaagacagccaagcagtgcaccatggagatggccaccggggaggtggacgtgcccctcgtgtccatcttcaagcaaaagcgcgtcaaaggctggtggcccctcctggcccgcaatgagaacgatgagtttgagctcacgggcaaggtggaggctgagctgcatttactgacagcagaggaggcagagaagaacccagtgggcctggcccgcaatgaacctgaccccctagagaaacccaaccggcccgacacgagcttcatctggttcctgaaccctctcaagtcggctcgctacttcttgtggcacacgtatcgctggctgctcctcaaactgttgctgctcctgctgctgctcctcctcctcgccctgttcctctactctgtgcctggctacctggtcaagaaaatcctcggggcctgagcccagtggcctcctggccggcccgacacggccttcgtctggttcctcaaccctctcaagtccatcaagtacctcatctgcacccggtacaagtggctcatcatcaagatcgtgctggcgctgttggggctgctcatgttggggctcttcctctacagcctccctggctacatggtcaaaaagctccttggggcatgaaggccgccagctcccgccagccgctccccagccctgccgcatttcctttcagtggcttggactctttcccatctcccctggggagcctgaggagcccagcgtccactcttcatgccttgggccgagcctgcctcctgcttgcgggggccgcctgtcctcactgccccaggctgcggcttgcccagtcccgcccctctgacccctgcctgtgggctggggagccttggatggggtggggacctggaatgggtctctcttgccccacctggctgaggcgccacccttcttcaggcccaggctccagaggaagactcctgaaaccctccccaggtcttccaagtacaggattgaagctttagtgaaattaaccaaggaccatgggtcagtgcccagggctttaaaaagaatgaacgagcaaaaggtatccccgccgtgacccctgcagatagcaccggtctttgatccgcagcaggggccagaccctgcccacaagtcccagcgcggctgcttctgccactgctgggctccacttggctcctctcacttcccagggggtcgcctgtcctgcctgtgggtttccatggcttcccagagctccctctgccccagccagcgcctccaggcccagctgaggagctgtgagaagcagcagaggggactccccatcccgggcacaccctgtcctcccacccctgcccccttgcccttccagccctttcagctgcagctgggagctggcccgtcaagtgctgcccctgcctgtgtctgggtttctgttggctgtttttcttttcttgagtggtgatttttctctaaataaaagaagtcaagcactga

SEQ ID NO: 162910 - DNA, 5108 bp, Homo sapiens
  Payload ID: 12095
  Gene Symbol: OTOF
  Gene Name: otoferlin
  Uniprot ID: Q9HC10
  ENST ID: ENST00000402415
  CDS Start-End: 150-4073
ccgtgagttctgcccaggccctgtgagctcaccagagccacagactcacagcccagaggtggcttcttccttcaggaactgaagaacccccatgaacaccaacatctccaggttctgagaacagaacctgggaaattgatgacttcctcatgatgaccgatactcaggatggccctagcgagagctcccagatcatgaggtccctcactcccctgatcaacagggaggaggcatttggggaggctggggaggcggggctgtggcccagcatcacccacactcctgattcacaggaagaaggcctgaacgacatacaggagatgatcaaaacggagaagtcctaccctgagcgtcgcctgcggggcgtcctggaggagctgagctgtggctgctgccgcttcctctccctcgctgacaaggaccagggccactcatcccgcaccaggcttgaccgggagcgcctcaagtcctgcatgagggagctggaaaacatggggcagcaggccaggatgctgcgggcccaggtgaagcggcacacggtgcgggacaagctgaggctgtgccagaacttcctgcagaagctgcgcttcctggcggacgagccccagcacagcattcccgacatcttcatctggatgatgagcaacaacaagcgtgtcgcctatgcccgtgtgccctccaaggacctgctcttctccatcgtggaggaggagactggcaaggactgcgccaaggtcaagacgctcttccttaagctgccagggaagcggggcttcggctcggcaggctggacagtgcaggccaaggtggagctgtacctgtggctgggcctcagcaaacagcgcaaggagttcctgtgcggcctgccctgtggcttccaggaggtcaaggcagcccagggcctgggcctgcatgccttcccacccgtcagcctggtctacaccaagaagcaggcgttccagctccgagcgcacatgtaccaggcccgcagcctctttgccgccgacagcagcggactctcagacccctttgcccgcgtcttcttcatcaatcagagtcagtgcacagaggtgctgaatgagaccctgtgtcccacctgggaccagatgctggtgttcgacaacctggagctctatggtgaagctcatgagctgagggacgatccgcccatcattgtcattgaaatctatgaccaggattccatgggcaaagctgacttcatgggccggaccttcgccaaacccctggtgaagatggcagacgaggcgtactgcccaccccgcttcccacctcagctcgagtactaccagatctaccgtggcaacgccacagctggagacctgctggcggccttcgagctgctgcagattggaccagcagggaaggctgacctgccccccatcaatggcccggtggacgtggaccgaggtcccatcatgcccgtgcccatgggcatccggcccgtgctcagcaagtaccgagtggaggtgctgttctggggcctacgggacctaaagcgggtgaacctggcccaggtggaccggccacgggtggacatcgagtgtgcagggaagggggtgcagtcgtccctgatccacaattataagaagaaccccaacttcaacaccctcgtcaagtggtttgaagtggacctcccagagaacgagctgctgcacccgcccttgaacatccgtgtggtggactgccgggccttcggtcgctacacactggtgggctcccatgccgtcagctccctgcgacgcttcatctaccggcccccagaccgctcggcccccagctggaacaccacggtcaggcttctccggcgctgccgtgtgctgtgcaatgggggctcctcctctcactccacaggggaggttgtggtgactatggagccagaggtacccatcaagaaactggagaccatggtgaagctggacgcgacttctgaagctgttgtcaaggtggatgtggctgaggaggagaaggagaagaagaagaagaagaagggcactgcggaggagccagaggaggaggagccagacgagagcatgctggactggtggtccaagtactttgcctccattgacaccatgaaggagcaacttcgacaacaagagccctctggaattgacttggaggagaaggaggaagtggacaataccgagggcctgaaggggtcaatgaagggcaaggagaaggcaagggctgccaaagaggagaagaagaagaaaactcagagctctggctctggccaggggtccgaggcccccgagaagaagaaacccaagattgatgagcttaaggtataccccaaagagctggagtccgagtttgataactttgaggactggctgcacactttcaacttgcttcggggcaagaccggggatgatgaggatggctccaccgaggaggagcgcattgtgggacgcttcaagggctccctctgcgtgtacaaagtgccactcccagaggacgtgtcccgggaagccggctacgactccacctacggcatgttccagggcatcccgagcaatgaccccatcaatgtgctggtccgagtctatgtggtccgggccacggacctgcaccctgctgacatcaacggcaaagctgacccctacatcgccatccggctaggcaagactgacatccgcgacaaggagaactacatctccaagcagctcaaccctgtctttgggaagtcctttgacatcgaggcctccttccccatggaatccatgctgacggtggctgtgtatgactgggacctggtgggcactgatgacctcattggggaaaccaagatcgacctggagaaccgcttctacagcaagcaccgcgccacctgcggcatcgcccagacctactccacacatggctacaatatctggcgggaccccatgaagcccagccagatcctgacccgcctctgcaaagacggcaaagtggacggcccccactttgggccccctgggagagtgaaggtggccaaccgcgtcttcactgggccctctgagattgaggacgagaacggtcagaggaagcccacagacgagcatgtggcgctgttggccctgaggcactgggaggacatcccccgcgcaggctgccgcctggtgccagagcatgtggagacgaggccgctgctcaaccccgacaagccgggcatcgagcagggccgcctggagctgtgggtggacatgttccccatggacatgccagcccctgggacgcctctggacatctcacctcggaagcccaagaagtacgagctgcgggtcatcatctggaacacagatgaggtggtcttggaggacgacgacttcttcacaggggagaagtccagtgacatcttcgtgagggggtggctgaagggccagcaggaggacaagcaggacacagacgtccactaccactccctcactggcgagggcaacttcaactggcgctacctgttccccttcgactacctggcggcggaggagaagatcgtcatctccaagaaggagtccatgttctcctgggacgagaccgagtacaagatccccgcgcggctcaccctgcagatctgggatgcggaccacttctccgctgacgacttcctgggggccatcgagctggacctgaaccggttcccgcggggcgcaaagacagccaagcagtgcaccatggagatggccaccggggaggtggacgtgcccctcgtgtccatcttcaagcaaaagcgcgtcaaaggctggtggcccctcctggcccgcaatgagaacgatgagtttgagctcacgggcaaggtggaggctgagctgcatttactgacagcagaggaggcagagaagaacccagtgggcctggcccgcaatgaacctgaccccctagagaaacccaaccggcccgacacgagcttcatctggttcctgaaccctctcaagtcggctcgctacttcttgtggcacacgtatcgctggctgctcctcaaactgttgctgctcctgctgctgctcctcctcctcgccctgttcctctactctgtgcctggctacctggtcaagaaaatcctcggggcctgagcccagtggcctcctggccggcccgacacggccttcgtctggttcctcaaccctctcaagtccatcaagtacctcatctgcacccggtacaagtggctcatcatcaagatcgtgctggcgctgttggggctgctcatgttggggctcttcctctacagcctccctggctacatggtcaaaaagctccttggggcatgaaggccgccagctcccgccagccgctccccagccctgccgcatttcctttcagtggcttggactctttcccatctcccctggggagcctgaggagcccagcgtccactcttcatgccttgggccgagcctgcctcctgcttgcgggggccgcctgtcctcactgccccaggctgcggcttgcccagtcccgcccctctgacccctgcctgtgggctggggagccttggatggggtggggacctggaatgggtctctcttgccccacctggctgaggcgccacccttcttcaggcccaggctccagaggaagactcctgaaaccctccccaggtcttccaagtacaggattgaagctttagtgaaattaaccaaggaccatgggtcagtgcccagggctttaaaaagaatgaacgagcaaaaggtatccccgccgtgacccctgcagatagcaccggtctttgatccgcagcaggggccagaccctgcccacaagtcccagcgcggctgcttctgccactgctgggctccacttggctcctctcacttcccagggggtcgcctgtcctgcctgtgggtttccatggcttcccagagctccctctgccccagccagcgcctccaggcccagctgaggagctgtgagaagcagcagaggggactccccatcccgggcacaccctgtcctcccacccctgcccccttgcccttccagccctttcagctgcagctgggagctggcccgtcaagtgctgcccctgcctgtgtctgggtttctgttggctgtttttcttttcttgagtggtgatttttctctaaataaaagaagtcaagcactga

SEQ ID NO: 162911 - DNA, 6937 bp, Homo sapiens
  Payload ID: 12095
  Gene Symbol: OTOF
  Gene Name: otoferlin
  Uniprot ID: Q9HC10
  ENST ID: ENST00000403946
  CDS Start-End: 108-6101
aggaggaggaggcagcggcagagaagagagaggcgtgtgagccgtgctccaccggctagctccttcccgctgctcctgcctggcagtgccaggcagcccacaccagcatggccttgctcatccacctcaagacagtctcggagctgcggggcaggggcgaccggatcgccaaagtgactttccgagggcaatccttctactctcgggtcctggagaactgtgaggatgtggctgactttgatgagacatttcggtggccggtggccagcagcatcgacagaaatgagatgctggagattcaggttttcaactacagcaaagtcttcagcaacaagctcatcgggaccttccgcatggtgctgcagaaggtggtagaggagagccatgtggaggtgactgacacgctgattgatgacaacaatgctatcatcaagaccagcctgtgcgtggaggtccggtatcaggccactgacggcacagtgggctcctgggacgatggggacttcctgggagatgagtctcttcaagaggaagagaaggacagccaagagacggatggactgctcccaggctcccggcccagctcccggcccccaggagagaagagcttccggagagccgggaggagcgtgttctccgccatgaagctcggcaaaaaccggtctcacaaggaggagccccaaagaccagatgaaccggcggtgctggagatggaagaccttgaccatctggccattcggctaggagatggactggatcccgactcggtgtctctagcctcagtcacagctctcaccactaatgtctccaacaagcgatctaagccagacattaagatggagccaagtgctgggcggcccatggattaccaggtcagcatcacggtgatcgaggcccggcagctggtgggcttgaacatggaccctgtggtgtgcgtggaggtgggtgacgacaagaagtacacatccatgaaggagtccactaactgcccctattacaacgagtacttcgtcttcgacttccatgtctctccggatgtcatgtttgacaagatcatcaagatttcggtgattcactccaagaacctgctgcgcagtggcaccctggtgggctccttcaaaatggacgtgggaaccgtgtactcgcagccagagcaccagttccatcacaagtgggccatcctgtctgaccccgatgacatctcctcggggctgaagggctacgtgaagtgtgacgttgccgtggtgggcaaaggggacaacatcaagacgccccacaaggccaatgagaccgacgaagatgacattgaggggaacttgctgctccccgagggggtgccccccgaacgccagtgggcccggttctatgtgaaaatttaccgagcagaggggctgccccgtatgaacacaagcctcatggccaatgtaaagaaggctttcatcggtgaaaacaaggacctcgtggacccctacgtgcaagtcttctttgctggccagaagggcaagacttcagtgcagaagagcagctatgagcccctgtggaatgagcaggtcgtctttacagacctcttccccccactctgcaaacgcatgaaggtgcagatccgagactcggacaaggtcaacgacgtggccatcggcacccacttcattgacctgcgcaagatttctaatgacggagacaaaggcttcctgcccacactgggcccagcctgggtgaacatgtacggctccacacgtaactacacgctgctggatgagcatcaggacctgaacgagggcctgggggagggtgtgtccttccgggcccggctcctgctgggcctggctgtggagatcgtagacacctccaaccctgagctcaccagctccacagaggtgcaggtggagcaggccacgcccatctcggagagctgtgcaggtaaaatggaagaattctttctctttggagccttcctggaggcctcaatgatcgaccggagaaacggagacaagcccatcacctttgaggtcaccataggcaactatgggaacgaagttgatggcctgtcccggccccagcggcctcggccccggaaggagccgggggatgaggaagaagtagacctgattcagaacgcaagtgatgacgaggccggtgatgccggggacctggcctcagtctcctccactccaccaatgcggccccaggtcaccgacaggaactacttccatctgccctacctggagcgaaagccctgcatctacatcaagagctggtggccggaccagcgccgccgcctctacaatgccaacatcatggaccacattgccgacaagctggaagaaggcctgaacgacatacaggagatgatcaaaacggagaagtcctaccctgagcgtcgcctgcggggcgtcctggaggagctgagctgtggctgctgccgcttcctctccctcgctgacaaggaccagggccactcatcccgcaccaggcttgaccgggagcgcctcaagtcctgcatgagggagctggaaaacatggggcagcaggccaggatgctgcgggcccaggtgaagcggcacacggtgcgggacaagctgaggctgtgccagaacttcctgcagaagctgcgcttcctggcggacgagccccagcacagcattcccgacatcttcatctggatgatgagcaacaacaagcgtgtcgcctatgcccgtgtgccctccaaggacctgctcttctccatcgtggaggaggagactggcaaggactgcgccaaggtcaagacgctcttccttaagctgccagggaagcggggcttcggctcggcaggctggacagtgcaggccaaggtggagctgtacctgtggctgggcctcagcaaacagcgcaaggagttcctgtgcggcctgccctgtggcttccaggaggtcaaggcagcccagggcctgggcctgcatgccttcccacccgtcagcctggtctacaccaagaagcaggcgttccagctccgagcgcacatgtaccaggcccgcagcctctttgccgccgacagcagcggactctcagacccctttgcccgcgtcttcttcatcaatcagagtcagtgcacagaggtgctgaatgagaccctgtgtcccacctgggaccagatgctggtgttcgacaacctggagctctatggtgaagctcatgagctgagggacgatccgcccatcattgtcattgaaatctatgaccaggattccatgggcaaagctgacttcatgggccggaccttcgccaaacccctggtgaagatggcagacgaggcgtactgcccaccccgcttcccacctcagctcgagtactaccagatctaccgtggcaacgccacagctggagacctgctggcggccttcgagctgctgcagattggaccagcagggaaggctgacctgccccccatcaatggcccggtggacgtggaccgaggtcccatcatgcccgtgcccatgggcatccggcccgtgctcagcaagtaccgagtggaggtgctgttctggggcctacgggacctaaagcgggtgaacctggcccaggtggaccggccacgggtggacatcgagtgtgcagggaagggggtgcagtcgtccctgatccacaattataagaagaaccccaacttcaacaccctcgtcaagtggtttgaagtggacctcccagagaacgagctgctgcacccgcccttgaacatccgtgtggtggactgccgggccttcggtcgctacacactggtgggctcccatgccgtcagctccctgcgacgcttcatctaccggcccccagaccgctcggcccccagctggaacaccacggtcaggcttctccggcgctgccgtgtgctgtgcaatgggggctcctcctctcactccacaggggaggttgtggtgactatggagccagaggtacccatcaagaaactggagaccatggtgaagctggacgcgacttctgaagctgttgtcaaggtggatgtggctgaggaggagaaggagaagaagaagaagaagaagggcactgcggaggagccagaggaggaggagccagacgagagcatgctggactggtggtccaagtactttgcctccattgacaccatgaaggagcaacttcgacaacaagagccctctggaattgacttggaggagaaggaggaagtggacaataccgagggcctgaaggggtcaatgaagggcaaggagaaggcaagggctgccaaagaggagaagaagaagaaaactcagagctctggctctggccaggggtccgaggcccccgagaagaagaaacccaagattgatgagcttaaggtataccccaaagagctggagtccgagtttgataactttgaggactggctgcacactttcaacttgcttcggggcaagaccggggatgatgaggatggctccaccgaggaggagcgcattgtgggacgcttcaagggctccctctgcgtgtacaaagtgccactcccagaggacgtgtcccgggaagccggctacgactccacctacggcatgttccagggcatcccgagcaatgaccccatcaatgtgctggtccgagtctatgtggtccgggccacggacctgcaccctgctgacatcaacggcaaagctgacccctacatcgccatccggctaggcaagactgacatccgcgacaaggagaactacatctccaagcagctcaaccctgtctttgggaagtcctttgacatcgaggcctccttccccatggaatccatgctgacggtggctgtgtatgactgggacctggtgggcactgatgacctcattggggaaaccaagatcgacctggagaaccgcttctacagcaagcaccgcgccacctgcggcatcgcccagacctactccacacatggctacaatatctggcgggaccccatgaagcccagccagatcctgacccgcctctgcaaagacggcaaagtggacggcccccactttgggccccctgggagagtgaaggtggccaaccgcgtcttcactgggccctctgagattgaggacgagaacggtcagaggaagcccacagacgagcatgtggcgctgttggccctgaggcactgggaggacatcccccgcgcaggctgccgcctggtgccagagcatgtggagacgaggccgctgctcaaccccgacaagccgggcatcgagcagggccgcctggagctgtgggtggacatgttccccatggacatgccagcccctgggacgcctctggacatctcacctcggaagcccaagaagtacgagctgcgggtcatcatctggaacacagatgaggtggtcttggaggacgacgacttcttcacaggggagaagtccagtgacatcttcgtgagggggtggctgaagggccagcaggaggacaagcaggacacagacgtccactaccactccctcactggcgagggcaacttcaactggcgctacctgttccccttcgactacctggcggcggaggagaagatcgtcatctccaagaaggagtccatgttctcctgggacgagaccgagtacaagatccccgcgcggctcaccctgcagatctgggatgcggaccacttctccgctgacgacttcctgggggccatcgagctggacctgaaccggttcccgcggggcgcaaagacagccaagcagtgcaccatggagatggccaccggggaggtggacgtgcccctcgtgtccatcttcaagcaaaagcgcgtcaaaggctggtggcccctcctggcccgcaatgagaacgatgagtttgagctcacgggcaaggtggaggctgagctgcatttactgacagcagaggaggcagagaagaacccagtgggcctggcccgcaatgaacctgaccccctagagaaacccaaccggcccgacacggccttcgtctggttcctcaaccctctcaagtccatcaagtacctcatctgcacccggtacaagtggctcatcatcaagatcgtgctggcgctgttggggctgctcatgttggggctcttcctctacagcctccctggctacatggtcaaaaagctccttggggcatgaaggccgccagctcccgccagccgctccccagccctgccgcatttcctttcagtggcttggactctttcccatctcccctggggagcctgaggagcccagcgtccactcttcatgccttgggccgagcctgcctcctgcttgcgggggccgcctgtcctcactgccccaggctgcggcttgcccagtcccgcccctctgacccctgcctgtgggctggggagccttggatggggtggggacctggaatgggtctctcttgccccacctggctgaggcgccacccttcttcaggcccaggctccagaggaagactcctgaaaccctccccaggtcttccaagtacaggattgaagctttagtgaaattaaccaaggaccatgggtcagtgcccagggctttaaaaagaatgaacgagcaaaaggtatccccgccgtgacccctgcagatagcaccggtctttgatccgcagcaggggccagaccctgcccacaagtcccagcgcggctgcttctgccactgctgggctccacttggctcctctcacttcccagggggtcgcctgtcctgcctgtgggtttccatggcttcccagagctccctctgccccagccagcgcctccaggcccagctgaggagctgtgagaagcagcagaggggactccccatcccgggcacaccctgtcctcccacccctgcccccttgcccttccagccctttcagctgcagctgggagctggcccgtcaagtgctgcccctgcctgtgtctgggtttctgttggctgtttttcttttcttgagtggtgatttttctctaaataaaagaagtcaagcactg

SEQ ID NO: 162912 - DNA, 557 bp, Homo sapiens
  Payload ID: 12095
  Gene Symbol: OTOF
  Gene Name: otoferlin
  ENST ID: ENST00000426958
  CDS Start-End: 1-424
aaagcgggtgaacctggcccaggtggaccggccacgggtggacatcgagtgtgcagggaagggggtgcagtcgtccctgatccacaattataagaagaaccccaacttcaacaccctcgtcaagtggtttgaagtggacctcccagagaacgagctgctgcacccgcccttgaacatccgtgtggtggactgccgggccttcggtcgctacacactggtgggctcccatgccgtcagctccctgcgacgcttcatctaccggcccccagaccgctcggcccccagctggaacaccacgggggaggttgtggtgactatggagccagaggtacccatcaagaaactggagaccatggtgaagctggacgcggtaaggcgggtggggtcagccccctgctggctgggaacatgcaacttcgtgtgacacatcctgtgaaccagactatctgccccgagagaaaaggacactaagagcctcctttggcatgtgactgtcgggggctgagcttgattgtgtgtccaaacagctccctcctaatactatcctggaatgcaca

SEQ ID NO: 162913 - DNA, 4992 bp, Homo sapiens
  Payload ID: 12096
  Gene Symbol: OTOG
  Gene Name: otogelin
  Uniprot ID: Q6ZRI0
  ENST ID: ENST00000342528
  CDS Start-End: 285-4811
aggagacttccgagcccgtctctccctccatcctccagctgctgcccctgtagcccaggagcccatactgaggccccagggcctccgctcccatcttcttctcttccagctgctgcctgcccagcaggccaggtcttcgtgaactgcagcgacctgcacacggacctggagctgagcagggagaggacgtgtgagcagcaactgctgaacctgagcgtgtcagcccgtggcccctgcctctcgggctgcgcctgtccccagggtctgctcagacacggggatgcatgtttcctgccagaggagtgcccctgcacttggaaggggaaggagtatttccctggggaccaggtgatgtctccttgccatacctgagcacatcagatgtcagcttctctgtgattgtagagaatgtgaactgctacagctctggcatgatctgcaggaaatttatttccatcaacgttgggaactcactcattgtctttgatgatgactccggaaatcctagtccagagagcttcctggatgacaagcaggaggtccacacatggcgagtgggatttttcacactggtgcatttcccacaggagcacatcaccctcttgtgggaccagagaaccacagtgcacgtccaggctgggcctcagtggcagggccagctggcgggcctctgtgggaactttgacttaaaaaccatcaatgagatgaggaccccggagaacctagagctaactaacccccaggagtttggcagcagttgggctgcagttgagtgcccagacaccctcgatcctcgggatatgtgtgtcctgaatcctctccgagaaccatttgccaagaaggagtgcagcatcctgctcagtgaggtgtttgagatctgccaccctgtggttgatgtcacttggttttactcaaactgcctgacagacacatgtggctgcagccagggtggtgactgtgagtgcttctgtgccagcgtctccgcttatgcccaccagtgttgccagcatggggtggctgttgactggcgaaccccccgcctctgcctgctaggtaagggcccctatcagctatccagcttggcagccggtggtgctctggtgggcatgaaggcggtgggcgatgacatagtcctagtgaggacagaggatgtggcgccagcagacattgtgagcttcctgctgacagctgctctgtacaaggccaaggcccatgacccagatgtggtgtccctggaggcagcagacagacccaacttcttccttcacgtcacagccaacgggtctctggagctggctaagtggcagggccgtgacaccttccaacagcatgcctccttcttgctgcaccgggggacacggcaggcaggcctggtggccctggagtccctggccaagcccagctccttcctctatgtgtcgggcgcggtgctggccctgcggctgtacgaacacacagaggtgttccgccggggcacactcttccgccttctggatgccaagccctcgggggctgcctaccccatctgcgagtggcgctacgatgcctgtgccagcccctgcttccaaacctgccgggacccacgggcagccagctgccgggacgtacccagggtagaaggctgtgtccctgtgtgccccaccccccaggtcctggatgaagtcacacagagatgtgtctacttggaggactgtgtggagccagcagtttgggttcccacagaggcccttggcaatgagaccctccctcccagtcaagggttgcccactcccagtgatgaggagccacagctgtcacaggaaagccccaggacccccacccacaggccagccctcaccccagctgccccactcaccacagccctgaacccaccagtgacagccactgaggagccagtggtgtctccaggccccacccagaccaccctgcagcagccactggagctcactgcatctcaactccccgccggccccacggagtccccagccagcaagggagtgactgccagcctcctggccatcccccatacaccagagtcctcatccctccctgttgcactgcagacacccacacctggcatggtgtcaggtgccatggagacaacaagggtgactgtgatctttgcaggaagccctaacatcacagtctcctcccggtcgccccctgcccctcgcttcccgctcatgaccaaggctgtgacagtccgaggccatggctccttgcctgttaggacgacacccccacagccctccttgacagcaagtccctcctccagacctgtggcttcccctggagccatctccaggtcccccacctcctcgggatcccacaaggctgtgctgacacctgcagtaactaaggtcataagcaggacaggggtcccccagcccacccaggcccagagtgcttcaagtcccagcacccctctaactgtggctggaacagcagcagaacaggttcctgtcagtccccttgcaaccaggagcttggagatagtgctatccacagagaagggcgaagccgggcacagccagcccatgggctcgcctgcctccccacagccacacccactcccctctgcaccaccccgcccagcccagcataccaccatggccaccaggtctccagctctgcccccagagaccccagctgccgccagcctgtcaacagccactgatgggctggcagccacacccttcatgtcccttgagtcaactcgtccctcccagctcctctctggcctgcctcccgacaccagcctgcccctggccaaggtgggcacatctgccccagtggccacacccggccccaaagcctctgtcatcaccactccactccagccacaggccacgactctgcctgctcagacacttagcccagtactgcctttcactccagcagcaatgacccaggcgcacccacccactcacatagcacccccagcagcaggcacagctccaggcctgctgctgggagccacattgccaacctctggagtcctgcctgtggctgagggcacggcctccatggtatctgttgtcccacgaaagagcaccacagggaaggtggccatcctatccaagcaagtgtctctgcccacttccatgtatggttctgcagagggtgggcccacagagctcacgcctgctacgagccaccctctcacgcccttggtggctgagcccgagggagcccaggcaggcacagctctgccagtgcccacatcctatgccctgagccgtgtctcagccaggacggccccccaagacagcatgctggttctgttgcctcagctggctgaggcccatggaacctcggcagggcctcacctggcagcagagccggtggacgaggccaccacagaaccatctgggcgctcagccccagccctgagcatcgtagagggtttggcggaggctttggcaactaccactgaggccaatacatccaccacctgtgttccaatcgccgagcaggactgcgtccgccacatctgcctggagggccagctgattcgcgtgaatcagtcccagcactgtccccagggtgctgctccccctcgctgtgggatcctgggcctcgccgtgcgggtgggtggggaccgctgctgcccactctgggagtgtgcctgccggtgctcaatcttccctgacctgagcttcgtgaccttcgatgggagccacgtagctctgttcaaggaggccatctacatcctcagccagagcccagatgaaatgctcaccgtccatgtactggactgcaaaagtgccaacctggggcacctgaactggcccccgttctgtctggtgatgttgaacatgactcacttggcccatcaggtcactattgatcgcttcaaccgaaaggtgactgtggacttgcagcctgtgtggccaccggtgagcaggtatggattcagaattgaggacacaggccacatgtacatgatcctgactccctcagacatccagatccagtggctccacagctcaggactcatgatcgtggaggccagcaaaaccagcaaggcccagggccatggcctgtgcggtatctgtgatggagatgcagccaatgaccttaccctgaaggatggctcagtggtgggtggggctgaggaccctgctccctttctggacagctggcaggtgcccagctccctgacctcagtgggccagacccgcttccgcccagacagctgcgccacaactgactgctcgccctgccttcgcatggtgtccaaccgcaccttcagtgcctgccaccgctttgtgcctccggagtcattctgtgagctgtggatccgggacaccaagtacgtgcagcagccctgcgtggccctgactgtgtacgtggccatgtgccacaaatttcatgtgtgcatcgagtggcggcgctctgactactgccccttcctgtgctccagcgactccacataccaggcatgtgtgacagcctgtgagccacccaagacatgccaggatgggatactagggcctctggacccagagcactgccaggtgctgggcgagggctgcgtctgctccgagggcaccatcttacaccggcgccactctgcactctgcatcccggaggccaagtgcgcctgtggtgactgtccagactccatccccgaatgtcaagaaggggaggcgctcactgtgcacaggaataccacggaactctgctgccctctgtaccagtgtgtgtgtgagaacttccgctgtccccaagtgcagtgtggcctgggcactgccctggtggaggtgtggagccccgaccgctgctgcccctacaaatcctgtggataaaagaaggaaaaagcaagtttcccattccaaagagggtttccgtcttaaaaagtccttactgcggccgggcacggtggctcacacctgtaatcccagcactttgagaggccaaggcgggtggatcatgaggtcaggagttcaagaccagcctggccaagacggtgaaaccctgtgtctactg

SEQ ID NO: 162914 - DNA, 8778 bp, Homo sapiens
  Payload ID: 12096
  Gene Symbol: OTOG
  Gene Name: otogelin
  Uniprot ID: Q6ZRI0
  ENST ID: ENST00000399391
  CDS Start-End: 1-8778
atgggagtcctggcgtctgcgctctgctggctgctttgtgtctggctgccctggggtgagcaggcagccgagtccctgcgggtgcagcgcctcggtgagagggttgtggactcagggaggtcgggggctcgaggaatgagaaacgttaaaggaatgaggaatgggcccgcgcagactcgtgtttcctccagcagcagccaccaggaggcgacccttgccatgggggacaaggctacagtcgtgggaggccagcaggctgaagccccagactccgtggccatgtcttcctgggaaaggcggctccatcgggccaagtgtgcaccatcctacttgttctcctgcttcaatggaggcgagtgtgtgcacccagccttctgtgactgcagacgcttcaatgccactggaccgcgctgccagatggtgtacaatgccggccctgagagggacagcatttgccgggcgtgggggcagcaccacgtggagacatttgatgggctctactactacctctccggaaagggcagctacaccctggtgggtcgccatgagcccgagggacagagcttctccatccaggtacacaatgacccgcagtgtggctcttcaccctacacctgctccagggctgtcagcctcttctttgtgggtgagcaggagatccatctggccaaggaggtcacccatggaggcatgagggtccaactgccacatgtcatggggagcgcgcgtctgcagcagcttgccggctatgtcatcgtgcggcatcagtcagccttcacactggcctgggatggtgcctcggctgtctacatcaagatgagtccagagcttctgggctggacccatgggctgtgtgggaacaacaatgctgaccccaaggatgatctggtgaccagctctgggaagctgactgacgacgtggttgagtttgtgcacagctggcaggagcaggcccctaaccagcctccagggcccacaacttcctccctgcctcgcccaccgtgcctacagcagaacccaggaaccatgcagggcgtgtacgagcagtgtgaggctctactgcggcccccctttgacgcctgccacgcctacgtcagccctctgcccttcacagccagttgtaccagtgatctctgccaatcaatgggtgatgtagccacctggtgccgggcactggcggagtatgcccgggcgtgtgcccaggcagggcggcccttgcaaggctggaggacccagctccggcaatgcactgtgcactgcaaggagaaggcctttacctacaatgagtgcatcgcctgctgccctgcctcctgccatccccgggcatcctgtgtggacagtgagatcgcctgtgtggacggctgctattgccccaatgggctcatcttcgaggatgggggctgcgtggcaccagctgagtgtccctgtgagtttcacgggactctgtacccacctggctctgtggtgaaggaagactgcaatacttgcacatgcacctcaggcaagtgggagtgcagcacagctgtctgcccagctgagtgctcagtgactggtgacattcacttcacaacctttgatggccgccggtacacgttccccgccacatgtcagtacatcctggccaagagccgctcttcgggcaccttcaccgtgacattgcagaatgccccatgtggcctgaaccaagatggagcctgtgtccagtcagtgtcagtgattctgcaccaggaccctcggaggcaggtgaccctgacccaggcaggggatgtccttctgtttgaccagtacaagatcatcccgccatacacagatgatgcctttgagatccgtaggctgtcctccgtgttcctgcgggtgaggacgaacgtgggcgtgcgggtgctctacgaccgtgaagggctccgactgtacctgcaagtggaccagcgatgggtggaggataccgtgggcctctgcggcaccttcaatggcaacacgcaggatgacttcctgtctccagtgggtgtacctgagagcaccccacaactttttggcaattcctggaaaacactttctgcttgctccccgctggtctctggctcccctctggacccctgcgatgtgcacctgcaagccgcctcctactcagtgcaggcctgcagcgtgctcacgggggagatgtttgcgccctgctctgcgttcctgagccccgtgccctactttgagcagtgccgcagggatgcctgccgctgcgggcagccctgcctgtgcgccacactggcccactacgcccacctgtgccggcgccatgggctccccgttgatttccgcgcccgcctgccagcctgtgcactgtcctgtgaggcctccaaggagtatagcccctgcgtggccccgtgtggacgtacctgccaggacctggccagccctgaggcctgtggggttgatggtggcgatgacctgagcagagacgagtgtgtggagggctgtgcctgcccaccggacacctatctggacacccaggctgacctctgtgtcccccggaaccagtgctcctgccacttccagggagtggactatccccccggagacagtgacatcccatccctgggccactgccactgcaaagatggagtcatgagctgtgatagcagagccccagctgctgcctgcccagcaggccaggtcttcgtgaactgcagcgacctgcacacggacctggagctgagcagggagaggacgtgtgagcagcaactgctgaacctgagcgtgtcagcccgtggcccctgcctctcgggctgcgcctgtccccagggtctgctcagacacggggatgcatgtttcctgccagaggagtgcccctgcacttggaaggggaaggagtatttccctggggaccaggtgatgtctccttgccatacctgtgtgtgccagcggggctcattccagtgcaccctgcacccttgcgcctccacctgcactgcctatggggaccggcattaccgcacgtttgatgggctcccgtttgacttcgtgggggcatgcaaagtgcacctggtcaagagcacatcagatgtcagcttctctgtgattgtagagaatgtgaactgctacagctctggcatgatctgcaggaaatttatttccatcaacgttgggaactcactcattgtctttgatgatgactccggaaatcctagtccagagagcttcctggatgacaagcaggaggtccacacatggcgagtgggatttttcacactggtgcatttcccacaggagcacatcaccctcttgtgggaccagagaaccacagtgcacgtccaggctgggcctcagtggcagggccagctggcgggcctctgtgggaactttgacttaaaaaccatcaatgagatgaggaccccggagaacctagagctaactaacccccaggagtttggcagcagttgggctgcagttgagtgcccagacaccctcgatcctcgggatatgtgtgtcctgaatcctctccgagaaccatttgccaagaaggagtgcagcatcctgctcagtgaggtgtttgagatctgccaccctgtggttgatgtcacttggttttactcaaactgcctgacagacacatgtggctgcagccagggtggtgactgtgagtgcttctgtgccagcgtctccgcttatgcccaccagtgttgccagcatggggtggctgttgactggcgaaccccccgcctctgcccgtatgactgtgacttctttaacaaagtgctaggtaagggcccctatcagctatccagcttggcagccggtggtgctctggtgggcatgaaggcggtgggcgatgacatagtcctagtgaggacagaggatgtggcgccagcagacattgtgagcttcctgctgacagctgctctgtacaaggccaaggcccatgacccagatgtggtgtccctggaggcagcagacagacccaacttcttccttcacgtcacagccaacgggtctctggagctggctaagtggcagggccgtgacaccttccaacagcatgcctccttcttgctgcaccgggggacacggcaggcaggcctggtggccctggagtccctggccaagcccagctccttcctctatgtgtcgggcgcggtgctggccctgcggctgtacgaacacacagaggtgttccgccggggcacactcttccgccttctggatgccaagccctcgggggctgcctaccccatctgcgagtggcgctacgatgcctgtgccagcccctgcttccaaacctgccgggacccacgggcagccagctgccgggacgtacccagggtagaaggctgtgtccctgtgtgccccaccccccaggtcctggatgaagtcacacagagatgtgtctacttggaggactgtgtggagccagcagtttgggttcccacagaggcccttggcaatgagaccctccctcccagtcaagggttgcccactcccagtgatgaggagccacagctgtcacaggaaagccccaggacccccacccacaggccagccctcaccccagctgccccactcaccacagccctgaacccaccagtgacagccactgaggagccagtggtgtctccaggccccacccagaccaccctgcagcagccactggagctcactgcatctcaactccccgccggccccacggagtccccagccagcaagggagtgactgccagcctcctggccatcccccatacaccagagtcctcatccctccctgttgcactgcagacacccacacctggcatggtgtcaggtgccatggagacaacaagggtgactgtgatctttgcaggaagccctaacatcacagtctcctcccggtcgccccctgcccctcgcttcccgctcatgaccaaggctgtgacagtccgaggccatggctccttgcctgttaggacgacacccccacagccctccttgacagcaagtccctcctccagacctgtggcttcccctggagccatctccaggtcccccacctcctcgggatcccacaaggctgtgctgacacctgcagtaactaaggtcataagcaggacaggggtcccccagcccacccaggcccagagtgcttcaagtcccagcacccctctaactgtggctggaacagcagcagaacaggttcctgtcagtccccttgcaaccaggagcttggagatagtgctatccacagagaagggcgaagccgggcacagccagcccatgggctcgcctgcctccccacagccacacccactcccctctgcaccaccccgcccagcccagcataccaccatggccaccaggtctccagctctgcccccagagaccccagctgccgccagcctgtcaacagccactgatgggctggcagccacacccttcatgtcccttgagtcaactcgtccctcccagctcctctctggcctgcctcccgacaccagcctgcccctggccaaggtgggcacatctgccccagtggccacacccggccccaaagcctctgtcatcaccactccactccagccacaggccacgactctgcctgctcagacacttagcccagtactgcctttcactccagcagcaatgacccaggcgcacccacccactcacatagcacccccagcagcaggcacagctccaggcctgctgctgggagccacattgccaacctctggagtcctgcctgtggctgagggcacggcctccatggtatctgttgtcccacgaaagagcaccacagggaaggtggccatcctatccaagcaagtgtctctgcccacttccatgtatggttctgcagagggtgggcccacagagctcacgcctgctacgagccaccctctcacgcccttggtggctgagcccgagggagcccaggcaggcacagctctgccagtgcccacatcctatgccctgagccgtgtctcagccaggacggccccccaagacagcatgctggttctgttgcctcagctggctgaggcccatggaacctcggcagggcctcacctggcagcagagccggtggacgaggccaccacagaaccatctgggcgctcagccccagccctgagcatcgtagagggtttggcggaggctttggcaactaccactgaggccaatacatccaccacctgtgttccaatcgccgagcaggactgcgtccgccacatctgcctggagggccagctgattcgcgtgaatcagtcccagcactgtccccagggtgctgctccccctcgctgtgggatcctgggcctcgccgtgcgggtgggtggggaccgctgctgcccactctgggagtgtgcctgccggtgctcaatcttccctgacctgagcttcgtgaccttcgatgggagccacgtagctctgttcaaggaggccatctacatcctcagccagagcccagatgaaatgctcaccgtccatgtactggactgcaaaagtgccaacctggggcacctgaactggcccccgttctgtctggtgatgttgaacatgactcacttggcccatcaggtcactattgatcgcttcaaccgaaaggtgactgtggacttgcagcctgtgtggccaccggtgagcaggtatggattcagaattgaggacacaggccacatgtacatgatcctgactccctcagacatccagatccagtggctccacagctcaggactcatgatcgtggaggccagcaaaaccagcaaggcccagggccatggcctgtgcggtatctgtgatggagatgcagccaatgaccttaccctgaaggatggctcagtggtgggtggggctgaggaccctgctccctttctggacagctggcaggtgcccagctccctgacctcagtgggccagacccgcttccgcccagacagctgcgccacaactgactgctcgccctgccttcgcatggtgtccaaccgcaccttcagtgcctgccaccgctttgtgcctccggagtcattctgtgagctgtggatccgggacaccaagtacgtgcagcagccctgcgtggccctgactgtgtacgtggccatgtgccacaaatttcatgtgtgcatcgagtggcggcgctctgactactgccccttcctgtgctccagcgactccacataccaggcatgtgtgacagcctgtgagccacccaagacatgccaggatgggatactagggcctctggacccagagcactgccaggtgctgggcgagggctgcgtctgctccgagggcaccatcttacaccggcgccactctgcactctgcatcccggaggccaagtgcgcctgcactgacagcatgggggtgccgagggccctgggggagacctggaacagctccctcagcggctgctgccagcaccagtgccaagccccagacaccattgtcccggtggatctgggctgccccagtccccgccctgagagctgcctgcgattcggggaggtggccttgctcctacccaccaaggacccctgctgcctggggactgtctgtgtgtgtaaccagactctgtgtgagggtctcgcccccacatgccgcccaggccaccgcctcctcacccacttccaggaggactcctgctgccccagctacagctgtgagtgtgacccagatctctgtgaggcagagctggtccccagctgccgacaggaccagatcctgatcacgggccgcctgggggactcctgctgcacctcctacttctgcgcctgtggtgactgtccagactccatccccgaatgtcaagaaggggaggcgctcactgtgcacaggaataccacggaactctgctgccctctgtaccagtgtgtgtgtgagaacttccgctgtccccaagtgcagtgtggcctgggcactgccctggtggaggtgtggagccccgaccgctgctgcccctacaaatcctgtgaatgtgactgtgacacaatcccggtgccccggtgccatctgtgggagaaatcccagctggatgaggagttcatgcacagcgtggagaatgtgtgtggctgcgccaagtacgagtgtgtgaaggccccggtgtgtctgagccgcgagctgggtgtgatgcagcccggccagacagtggtggagctctcagcagatggcgtgtgccacacctcccgctgcaccaccgtgctcgaccctctcaccaacttctaccagatcaacaccacctccgtgctctgtgacatccactgtgaggcgaaccaggagtacgagcacccgcgggacctcgctgcctgctgcggctcctgcaggaacgtgtcctgtctcttcaccttccccaatggcaccacctccctgttcttgcccggggcatcctggatcgcagactgcgcccgccaccactgcagcagcacgcccctgggtgccgtgctggtccgctctcccataagctgcccaccgctcaatgagactgagtgtgccaaggttgggggttccgtggtaccttccttggaaggatgctgcaggacctgtaaggaggatgggcgctcctgcaagaaggtgaccatccgcatgaccatccgcaagaatgaatgcaggagcagcacccctgtgaacctagtgtcctgcgatgggaggtgcccatccgccagcatctacaactacaacatcaacacctatgcccgattctgcaagtgctgccgtgaggtgggcctgcagcggcgctctgtgcagctcttctgtgccaccaatgccacctgggtgccctatacagtgcaggagcccaccgactgtgcctgccagtggtcctga

SEQ ID NO: 162915 - DNA, 9948 bp, Homo sapiens
  Payload ID: 12096
  Gene Symbol: OTOG
  Gene Name: otogelin
  ENST ID: ENST00000399397
  CDS Start-End: 1-8742
atgggagtcctggcgtctgcgctctgctggctgctttgtgtctggctgccctggggtgagcaggcagccgagtccctgcgggtgcagcgcctcgccgcagcacccgttctgtggggcagtgcagagccacagccagagccagccgggcaacccagcagcagccaccaggaggcgacccttgccatgggggacaaggctacagtcgtgggaggccagcaggctgaagccccagactccgtggccatgtcttcctgggaaaggcggctccatcgggccaagtgtgcaccatcctacttgttctcctgcttcaatggaggcgagtgtgtgcacccagccttctgtgactgcagacgcttcaatgccactggaccgcgctgccagatggtgtacaatgccggccctgagagggacagcatttgccgggcgtgggggcagcaccacgtggagacatttgatgggctctactactacctctccggaaagggcagctacaccctggtgggtcgccatgagcccgagggacagagcttctccatccaggtacacaatgacccgcagtgtggctcttcaccctacacctgctccagggctgtcagcctcttctttgtgggtgagcaggagatccatctggccaaggaggtcacccatggaggcatgagggtccaactgccacatgtcatggggagcgcgcgtctgcagcagcttgccggctatgtcatcgtgcggcatcagtcagccttcacactggcctgggatggtgcctcggctgtctacatcaagatgagtccagagcttctgggctggacccatgggctgtgtgggaacaacaatgctgaccccaaggatgatctggtgaccagctctgggaagctgactgacgacgtggttgagtttgtgcacagctggcaggagcaggcccctaaccagcctccagggcccacaacttcctccctgcctcgcccaccgtgcctacagcagaacccaggaaccatgcagggcgtgtacgagcagtgtgaggctctactgcggcccccctttgacgcctgccacgcctacgtcagccctctgcccttcacagccagttgtaccagtgatctctgccaatcaatgggtgatgtagccacctggtgccgggcactggcggagtatgcccgggcgtgtgcccaggcagggcggcccttgcaaggctggaggacccagctccggcaatgcactgtgcactgcaaggagaaggcctttacctacaatgagtgcatcgcctgctgccctgcctcctgccatccccgggcatcctgtgtggacagtgagatcgcctgtgtggacggctgctattgccccaatgggctcatcttcgaggatgggggctgcgtggcaccagctgagtgtccctgtgagtttcacgggactctgtacccacctggctctgtggtgaaggaagactgcaatacttgcacatgcacctcaggcaagtgggagtgcagcacagctgtctgcccagctgagtgctcagtgactggtgacattcacttcacaacctttgatggccgccggtacacgttccccgccacatgtcagtacatcctggccaagagccgctcttcgggcaccttcaccgtgacattgcagaatgccccatgtggcctgaaccaagatggagcctgtgtccagtcagtgtcagtgattctgcaccaggaccctcggaggcaggtgaccctgacccaggcaggggatgtccttctgtttgaccagtacaagatcatcccgccatacacagatgatgcctttgagatccgtaggctgtcctccgtgttcctgcgggtgaggacgaacgtgggcgtgcgggtgctctacgaccgtgaagggctccgactgtacctgcaagtggaccagcgatgggtggaggataccgtgggcctctgcggcaccttcaatggcaacacgcaggatgacttcctgtctccagtgggtgtacctgagagcaccccacaactttttggcaattcctggaaaacactttctgcttgctccccgctggtctctggctcccctctggacccctgcgatgtgcacctgcaagccgcctcctactcagtgcaggcctgcagcgtgctcacgggggagatgtttgcgccctgctctgcgttcctgagccccgtgccctactttgagcagtgccgcagggatgcctgccgctgcgggcagccctgcctgtgcgccacactggcccactacgcccacctgtgccggcgccatgggctccccgttgatttccgcgcccgcctgccagcctgtgcactgtcctgtgaggcctccaaggagtatagcccctgcgtggccccgtgtggacgtacctgccaggacctggccagccctgaggcctgtggggttgatggtggcgatgacctgagcagagacgagtgtgtggagggctgtgcctgcccaccggacacctatctggacacccaggctgacctctgtgtcccccggaaccagtgctcctgccacttccagggagtggactatccccccggagacagtgacatcccatccctgggccactgccactgcaaagatggagtcatgagctgtgatagcagagccccagctgctgcctgcccagcaggccaggtcttcgtgaactgcagcgacctgcacacggacctggagctgagcagggagaggacgtgtgagcagcaactgctgaacctgagcgtgtcagcccgtggcccctgcctctcgggctgcgcctgtccccagggtctgctcagacacggggatgcatgtttcctgccagaggagtgcccctgcacttggaaggggaaggagtatttccctggggaccaggtgatgtctccttgccatacctgtgtgtgccagcggggctcattccagtgcaccctgcacccttgcgcctccacctgcactgcctatggggaccggcattaccgcacgtttgatgggctcccgtttgacttcgtgggggcatgcaaagtgcacctggtcaagagcacatcagatgtcagcttctctgtgattgtagagaatgtgaactgctacagctctggcatgatctgcaggaaatttatttccatcaacgttgggaactcactcattgtctttgatgatgactccggaaatcctagtccagagagcttcctggatgacaagcaggaggtccacacatggcgagtgggatttttcacactggtgcatttcccacaggagcacatcaccctcttgtgggaccagagaaccacagtgcacgtccaggctgggcctcagtggcagggccagctggcgggcctctgtgggaactttgacttaaaaaccatcaatgagatgaggaccccggagaacctagagctaactaacccccaggagtttggcagcagttgggctgcagttgagtgcccagacaccctcgatcctcgggatatgtgtgtcctgaatcctctccgagaaccatttgccaagaaggagtgcagcatcctgctcagtgaggtgtttgagatctgccaccctgtggttgatgtcacttggttttactcaaactgcctgacagacacatgtggctgcagccagggtggtgactgtgagtgcttctgtgccagcgtctccgcttatgcccaccagtgttgccagcatggggtggctgttgactggcgaaccccccgcctctgcccgtatgactgtgacttctttaacaaagtgctaggtaagggcccctatcagctatccagcttggcagccggtggtgctctggtgggcatgaaggcggtgggcgatgacatagtcctagtgaggacagaggatgtggcgccagcagacattgtgagcttcctgctgacagctgctctgtacaaggccaaggcccatgacccagatgtggtgtccctggaggcagcagacagacccaacttcttccttcacgtcacagccaacgggtctctggagctggctaagtggcagggccgtgacaccttccaacagcatgcctccttcttgctgcaccgggggacacggcaggcaggcctggtggccctggagtccctggccaagcccagctccttcctctatgtgtcgggcgcggtgctggccctgcggctgtacgaacacacagaggtgttccgccggggcacactcttccgccttctggatgccaagccctcgggggctgcctaccccatctgcgagtggcgctacgatgcctgtgccagcccctgcttccaaacctgccgggacccacgggcagccagctgccgggacgtacccagggtagaaggctgtgtccctgtgtgccccaccccccaggtcctggatgaagtcacacagagatgtgtctacttggaggactgtgtggagccagcagtttgggttcccacagaggcccttggcaatgagaccctccctcccagtcaagggttgcccactcccagtgatgaggagccacagctgtcacaggaaagccccaggacccccacccacaggccagccctcaccccagctgccccactcaccacagccctgaacccaccagtgacagccactgaggagccagtggtgtctccaggccccacccagaccaccctgcagcagccactggagctcactgcatctcaactccccgccggccccacggagtccccagccagcaagggagtgactgccagcctcctggccatcccccatacaccagagtcctcatccctccctgttgcactgcagacacccacacctggcatggtgtcaggtgccatggagacaacaagggtgactgtgatctttgcaggaagccctaacatcacagtctcctcccggtcgccccctgcccctcgcttcccgctcatgaccaaggctgtgacagtccgaggccatggctccttgcctgttaggacgacacccccacagccctccttgacagcaagtccctcctccagacctgtggcttcccctggagccatctccaggtcccccacctcctcgggatcccacaaggctgtgctgacacctgcagtaactaaggtcataagcaggacaggggtcccccagcccacccaggcccagagtgcttcaagtcccagcacccctctaactgtggctggaacagcagcagaacaggttcctgtcagtccccttgcaaccaggagcttggagatagtgctatccacagagaagggcgaagccgggcacagccagcccatgggctcgcctgcctccccacagccacacccactcccctctgcaccaccccgcccagcccagcataccaccatggccaccaggtctccagctctgcccccagagaccccagctgccgccagcctgtcaacagccactgatgggctggcagccacacccttcatgtcccttgagtcaactcgtccctcccagctcctctctggcctgcctcccgacaccagcctgcccctggccaaggtgggcacatctgccccagtggccacacccggccccaaagcctctgtcatcaccactccactccagccacaggccacgactctgcctgctcagacacttagcccagtactgcctttcactccagcagcaatgacccaggcgcacccacccactcacatagcacccccagcagcaggcacagctccaggcctgctgctgggagccacattgccaacctctggagtcctgcctgtggctgagggcacggcctccatggtatctgttgtcccacgaaagagcaccacagggaaggtggccatcctatccaagcaagtgtctctgcccacttccatgtatggttctgcagagggtgggcccacagagctcacgcctgctacgagccaccctctcacgcccttggtggctgagcccgagggagcccaggcaggcacagctctgccagtgcccacatcctatgccctgagccgtgtctcagccaggacggccccccaagacagcatgctggttctgttgcctcagctggctgaggcccatggaacctcggcagggcctcacctggcagcagagccggtggacgaggccaccacagaaccatctgggcgctcagccccagccctgagcatcgtagagggtttggcggaggctttggcaactaccactgaggccaatacatccaccacctgtgttccaatcgccgagcaggactgcgtccgccacatctgcctggagggccagctgattcgcgtgaatcagtcccagcactgtccccagggtgctgctccccctcgctgtgggatcctgggcctcgccgtgcgggtgggtggggaccgctgctgcccactctgggagtgtgcctgccggtgctcaatcttccctgacctgagcttcgtgaccttcgatgggagccacgtagctctgttcaaggaggccatctacatcctcagccagagcccagatgaaatgctcaccgtccatgtactggactgcaaaagtgccaacctggggcacctgaactggcccccgttctgtctggtgatgttgaacatgactcacttggcccatcaggtcactattgatcgcttcaaccgaaaggtgactgtggacttgcagcctgtgtggccaccggtgagcaggtatggattcagaattgaggacacaggccacatgtacatgatcctgactccctcagacatccagatccagtggctccacagctcaggactcatgatcgtggaggccagcaaaaccagcaaggcccagggccatggcctgtgcggtatctgtgatggagatgcagccaatgaccttaccctgaaggatggctcagtggtgggtggggctgaggaccctgctccctttctggacagctggcaggtgcccagctccctgacctcagtgggccagacccgcttccgcccagacagctgcgccacaactgactgctcgccctgccttcgcatggtgtccaaccgcaccttcagtgcctgccaccgctttgtgcctccggagtcattctgtgagctgtggatccgggacaccaagtacgtgcagcagccctgcgtggccctgactgtgtacgtggccatgtgccacaaatttcatgtgtgcatcgagtggcggcgctctgactactgccccttcctgtgctccagcgactccacataccaggcatgtgtgacagcctgtgagccacccaagacatgccaggatgggatactagggcctctggacccagagcactgccaggtgctgggcgagggctgcgtctgctccgagggcaccatcttacaccggcgccactctgcactctgcatcccggaggccaagtgcgcctgcactgacagcatgggggtgccgagggccctgggggagacctggaacagctccctcagcggctgctgccagcaccagtgccaagccccagacaccattgtcccggtggatctgggctgccccagtccccgccctgagagctgcctgcgattcggggaggtggccttgctcctacccaccaaggacccctgctgcctggggactgtctgtgtgtgtaaccagactctgtgtgagggtctcgcccccacatgccgcccaggccaccgcctcctcacccacttccaggaggactcctgctgccccagctacagctgtgagtgtgacccagatctctgtgaggcagagctggtccccagctgccgacaggaccagatcctgatcacgggccgcctgggggactcctgctgcacctcctacttctgcgcctgtggtgactgtccagactccatccccgaatgtcaagaaggggaggcgctcactgtgcacaggaataccacggaactctgctgccctctgtaccagtgtgtgtgtgagaacttccgctgtccccaagtgcagtgtggcctgggcactgccctggtggaggtgtggagccccgaccgctgctgcccctacaaatcctgtgaatgtgactgtgacacaatcccggtgccccggtgccatctgtgggagaaatcccagctggatgaggagttcatgcacagcgtggagaatgtgtgtggctgcgccaagtacgagtgtgtgaaggccccggtgtgtctgagccgcgagctgggtgtgatgcagcccggccagacagtggtggagctctcagcagatggcgtgtgccacacctcccgctgcaccaccgtgctcgaccctctcaccaacttctaccagatcaacaccacctccgtgctctgtgacatccactgtgaggcgaaccaggagtacgagcacccgcgggacctcgctgcctgctgcggctcctgcaggaacgtgtcctgtctcttcaccttccccaatggcaccacctccctgttcttgcccggggcatcctggatcgcagactgcgcccgccaccactgcagcagcacgcccctgggtgccgtgctggtccgctctcccataagctgcccaccgctcaatgagactgagtgtgccaaggttgggggttccgtggtaccttccttggaaggatgctgcaggacctgtaaggaggatgggcgctcctgcaagaaggtgaccatccgcatgaccatccgcaagaatgaatgcaggagcagcacccctgtgaacctagtgtcctgcgatgggaggtgcccatccgccagcatctacaactacaacatcaacacctatgcccgattctgcaagtgctgccgtgaggtgggcctgcagcggcgctctgtgcagctcttctgtgccaccaatgccacctgggtgccctatacagtgcaggagcccaccgactgtgcctgccagtggtcctgaggcctgggggcccgggctagctggaccacctctgccagccccactttctgtttccagctggcccaatgtgaatgggggtattaaaggtggtagaaatctggcacgtgttgagcatggaatggtgggaagaggtcacaggagtaaccagaaagggtcacccctgcccatcctggctccctttctgggctccccattttccgcacatgggaaagtgccacagttgagggctcagggagctcacctctgtccctggtttgagatggaaaatgggctttaggtccaggggcagcagcctctgaacctctgtgaccctggccacagctcttggtggagggggtgagagctgtgggaagatgggaaggtgcatggtgcttacatgggaaccacagctggacccaagaccaagcacaggggcaggatgcagtggcccattctcttggcctttttgactacacaagaaaccagacacagtaaaaggaaagagggctatacctgcaacactcaggcctgcagatggctgcccagaaggagttcccaaagacaaagatggtggattctagggcccaggttgtctcaccaagatctgtgaaatcagagtgagctcagtgaccttcgcatctcctgtagtccaaagaaaggtgcctggtgtcctggtattgatatggtaattcaggaaaggatttggaagacctaagcctgtacccttaccccaaggcaaccttcccagcaggcaggccggccttgtgaggcggtgctgggggagtgaaaccctcagtgagggcccagcactacttatctaggatgctggttgacagcccatgccttcaaggccctaggttgctgagggggtaccttcagcctgcaaatgcagctccaggctttgcagtgtgccttttctccaaggccatgacagagtcgggctcagaggagcctgattatgggttgtgtggctcagccagtgccagtctctgtgctccatgggactgtttagcaagagagtgtctgttggtgtcagtggaaaacacagccccagcctccctgagcacttgtgagatccttgtcactgaaccagagcgtcccctaaagccagggccagcgtccccttccacaccccactctgcaagtctcccaccccctgtgccactttgtgccacgtggaaccgaagggcatgaacataaggttgtgcaggccccagcactgccctg

SEQ ID NO: 162916 - DNA, 282 bp, Homo sapiens
  Payload ID: 12096
  Gene Symbol: OTOG
  Gene Name: otogelin
  ENST ID: ENST00000428619
  CDS Start-End: 1-282
gccatgggggacaaggctacagtcgtgggaggccaggctgaagccccagactccgtggccatgtcttcctgggaaaggcggctccatcgggccaagtgtgcaccatcctacttgttctcctgcttcaatggaggcgagtgtgtgcacccagccttctgtgactgcagacgcttcaatgccactggaccgcgctgccagatggtgtacaatgccggccctgagagggacagcatttgccgggcgtgggggcagcaccacgtggagacatttgatgggctctac

SEQ ID NO: 162917 - DNA, 3289 bp, Homo sapiens
  Payload ID: 12097
  Gene Symbol: OTOGL
  Gene Name: otogelin-like
  ENST ID: ENST00000298820
  CDS Start-End: 1-2258
gtgaaattatagttgctcatatcgaaaaatgttccatgaatcagaatggaaactccttaaaaaagctagctccctctggaagaatctctggactttgttttaagaagttaaatgtgacaacacccatacataaaataattgtcaatcggttggcaagaaaggtagaagtggattccattgttgtgcctttgcccttttcaagtcaggaactgtccatagaggattctggttcaatgtatgtaattactactccagctggactaatcataaagtggtctcatcttacaggaatcatagacattcattttggcttccgatttaacttgtcatcctacacagaaggactctgtggaatttgcaatgaagatccggatgatgatctaaggatgcaaaatggcacaattattacaaatatggaagacataggattatttattgagagctgggaaattgagaaatcatttgaagtaacaatgagaagacctgttaggaattgtactgagcatgattgcagccagtgcattgatttattaaatagaagaattttcattccatgtcatgataaagtttcaccggaagacttttgtgaaaagatgtggatcaattatacctatttttggaactatgaatgtgatgcactttctgcatatgtggctctgtgcaacaagtttgatatctgtattcagtggagaacacctgattactgctccctgagttgcccagaggggaaggaatatcaaccctgtgtgcgaccttgtgaagcaagaacatgcctgaaccaatggttctatggacacacttcctgtttgaatctaagagaagactgtgtgtgcaaagttggaactattcttcacaggccacattcagcccagtgcattccagagaaagagtgtgcatgcactgatagtgaagaccaaccccgcactgctggggagatttggaatgggggcattgatgaatgcactctatacaaatgtttggagaatggaagcattatccctatagaacctgactgtgatgaagagcccacgccagtttgtgaacgagaagctgaagttgtcatgggcatcattgataaatggacctgctgttcaaaggaagtttgtggatgtgacacgactttgtgtgaaactagcattccaacatgtacaaatagtcaaaaattgattgttggccacagtcctctttcttgctgtccacagtacaaatgtgaatgtgacccattgaaatgccccagtatttcaacaccagaatgcagagaagatcaattcatgattcaagttcgacaggaagaaccttgttgtttttcccctttttgtgtttgtgaatcttgcaccaaacctgttccactatgtcatgatggggaatttctcacagtagatcttaatagcacacacttctgttgtcctcagtattactgtgtatgtgaaccaaacctttgtcctatgccattactcaactgtgcagaagatatgaatcttgtgaaagaaaatgtatctggtcaatgttgcccaacatggcactgtgaaaaggatgatgtgtgtgtatttcaagaagtatcagtattgaatcctggacaatccatgataaagtatttggaagaagacttttgttatgctatagagtgtctggaagaaaaagataaccatacgggctttcacactctgaattttacactggtgaattgttcaaaaaaatgtgatgttcaccaggtatatactccatccccaagtgattatggttgttgtggtacctgcaaaaatgtatcctgcaaatttcacatggaaaatggaacatcagttgtatacgcggtagggagtacctggcactacaattgcaccacatatgaatgtgttaaaactgatgaaggagcaataattctgaactacacaatggtctgtcccccttttaatgagactgaatgcaaaatgaatgaagggattgtgaagctttataatgaaggctgttgcaagatctgcaaacgagaagaaagaatatgccagaaagtgatcattaaatcggtcataaggaaacaggactgtatgagccaaagccctataaatgttgcatcttgtgacggcaaatgcccatcagctaccatatataacatcaatattgaaagtcacctaagattctgcaagtgttgtcgtgaaaatggagtacgaaacttgtctgtgcctctgtattgctcaggaaatggcactgaaattatgtacactctccaggaacccatagactgtacgtgccagtggaattaaacccttgggttccaagagctctatacaacatcataacgtcagatagaattaacttttattgctattacttaggcatgtggcagatttatgctgtttaacaatactgtatttttcagacttggaatgtggaaatttagcaatttgtacaaaatatatacagtttcaatagcaaaattaaatttattgctttactctattttagaaaatcaaatgactgtaagttgttcagctgaaatgctgttatgtatttaattacaacttggtgcagatacagtatattctcatcaactggaaggttattttgcaaaattccttcaatttcactcagtagctctttttttcttaatttgcaaagtctgctatagctatccaaattaaggtaccctttaatatgtactccttaatctggtaaatgtgatcagttaaaattgtcatctagatagcaataaagagtgatatgcttagagatagataatggattatttaaaacctgaatggtttatagagaagtcattataaattcccctcattttgcaggtgtaacagataaccagagaagctgtgtgactcgtacaaatttattcagtgtaataatatagtaaattcatgttaacagttggattaaatcctagctctctcttattccagtactatatcacttttaaaatcctgagcagtatgtagtaagagtatatcacagaatctttcattcttaaagagtttgcattggatagaattaagtattttaagtttaacatatttgaaaaatgccccccatacattgttattccaatagtaaggagcagggaaatatagcatcatttgctaaatagaggagatagatcttgaactgttattttttatataattaaaactgctattaaatgtgttgtcagtatttaacatttagttactgtctcattaatatttaattttgaggatgtacttgcatactgttgaagttgagtgctgttttgctgttaatgctgctgctttgccaatgaagaatgaaataaatttatctgaatgta

SEQ ID NO: 162918 - DNA, 8083 bp, Homo sapiens
  Payload ID: 12097
  Gene Symbol: OTOGL
  Gene Name: otogelin-like
  ENST ID: ENST00000458043
  CDS Start-End: 7-7041
aatttaatgataccttggagtatattcttgcttcatgtactgctgttttcattacaagaatatatttgtgcatcgtctatattgatgggaacatcaaaaaacgggtttaatgaaaatcgacagaaaagagctcttttagcagcacagtttgaagctacttctccgagatactttttccatgatgctattaattggggtgagagcaaaataaaaggttcttgtccttatgaatgccttaatggagctttctgttctaagactggaacatgtgactgtcaaatatttcaggctcttgggacaagatgccagatcatcccaaacatgggcaacggcagagatgggatttgtaaaacctggggacagtatcattttgaaacattcgatggcatctactattacttcccaggaaactgttcttacatttttgcaaaggactgtggtgatttggagcctcggtacactgtatgggttcataacagccctaaatgccttggttcggtgtattcttgttatcggtcaatcagcttgttcttttcaaaccaagaggaaattcgaatttatggtcatgaaataaaaaagaatggaatcagtttaacattgcctcagacaattggacagattttcattgagaaactagctgactacattcttgtgaaaacaacctttggcttttcattggcttgggacgggatatctgggatctacctcaagctgtctgaggaccataaggggaaatcatgtggcctatgtggaaactacaatgacattcaatctgatgatttcataattctgcaagaggactatacagaagacatcgctatgtttgcaaatagttggtcggtgcaaactccagatgacaccaaatgtgtactcacaccctcagattttccaaatccgtgctccagtggaatgccagcatttgaggcaatcttcttcaagtgtcagatactgttgcagtttccttttctgagctgccatgagtatatcgatccatacttatatattgccagctgtgttaatgatctttgcaaaactgatgatgatgaaacctattgccgagcagccactgagtatgctagagcctgctctcatgctggctaccctattcaagactggagagatgactttccagcatgcactgataaatgtgatgatagctttgtccatcgggactgtatcagttgttgtccaccaacctgcacatttgagaagcaatgtcttgggagcaatctccattgtcttgatggatgttactgcccagatggcctcgtaatggacaatgggacttgcatctccttggaaaattgcccatgcggttttcatggattagcttattcagttggttcaaaaattgaacaagaatgtactgaatgtgtgtgtgttggtggagtttggaactgcactgagcaagactgtccagttcaatgctcagttgtaggtgattctcactttacaacttttgatggtcgacattattcttttattggcatgtgccaatacatcctcgtgaaaggaactggaaaagataaattcacgattactttacagaaagctccctgtgagcagaatcttggcttggtctgccttcagtctataactctgattctggaggatgattttaacaaacaagtgacccttggtaggggaggacaaattctcactagtcctaaccaaggcttcaacctgaatggtattgttgaaattcaaactctgtcatccttatttatacttctaaaaaccacatttggtttaaagattctgtttgctatagatggggaaagaatttatattcagcttactagcgcatggaaaagaagaacattaggtctgtgtggcacttttaatggcaacataagggatgattttctttctccatcaggcatgatagaaggtacaccacaacttcacgcaaatgcgtggagagtttcttctacctgttttgcacctgttcatgtcccagtggtggacccctgtaacatcaatcaacaaaacattgggtatgcagcacactgtgatgtcatccaccaggagctctttgctccttgccacatctatattagccctgggctgtactatcagctatgccgccacgatgcatgcaagtgtggaagctcctgcctgtgcaatgctcttgcccactatgcctacctctgcggccagcacggtgttcccattgatttcagaactcagatttctttctgtgctgtggtgtgccagaagggcatgctgtaccatcactgttcctcgttctgcctccattcctgcatttctctctcttccccggagcagtgcagtgatgactgtgctgaaggctgtaattgtccggaaggcaaattctatgaagacactcttaacttttgtgtacccatattccactgccgttgtcattataggggcagtgtttatcaacctggagagctcatccccacaccctcgggcttatgccagtgttcaaatgggactgtgaaatgtgatgaattagcaacgccctctgctgttcacatctgcccagagggaaaagagtatttcgactgcaggtttcctgaccctgaattaccagctggtggtgttaattgtgagactacatgtgcaaacctagccatgaacttcacctgcaccccatcctcaccctgtataagtggctgtgtttgtgctccaggaatggcagagcacagaggaaagtgttatgttcctgaaagctgcccatgtatttggaaagattgggagtatctctcaggagaagtgattgctacaccgtgttacacctgcgtttgtcgacgaggaatgttcaattgcacatattatccatgcccagcagtgtgcacaatatacggggaccgacattattattcttttgatggactagaatatgactatatcagtgattgccaggtgtttttgataaagagtgcagatgattcagatatatctgtcattgcccagaacaagaaatgctttgacaacgatattgtttgttctaaaagtgttttgatttcagttggggacactgaaatttacctgaatgatactccttacaaacagaaacaatcaggtttttttctggaaaacaaatctacctaccagctttggaaggctggttactatatagtagtatactttccagagaaagatatcactattctttgggataggaagacaactattcatatcaaagttgggccacagtggaagaacaagctatcaggattgtgtggaaactttgacaaatgcacttcaaatgatatgaccacatctaataacttggaagtgagaaatgctcgggtatttggagatagttgggcattaggacagtgtgaaagtccagatgaaacaattaaaccctgtgaggcacatcaaaacaaatttccttatgccaagaaagaatgctccattttgtacagtgatatttttgcttcttgtcgcaatgtgattgacgttacttcttttgccaaaaattgtcatgaagatacatgtaactgcaatcttggtggcgactgtgagtgtttgtgcactagtatagctgcatatgcatacaagtgttgtcaggaaggaatatcaattcattggagatcatctactgtttgttcacttgattgtgaatactacaatgaaggacttggagaaggaccatatatgctggcaagctatgggcagagtggccttgttctgggggccaatatgaccagcagaagcgttttctgtttgccgagaagcagtgttcataccagtttatttttttattttatgatcactccaggccttttcaaagagaaggtatcatcattagcacttgtttccttggaatctgctgaaaggccaaactactttctctatgtccatgacaatgatactcttagcttggagctgtgggaggcgaattcagcctttcatcggagagcaacatttttccaccatcagggcctctggattcctggttacagtgcatttgagttatacagcaagaaaggctttttcatcatattcacagattctagtgtcaaagcatcaaaatatgatgattctgaagaatttaaacattcaagtagcttcagcatagaagaaatccaggcagcagtgccttacaggaagatgtgtgaatggagatatgaaccttgtgctacaccctgttttaaaacatgtagtgaccctgaagcactagcatgtaaatttcttccaccggttgaaggatgcttgccctactgccctaaaaatatgatccttgatgaggtcaccctcaagtgtgtttatccacgagactgtatacctgtgattcccacagaaccaacattaatgccaccagctaagccaactgtgcccatgtttacagtttgggaaatgattactccatcagacatcactgtgtttgatatgctaacaccaactacaggcttggaatgtgagcctcagaaatttgatcctgtttatgattgtagccaatacatatgccttaatatggaatggcagttatacaactggtcccttaattgcccaaaggacgtggaaatgcctgactgtggtttccgaggaaggccagttcaagtgaacagtgatatctgctgccctgagtgggaatgtccttgtcggtgttccatgttgtcagaactgagcattattacatttgatggaaacaacgcagcattatatagcatggcttcttatatcttagtaagaattcctggtgaaattatagttgctcatatcgaaaaatgttccatgaatcagaatggaaactccttaaaaaagctagctccctctggaagaatctctggactttgttttaagaagttaaatgtgacaacacccatacataaaataattgtcaatcggttggcaagaaaggtagaagtggattccattgttgtgcctttgcccttttcaagtcaggaactgtccatagaggattctggttcaatgtatgtaattactactccagctggactaatcataaagtggtctcatcttacaggaatcatagacattcattttggcttccgatttaacttgtcatcctacacagaaggactctgtggaatttgcaatgaagatccggatgatgatctaaggatgcaaaatggcacaattattacaaatatggaagacataggattatttattgagagctgggaaattgagaaatcatttgaagtaacaatgagaagacctgttaggaattgtactgagcatgattgcagccagtgcattgatttattaaatagaagaattttcattccatgtcatgataaagtttcaccggaagacttttgtgaaaagatgtggatcaattatacctatttttggaactatgaatgtgatgcactttctgcatatgtggctctgtgcaacaagtttgatatctgtattcagtggagaacacctgattactgctccctgagttgcccagaggggaaggaatatcaaccctgtgtgcgaccttgtgaagcaagaacatgcctgaaccaatggttctatggacacacttcctgtttgaatctaagagaagactgtgtgtgcaaagttggaactattcttcacaggccacattcagcccagtgcattccagagaaagagtgtgcatgcactgatagtgaagaccaaccccgcactgctggggagatttggaatgggggcattgatgaatgcactctatacaaatgtttggagaatggaagcattatccctatagaacctgactgtgatgaagagcccacgccagtttgtgaacgagaagctgaagttgtcatgggcatcattgataaatggacctgctgttcaaaggaagtttgtggatgtgacacgactttgtgtgaaactagcattccaacatgtacaaatagtcaaaaattgattgttggccacagtcctctttcttgctgtccacagtacaaatgtgaatgtgacccattgaaatgccccagtatttcaacaccagaatgcagagaagatcaattcatgattcaagttcgacaggaagaaccttgttgtttttcccctttttgtgtttgtgaatcttgcaccaaacctgttccactatgtcatgatggggaatttctcacagtagatcttaatagcacacacttctgttgtcctcagtattactgtgtatgtgaaccaaacctttgtcctatgccattactcaactgtgcagaagatatgaatcttgtgaaagaaaatgtatctggtcaatgttgcccaacatggcactgtgaatgtaactgtgaaaaccttattatgccaacttgtgaagtgggagaatttactgcaatagaccataacttccagagtgattgtggatgcatacagtatctctgtgaaaaggatgatgtgtgtgtatttcaagaagtatcagtattgaatcctggacaatccatgataaagtatttggaagaagacttttgttatgctatagagtgtctggaagaaaaagataaccatacgggctttcacactctgaattttacactggtgaattgttcaaaaaaatgtgatgttcaccaggtatatactccatccccaagtgattatggttgttgtggtacctgcaaaaatgtatcctgcaaatttcacatggaaaatggaacatcagttgtatacgcggtagggagtacctggcactacaattgcaccacatatgaatgtgttaaaactgatgaaggagcaataattctgaactacacaatggtctgtcccccttttaatgagactgaatgcaaaatgaatgaagggattgtgaagctttataatgaaggctgttgcaagatctgcaaacgagaagaaagaatatgccagaaagtgatcattaaatcggtcataaggaaacaggactgtatgagccaaagccctataaatgttgcatcttgtgacggcaaatgcccatcagctaccatatataacatcaatattgaaagtcacctaagattctgcaagtgttgtcgtgaaaatggagtacgaaacttgtctgtgcctctgtattgctcaggaaatggcactgaaattatgtacactctccaggaacccatagactgtacgtgccagtggaattaaacccttgggttccaagagctctatacaacatcataacgtcagatagaattaacttttattgctattacttaggcatgtggcagatttatgctgtttaacaatactgtatttttcagacttggaatgtggaaatttagcaatttgtacaaaatatatacagtttcaatagcaaaattaaatttattgctttactctattttagaaaatcaaatgactgtaagttgttcagctgaaatgctgttatgtatttaattacaacttggtgcagatacagtatattctcatcaactggaaggttattttgcaaaattccttcaatttcactcagtagctctttttttcttaatttgcaaagtctgctatagctatccaaattaaggtaccctttaatatgtactccttaatctggtaaatgtgatcagttaaaattgtcatctagatagcaataaagagtgatatgcttagagatagataatggattatttaaaacctgaatggtttatagagaagtcattataaattcccctcattttgcaggtgtaacagataaccagagaagctgtgtgactcgtacaaatttattcagtgtaataatatagtaaattcatgttaacagttggattaaatcctagctctctcttattccagtactatatcacttttaaaatcctgagcagtatgtagtaagagtatatcacagaatctttcattcttaaagagtttgcattggatagaattaagtattttaagtttaacatatttgaaaaatgccccccatacattgttattccaatagtaaggagcagggaaatatagcatcatttgctaaatagaggagatagatcttgaactgttattttttatataattaaaactgctattaaatgtgttgtcagtatttaacatttagttactgtctcattaatatttaattttgaggatgtacttgcatactgttgaagttgagtgctgttttgctgttaatgctgctgctttgccaatgaagaatgaaataaatttatctgaatgtatcaataacttt

SEQ ID NO: 162919 - DNA, 8032 bp, Homo sapiens
  Payload ID: 12097
  Gene Symbol: OTOGL
  Gene Name: otogelin-like
  Uniprot ID: Q3ZCN5
  ENST ID: ENST00000547103
  CDS Start-End: 7-7005
aatttaatgataccttggagtatattcttgcttcatgtactgctgttttcattacaagaatatatttgtgcatcgtctatattgatgggaacatcaaaaaacgggtttaatgaaaatcgacagaaaagagctcttttagcagcacagtttgaagctacttctccgagatactttttccatgatgctattaattggggtgagagcaaaataaaaggttcttgtccttatgaatgccttaatggagctttctgttctaagactggaacatgtgactgtcaaatatttcaggctcttgggacaagatgccagatcatcccaaacatgggcaacggcagagatgggatttgtaaaacctggggacagtatcattttgaaacattcgatggcatctactattacttcccaggaaactgttcttacatttttgcaaaggactgtggtgatttggagcctcggtacactgtatgggttcataacagccctaaatgccttggttcggtgtattcttgttatcggtcaatcagcttgttcttttcaaaccaagaggaaattcgaatttatggtcatgaaataaaaaagaatggaatcagtttaacattgcctcagacaattggacagattttcattgagaaactagctgactacattcttgtgaaaacaacctttggcttttcattggcttgggacgggatatctgggatctacctcaagctgtctgaggaccataaggggaaatcatgtggcctatgtggaaactacaatgacattcaatctgatgatttcataattctgcaagaggactatacagaagacatcgctatgtttgcaaatagttggtcggtgcaaactccagatgacaccaaatgtgtactcacaccctcagattttccaaatccgtgctccagtggaatgccagcatttgaggcaatcttcttcaagtgtcagatactgttgcagtttccttttctgagctgccatgagtatatcgatccatacttatatattgccagctgtgttaatgatctttgcaaaactgatgatgatgaaacctattgccgagcagccactgagtatgctagagcctgctctcatgctggctaccctattcaagactggagagatgactttccagcatgcactgataaatgtgatgatagctttgtccatcgggactgtatcagttgttgtccaccaacctgcacatttgagaagcaatgtcttgggagcaatctccattgtcttgatggatgttactgcccagatggcctcgtaatggacaatgggacttgcatctccttggaaaattgcccatgcggttttcatggattagcttattcagttggttcaaaaattgaacaagaatgtactgaatgtgtgtgtgttggtggagtttggaactgcactgagcaagactgtccagttcaatgctcagttgtaggtgattctcactttacaacttttgatggtcgacattattcttttattggcatgtgccaatacatcctcgtgaaaggaactggaaaagataaattcacgattactttacagaaagctccctgtgagcagaatcttggcttggtctgccttcagtctataactctgattctggaggatgattttaacaaacaagtgacccttggtaggggaggacaaattctcactagtcctaaccaaggcttcaacctgaatggtattgttgaaattcaaactctgtcatccttatttatacttctaaaaaccacatttggtttaaagattctgtttgctatagatggggaaagaatttatattcagcttactagcgcatggaaaagaagaacattaggtctgtgtggcacttttaatggcaacataagggatgattttctttctccatcaggcatgatagaaggtacaccacaacttcacgcaaatgcgtggagagtttcttctacctgttttgcacctgttcatgtcccagtggtggacccctgtaacatcaatcaacaaaacattgggtatgcagcacactgtgatgtcatccaccaggagctctttgctccttgccacatctatattagccctgggctgtactatcagctatgccgccacgatgcatgcaagtgtggaagctcctgcctgtgcaatgctcttgcccactatgcctacctctgcggccagcacggtgttcccattgatttcagaactcagatttctttctgtgctgtggtgtgccagaagggcatgctgtaccatcactgttcctcgttctgcctccattcctgcatttctctctcttccccggagcagtgcagtgatgactgtgctgaaggctgtaattgtccggaaggcaaattctatgaagacactcttaacttttgtgtacccatattccactgccgttgtcattataggggcagtgtttatcaacctggagagctcatccccacaccctcgggcttatgccagtgttcaaatgggactgtgaaatgtgatgaattagcaacgccctctgctgttcacatctgcccagagggaaaagagtatttcgactgcaggtttcctgaccctgaattaccagctggtggtgttaattgtgagactacatgtgcaaacctagccatgaacttcacctgcaccccatcctcaccctgtataagtggctgtgtttgtgctccaggaatggcagagcacagaggaaagtgttatgttcctgaaagctgcccatgtatttggaaagattgggagtatctctcaggagaagtgattgctacaccgtgttacacctgcgtttgtcgacgaggaatgttcaattgcacatattatccatgcccagcagtgtgcacaatatacggggaccgacattattattcttttgatggactagaatatgactatatcagtgattgccaggtgtttttgataaagagtgcagatgattcagatatatctgtcattgcccagaacaagaaatgctttgacaacgatattgtttgttctaaaagtgttttgatttcagttggggacactgaaatttacctgaatgatactccttacaaacagaaacaatcaggtttttttctggaaaacaaatctacctaccagctttggaaggctggttactatatagtagtatactttccagagaaagatatcactattctttgggataggaagacaactattcatatcaaagttgggccacagtggaagaacaagctatcaggattgtgtggaaactttgacaaatgcacttcaaatgatatgaccacatctaataacttggaagtgagaaatgctcgggtatttggagatagttgggcattaggacagtgtgaaagtccagatgaaacaattaaaccctgtgaggcacatcaaaacaaatttccttatgccaagaaagaatgctccattttgtacagtgatatttttgcttcttgtcgcaatgtgattgacgttacttcttttgccaaaaattgtcatgaagatacatgtaactgcaatcttggtggcgactgtgagtgtttgtgcactagtatagctgcatatgcatacaagtgttgtcaggaaggaatatcaattcattggagatcatctactgtttgttcacttgattgtgaatactacaatgaaggacttggagaaggaccatatatgctggcaagctatgggcagagtggccttgttctgggggccaatatgaccagcagaagcgttttctgtttgccgagaagcagtgttcataccagtttatttttttattttatgatcactccaggccttttcaaagagaaggtatcatcattagcacttgtttccttggaatctgctgaaaggccaaactactttctctatgtccatgacaatgatactcttagcttggagctgtgggaggcgaattcagcctttcatcggagagcaacatttttccaccatcagggcctctggattcctggttacagtgcatttgagttatacagcaagaaaggctttttcatcatattcacagattctagtgtcaaagcatcaaaatatgatgattctgaagaatttaaacattcaagtagcttcagcatagaagaaatccaggcagcagtgccttacaggaagatgtgtgaatggagatatgaaccttgtgctacaccctgttttaaaacatgtagtgaccctgaagcactagcatgtaaatttcttccaccggttgaaggatgcttgccctactgccctaaaaatatgatccttgatgaggtcaccctcaagtgtgtttatccacgagactgtatacctgtgattcccacagaaccaacattaatgccaccagctaagccaactgtgcccatcactgtgtttgatatgctaacaccaactacaggcttggaatgtgagcctcagaaatttgatcctgtttatgattgtagccaatacatatgccttaatatggaatggcagttatacaactggtcccttaattgcccaaaggacgtggaaatgcctgactgtggtttccgaggaaggccagttcaagtgaacagtgatatctgctgccctgagtgggaatgtccttgtcggtgttccatgttgtcagaactgagcattattacatttgatggaaacaacgcagcattatatagcatggcttcttatatcttagtaagaattcctggtgaaattatagttgctcatatcgaaaaatgttccatgaatcagaatggaaactccttaaaaaagctagctccctctggaagaatctctggactttgttttaagaagttaaatgtgacaacacccatacataaaataattgtcaatcggttggcaagaaaggtagaagtggattccattgttgtgcctttgcccttttcaagtcaggaactgtccatagaggattctggttcaatgtatgtaattactactccagctggactaatcataaagtggtctcatcttacaggaatcatagacattcattttggcttccgatttaacttgtcatcctacacagaaggactctgtggaatttgcaatgaagatccggatgatgatctaaggatgcaaaatggcacaattattacaaatatggaagacataggattatttattgagagctgggaaattgagaaatcatttgaagtaacaatgagaagacctgttaggaattgtactgagcatgattgcagccagtgcattgatttattaaatagaagaattttcattccatgtcatgataaagtttcaccggaagacttttgtgaaaagatgtggatcaattatacctatttttggaactatgaatgtgatgcactttctgcatatgtggctctgtgcaacaagtttgatatctgtattcagtggagaacacctgattactgctccctgagttgcccagaggggaaggaatatcaaccctgtgtgcgaccttgtgaagcaagaacatgcctgaaccaatggttctatggacacacttcctgtttgaatctaagagaagactgtgtgtgcaaagttggaactattcttcacaggccacattcagcccagtgcattccagagaaagagtgtgcatgcactgatagtgaagaccaaccccgcactgctggggagatttggaatgggggcattgatgaatgcactctatacaaatgtttggagaatggaagcattatccctatagaacctgactgtgatgaagagcccacgccagtttgtgaacgagaagctgaagttgtcatgggcatcattgataaatggacctgctgttcaaaggaagtttgtggatgtgacacgactttgtgtgaaactagcattccaacatgtacaaatagtcaaaaattgattgttggccacagtcctctttcttgctgtccacagtacaaatgtgaatgtgacccattgaaatgccccagtatttcaacaccagaatgcagagaagatcaattcatgattcaagttcgacaggaagaaccttgttgtttttcccctttttgtgtttgtgaatcttgcaccaaacctgttccactatgtcatgatggggaatttctcacagtagatcttaatagcacacacttctgttgtcctcagtattactgtgtatgtgaaccaaacctttgtcctatgccattactcaactgtgcagaagatatgaatcttgtgaaagaaaatgtatctggtcaatgttgcccaacatggcactgtgaatgtaactgtgaaaaccttattatgccaacttgtgaagtgggagaatttactgcaatagaccataacttccagagtgattgtggatgcatacagtatctctgtgaaaaggatgatgtgtgtgtatttcaagaagtatcagtattgaatcctggacaatccatgataaagtatttggaagaagacttttgttatgctatagagtgtctggaagaaaaagataaccatacgggctttcacactctgaattttacactggtgaattgttcaaaaaaatgtgatgttcaccaggtatatactccatccccaagtgattatggttgttgtggtacctgcaaaaatgtatcctgcaaatttcacatggaaaatggaacatcagttgtatacgcggtagggagtacctggcactacaattgcaccacatatgaatgtgttaaaactgatgaaggagcaataattctgaactacacaatggtctgtcccccttttaatgagactgaatgcaaaatgaatgaagggattgtgaagctttataatgaaggctgttgcaagatctgcaaacgagaagaaagaatatgccagaaagtgatcattaaatcggtcataaggaaacaggactgtatgagccaaagccctataaatgttgcatcttgtgacggcaaatgcccatcagctaccatatataacatcaatattgaaagtcacctaagattctgcaagtgttgtcgtgaaaatggagtacgaaacttgtctgtgcctctgtattgctcaggaaatggcactgaaattatgtacactctccaggaacccatagactgtacgtgccagtggaattaaacccttgggttccaagagctctatacaacatcataacgtcagatagaattaacttttattgctattacttaggcatgtggcagatttatgctgtttaacaatactgtatttttcagacttggaatgtggaaatttagcaatttgtacaaaatatatacagtttcaatagcaaaattaaatttattgctttactctattttagaaaatcaaatgactgtaagttgttcagctgaaatgctgttatgtatttaattacaacttggtgcagatacagtatattctcatcaactggaaggttattttgcaaaattccttcaatttcactcagtagctctttttttcttaatttgcaaagtctgctatagctatccaaattaaggtaccctttaatatgtactccttaatctggtaaatgtgatcagttaaaattgtcatctagatagcaataaagagtgatatgcttagagatagataatggattatttaaaacctgaatggtttatagagaagtcattataaattcccctcattttgcaggtgtaacagataaccagagaagctgtgtgactcgtacaaatttattcagtgtaataatatagtaaattcatgttaacagttggattaaatcctagctctctcttattccagtactatatcacttttaaaatcctgagcagtatgtagtaagagtatatcacagaatctttcattcttaaagagtttgcattggatagaattaagtattttaagtttaacatatttgaaaaatgccccccatacattgttattccaatagtaaggagcagggaaatatagcatcatttgctaaatagaggagatagatcttgaactgttattttttatataattaaaactgctattaaatgtgttgtcagtatttaacatttagttactgtctcattaatatttaattttgaggatgtacttgcatactgttgaagttgagtgctgttttgctgttaatgctgctgctttgccaatgaagaatgaaataaatttatctgaa

SEQ ID NO: 162920 - DNA, 2087 bp, Homo sapiens
  Payload ID: 12097
  Gene Symbol: OTOGL
  Gene Name: otogelin-like
  ENST ID: ENST00000551340
  CDS Start-End: 1-500
gccacagtcctctttcttgctgtccacagtacaaatgtgaatgtgacccattgaaatgccccagtatttcaacaccagaatgcagagaagatcaattcatgattcaagttcgacaggaagaaccttgttgtttttcccctttttgtgtttgtgaatcttgcaccaaacctgttccactatgtcatgatggggaatttctcacagtagatcttaatagcacacacttctgttgtcctcagtattactgtgtatgtgaaccaaacctttgtcctatgccattactcaactgtgcagaagatatgaatcttgtgaaagaaaatgtatctggtcaatgttgcccaacatggcactgtgaatgtaactgtgaaaaccttattatgccaacttgtgaagtgcagccttgtgcagatgcagacatcagaaccctaggctgccttggtagagcagatcaagaacatttccatgaagcaaagttcctaagggagaatttactgcaatagaccataacttccagagtgattgtggatgcatacagtatctctgtgaaaaggatgatgtgtgtgtatttcaagaagtatcagtattgaatcctggacaatccatgataaagtatttggaagaagacttttgttatgctatagagtgtctggaagaaaaagataaccatacgggctttcacactctgaattttacactggtgaattgttcaaaaaaatgtgatgttcaccaggtatatactccatccccaagtgattatggttgttgtggtacctgcaaaaatgtatcctgcaaatttcacatggaaaatggaacatcagttgtatacgcggtagggagtacctggcactacaattgcaccacatatgaatgtgttaaaactgatgaaggagcaataattctgaactacacaatggtctgtcccccttttaatgagactgaatgcaaaatgaatgaagggattgtgaagctttataatgaaggctgttgcaagatctgcaaacgagaagaaagaatatgccagaaagtgatcattaaatcggtcataaggaaacaggactgtatgagccaaagccctataaatgttgcatcttgtgacggcaaatgcccatcagctaccatatataacatcaatattgaaagtcacctaagattctgcaagtgttgtcgtgaaaatggagtacgaaacttgtctgtgcctctgtattgctcaggaaatggcactgaaattatgtacactctccaggaacccatagactgtacgtgccagtggaattaaacccttgggttccaagagctctatacaacatcataacgtcagatagaattaacttttattgctattacttaggcatgtggcagatttatgctgtttaacaatactgtatttttcagacttggaatgtggaaatttagcaatttgtacaaaatatatacagtttcaatagcaaaattaaatttattgctttactctattttagaaaatcaaatgactgtaagttgttcagctgaaatgctgttatgtatttaattacaacttggtgcagatacagtatattctcatcaactggaaggttattttgcaaaattccttcaatttcactcagtagctctttttttcttaatttgcaaagtctgctatagctatccaaattaaggtaccctttaatatgtactccttaatctggtaaatgtgatcagttaaaattgtcatctagatagcaataaagagtgatatgcttagagatagataatggattatttaaaacctgaatggtttatagagaagtcattataaattcccctcattttgcaggtgtaacagataaccagagaagctgtgtgactcgtacaaatttattcagtgtaataatatagtaaattcatgttaacagttggattaaatcctagctctctcttattccagtactatatcacttttaaaatcctgagcagtatgtagtaagagtatatcacagaatctttcattcttaaagagtttgcattggatagaattaagtattttaagtttaacatatttgaaaaatgccccccatacattgttattccaatagtaaggagcagggaaa

SEQ ID NO: 162921 - DNA, 908 bp, Homo sapiens
  Payload ID: 12097
  Gene Symbol: OTOGL
  Gene Name: otogelin-like
  ENST ID: ENST00000550182
  CDS Start-End: 1-801
caagttcgacaggaagaaccttgttgtttttcccctttttgtgtttgtgaatcttgcaccaaacctgttccactatgtcatgatggggaatttctcacagtagatcttaatagcacacacttctgttgtcctcagtattactgtgtatgtgaaccaaacctttgtcctatgccattactcaactgtgcagaagatatgaatcttgtgaaagaaaatgtatctggtcaatgttgcccaacatggcactgtgaatgtaactgtgaaaaccttattatgccaacttgtgaagtgggagaatttactgcaatagaccataacttccagagtgattgtggatgcatacagtatctctgtgaaaaggatgatgtgtgtgtatttcaagaagtatcagtattgaatcctggacaatccatgataaagtatttggaagaagacttttgttatgctatagagtgtctggaagaaaaagataaccatacgggctttcacactctgaattttacactggtgaattgttcaaaaaaatgtgatgttcaccaggtatatactccatccccaagtgattatggttgttgtggtacctgcaaaaatgtatcctgcaaatttcacatggaaaatggaacatcagttgtatacgcggtagggagtacctggcactacaattgcaccacatatgaatgtgttaaaactgatgaaggagcaataattctgaactacacaatggtctgtcccccttttaatgagactgaatgcaaaatggtttgtactttgttgtatctaagaaaatttattattatataatttagaaaatacacattgatattttctaaggtcatactttcattgtggcttatacataatggcgaatgtgttattttcatgaatgaataaaagctctgttctatttt

SEQ ID NO: 162922 - DNA, 1434 bp, Homo sapiens
  Payload ID: 12098
  Gene Symbol: OTOL1
  Gene Name: otolin 1
  Uniprot ID: A6NHN0
  ENST ID: ENST00000327928
  CDS Start-End: 1-1434
atgtggatgttttcttggctttgtgctattttaattattttggctattgctggtatgaacacaatagcaaagaccacaccacataccaaatttacgaagaaatctgaggaaagagagatgccaaagggtctaaagccatccagtggcccacctccagaagaagaagaaaccctcttcacagaaatggctgaaatggcagaaccaattaccaaaccctcggccttggattctgtctttggcactgccactctctctccctttgaaaacttcactcttgacccagctgatttctttttgaattgttgtgattgttgttcacctgtacccgggcagaaaggagaacctggagagactggacagccaggtcctaaaggagaggctggaaatttggggatcccagggccaccaggagttgttgggccccaaggccctagaggctacaaaggagagaaaggactcaaaggagaacgtggggaccaaggagttccaggatacccaggaaaaccgggagcacaaggtgaacctggccctaagggagataaaggaaacattggtttgggaggagtgaaaggacaaaaaggctccaagggagacacatgtgggaattgtaccaaaggagaaaaaggagaccaaggggctatgggctcacctggcctgcacggagggcctggcgccaagggagagaagggggagatgggggagaagggggagatgggggataagggctgctgtggagattctggggagaggggaggaaaaggacagaaaggtgaggggggtatgaaaggggaaaaaggtagcaaaggagacagtggaatggaaggcaaaagcggccgtaatggtctgcctggggccaaaggtgatccagggattaaaggagaaaaaggagagttaggtcctcctggtctcctgggacctactgggccgaagggtgacattggcaacaaaggggtccgaggccccactgggaagaagggctctcggggctttaaaggctccaagggtgagttggctagagtgccccggtcggctttcagcgctggtttgtcaaagccatttcctcctcctaacatccccatcaaatttgaaaagattctctataatgaccaagggaattacagtcctgtcactgggaagtttaactgctctattcctgggacatatgttttttcctaccatattacggtgagggggcgacctgctcgaatcagtctggtggcccagaataagaagcagttcaagtccagagaaactctctatggtcaggaaatagaccaggcctctctcctcgtcatcttgaaattaagtgcaggagaccaagtctggcttgaggtgtcaaaagattggaatggggtgtatgtcagtgctgaggatgacagcatttttactgggttccttttgtacccagaggaaacttctggaatttcaccataa

SEQ ID NO: 162923 - DNA, 1864 bp, Homo sapiens
  Payload ID: 12099
  Gene Symbol: OTOP1
  Gene Name: otopetrin 1
  Uniprot ID: Q7RTM1
  ENST ID: ENST00000296358
  CDS Start-End: 26-1864
cagacttggcgcgggtgtctcgaagatgctcgagggcctggggtcgcccgcctcgccccgggcagctgcaagcgcctcggtcgcagggtcgtcggggccagcggcctgctcgcctccctcgtcctcggccccgaggtccccggaatccccggccccccggcggggcggtgtgcgcgccagcgtcccacagaaactggccgagatgctgagcagccagtatgggctgatcgtgttcgtggcggggctgctgctgctgctggcctgggccgtgcacgccgcgggcgtgagcaagagcgacctgctgtgcttcctgacggcgctcatgctgctgcagctgctgtggatgctgtggtacgtgggccgcagctccgcgcaccgccgcctcttccgcctcaaggacacgcacgcgggtgccggctggctgcgcggtagtatcacattgtttgcagtcattaccgtcatcctgggatgccttaaaattggatacttcattggattttcagaatgtttatcagccactgaaggagttttcccagtcacccattcagtgcatactttgttgcaggtatattttctttgggggcatgcaaaggatattatccagtctttcaaaacactggaaaggtttggagtgatccactcggtgttcaccaacctgcttctgtgggccaatggcgtcctcaatgagtcaaagcaccaactcaatgagcacaaggaacggctcatcactctgggttttgggaacataacaacagttttagatgaccacacaccgcagtgtaactgcacgcccccaactctgtgcactgccatctcccacgggatctactacctctaccccttcaacatagagtatcagatcctggcctccacaatgctctacgtcctgtggaagaacatcgggcgcaaagttgacagccatcagcaccagaagatgcagttcaagtctgatggggtcatggtgggcgcagtcctgggcctgaccgtgctggccgccaccattgctgtggtggtggtatacctgattcatattgggcgctccaagaccaagagcgagtcggcactcatcatgttctacctgtatgccatcaccctgctgatgcttatgggggctgcggggctggctggaatccggatttacaggatagacgagaagtcactggatgagtccaaaaatccggcccgcaaactggactcggacctcttggtgggcactgcctcgggctcctggcttatctcctggggctcaatcttggccatcctctgtgctgagggccacccccgctacacctggtacaacctgccctactccatcctggcgatcgtggagaagtacatccagaacctcttcatctttgaatccattcaccgagagcctgaaaaactctctgaggacatccaaacccttcgggtggtcacagtctgcaatggcaacaccatgccccttgcttcttcctgccccaagagtggaggtgtggccagagatgtggctccccagggcaaggacatgccaccagcagccaatggaaatgtgtgcatgagagaaagccatgacaaggaggaggagaagcaggaggagagcagctggggagggagcccaagcccagtccgccttccccgtttcttacagggcaacgccaagagaaaagtcctgaggaatattgcagccttcttgttcctctgcaatatttcgctttggatacctcccgcctttggctgtcgacctgagtatgacaatggattggaggagattgtctttggctttgaaccctggataattgtggtcaacctggccatgcctttttctattttctatcgaatgcacgcagctgcctccctctttgaggtctattgtaagatatag

SEQ ID NO: 162924 - DNA, 2147 bp, Homo sapiens
  Payload ID: 12100
  Gene Symbol: OTOP2
  Gene Name: otopetrin 2
  Uniprot ID: Q7RTS6
  ENST ID: ENST00000331427
  CDS Start-End: 93-1781
agaggagacgctcgccgtcccctgacccccagctcagcgccggctccaagcccagccagtgatccctctagccttctccagtcgcctccgccatgtccgaggagctggcccagggccccaaggagagccccccggcgccgcgtgcgggccccagggaggtgtggaagaagggtggccgcctgctgtcggtgctgctggcggtgaacgtgctgctcctcgcctgcacgctcatcagcggcggagccttcaacaaggtggccgtgtacgacaccgacgtgttcgcgctgctcactgcgatgatgctgctggcaacgctctggatcctcttctacctcctccgaaccgtgcgctgcccctgcgcggtaccctaccgggacgcgcacgctggccccatctggctccgaggtgggctggtgctgtttggaatctgcaccctcatcatggatgtcttcaagaccggctactactccagtttctttgagtgccagtcagccatcaagatcctgcaccccctcatccaggctgtgtttgtcatcatccagacctactttctctgggtctctgctaaagactgcgttcacgtccacctggatctgacctggtgtggtctcatgttcacactcaccaccaacctggccatctggatggcggccgtggtggatgaatctgtgcaccaatcccactcctacagcagttctcacagcaacgccagccacgcccgtctcatctctgaccagcatgcagacaacccggtcggaggagactcctgcctctgcagcacggccgtctgccagatcttccagcaggggtacttctacctatatcccttcaacatcgagtacagcctcttcgcctccaccatgctgtatgtcatgtggaagaatgtgggtagattcctggcctccacccctggccacagccacaccccaacccctgtcagcctcttccgggagaccttttttgctggcccggttctgggcctgctgctcttcgtggtggggctggctgtcttcatcatctacgaggttcaagtgagcggggacgggagccgcaccaggcaggccctggtcatctactacagcttcaacattgtctgcttgggactcaccaccttggtcagcctgagcggctccatcatctaccgttttgaccgccgggccatggaccaccataagaaccccacgcgcactctggacgtggccctgctgatgggtgccgccctgggtcagtacgccatctcttactactccatcgtggctgtggtggcgggcacaccccaggacctgctggcagggctcaacctcacccatgcactgctcatgatcgcccagcacaccttccagaacatgtttatcatcgagagccttcaccgaggaccgcccggggctgagcctcacagtacccaccccaaggagccctgccaagacctcaccttcaccaacctggatgccctccacacgttgtccgcctgcccacccaaccccgggctggttagccccagcccttcagaccagcgggaagcagtggccatcgtctcaacccccagaagccagtggagacgccagtgcctaaaagacatttctctgtttctcctactctgcaatgtcattctgtggatcatgcctgccttcggggcccgccctcatttcagcaacacagtggaggtggatttctacggctactccctctgggcggtcatcgtcaacatctgcctccctttcggcatcttctaccgcatgcacgctgtgtccagcctgctggaggtctacgtgctgtcctgaggcctccaacagaggcatggggggcaggaagagggggctcagctcatgtgcccactcagacaccctctgggaatgaatcccagctggtgccatatgacagcccatttccttctggtcccagagtggaattttcacaaaagttatttttccaggttcaatttttaaatcacagtcaggacaggcccatccaccccagtatgaccgtggggcatgaggtgactggggaagggagacctctcctggcagcatttctaggacccaacaagatctggaggtgccggctctggttccatctctaatcccctgctgtggcctggccagtgtactgcccggagctggaaaccaataaacctgtgatttgccccc

SEQ ID NO: 162925 - DNA, 2086 bp, Homo sapiens
  Payload ID: 12100
  Gene Symbol: OTOP2
  Gene Name: otopetrin 2
  Uniprot ID: Q7RTS6
  ENST ID: ENST00000580223
  CDS Start-End: 31-1719
tccctctagccttctccagtcgcctccgccatgtccgaggagctggcccagggccccaaggagagccccccggcgccgcgtgcgggccccagggaggtgtggaagaagggtggccgcctgctgtcggtgctgctggcggtgaacgtgctgctcctcgcctgcacgctcatcagcggcggagccttcaacaaggtggccgtgtacgacaccgacgtgttcgcgctgctcactgcgatgatgctgctggcaacgctctggatcctcttctacctcctccgaaccgtgcgctgcccctgcgcggtaccctaccgggacgcgcacgctggccccatctggctccgaggtgggctggtgctgtttggaatctgcaccctcatcatggatgtcttcaagaccggctactactccagtttctttgagtgccagtcagccatcaagatcctgcaccccctcatccaggctgtgtttgtcatcatccagacctactttctctgggtctctgctaaagactgcgttcacgtccacctggatctgacctggtgtggtctcatgttcacactcaccaccaacctggccatctggatggcggccgtggtggatgaatctgtgcaccaatcccactcctacagcagttctcacagcaacgccagccacgcccgtctcatctctgaccagcatgcagacaacccggtcggaggagactcctgcctctgcagcacggccgtctgccagatcttccagcaggggtacttctacctatatcccttcaacatcgagtacagcctcttcgcctccaccatgctgtatgtcatgtggaagaatgtgggtagattcctggcctccacccctggccacagccacaccccaacccctgtcagcctcttccgggagaccttttttgctggcccggttctgggcctgctgctcttcgtggtggggctggctgtcttcatcatctacgaggttcaagtgagcggggacgggagccgcaccaggcaggccctggtcatctactacagcttcaacattgtctgcttgggactcaccaccttggtcagcctgagcggctccatcatctaccgttttgaccgccgggccatggaccaccataagaaccccacgcgcactctggacgtggccctgctgatgggtgccgccctgggtcagtacgccatctcttactactccatcgtggctgtggtggcgggcacaccccaggacctgctggcagggctcaacctcacccatgcactgctcatgatcgcccagcacaccttccagaacatgtttatcatcgagagccttcaccgaggaccgcccggggctgagcctcacagtacccaccccaaggagccctgccaagacctcaccttcaccaacctggatgccctccacacgttgtccgcctgcccacccaaccccgggctggttagccccagcccttcagaccagcgggaagcagtggccatcgtctcaacccccagaagccagtggagacgccagtgcctaaaagacatttctctgtttctcctactctgcaatgtcattctgtggatcatgcctgccttcggggcccgccctcatttcagcaacacagtggaggtggatttctacggctactccctctgggcggtcatcgtcaacatctgcctccctttcggcatcttctaccgcatgcacgctgtgtccagcctgctggaggtctacgtgctgtcctgaggcctccaacagaggcatggggggcaggaagagggggctcagctcatgtgcccactcagacaccctctgggaatgaatcccagctggtgccatatgacagcccatttccttctggtcccagagtggaattttcacaaaagttatttttccaggttcaatttttaaatcacagtcaggacaggcccatccaccccagtatgaccgtggggcatgaggtgactggggaagggagacctctcctggcagcatttctaggacccaacaagatctggaggtgccggctctggttccatctctaatcccctgctgtggcctggccagtgtactgcccggagctggaaaccaataaacctgtgatttgccccca

SEQ ID NO: 162926 - DNA, 2363 bp, Homo sapiens
  Payload ID: 12101
  Gene Symbol: OTOP3
  Gene Name: otopetrin 3
  Uniprot ID: Q7RTS5
  ENST ID: ENST00000328801
  CDS Start-End: 1-1791
atgggccgcggagcccgagcggcggctgcgcagtcccgctgggggagggcgtcgcgggcatcggtctcacctggacggacgatccgctcagcgcccgcagtcggtgaagcacaggagactgaagcagccccggagaaggagaaccgagtggatgtgggggccgaggagagagcggccgccacccggccccggcagaagtcctggctggtgaggcatttctctctgctgctgcggcgggaccggcaggcccagaaggctggacaactcttctcggggctcctggccctgaatgtggtgttcctgggtggcgccttcatctgcagcatgatcttcaacaaggtggccgtcactctgggtgacgtgtggatcctgctggccacgctgaaggtcctctccctgctttggcttctctactatgtggcaagcaccacccgccgaccacacgccgtgctctaccaagatccccacgcggggcccctctgggtgcggggttccctagtgctcttcggcagctgcaccttctgcctcaacatcttccgagtgggctacgatgtgagccacatccgctgcaagtcacagctggaccttgtcttctctgtcatcgagatggtcttcatcggcgtccagacctgggtgctctggaaacactgcaaagactgtgttcgggtccagaccaacttcactaggtgtggcctgatgctgaccctggccacaaacctgctgctgtgggttctggccgttaccaatgactccatgcaccgagagatcgaagctgagcttggcatcctcatggaaaaatccacaggcaatgagaccaacacctgtctgtgcctcaatgccaccgcgtgtgaagctttccggagaggcttcctgatgctctaccccttcagcactgagtactgcctcatctgctgtgctgtgctgtttgtcatgtggaagaacgtgggccgccacgtggcaccccacatgggtgcccaccctgccaccgcacccttccacctgcacggggccatcttcgggccgctgctgggcctgctggtgctgctggcaggtgtgtgcgtctttgtgctcttccaaatcgaggccagtggccctgccattgcttgccagtacttcaccctctactatgccttctatgtggctgtgctgcccaccatgagtctggcgtgcctggcgggcacagccatacacgggctggaggagagagagctggacacggtcaagaaccctacccgcagcctggatgtggtgctgctaatgggtgctgcactgggccagatgggcatcgcctatttctccatcgtggccattgtggccaagcgcccgcatgagctgctcaaccgcctcatcctggcctactcgctgctgctcatcctgcagcacatcgctcagaacctcttcatcatcgagggcctgcaccggcgcccactctgggagacagttcccgagggcctggcaggaaagcaggaggctgagcctccccgcagaggctccttgctggagctgggccagggcctgcagcgggcctcactggcctacatccactcctacagccacctcaactggaagcggagggcactcaaggagatctcactcttcctcatcctctgcaatatcacactgtggatgatgcctgcatttggcatacacccggagtttgagaacgggctagaaaaggatttctacggctaccagatatggttcgccatcgtcaacttcggcctgcctctgggggtcttctaccgcatgcactctgtgggaggcctggtggaggtctacctgggggcctgaggctgcccacccccggcagaacctcgaagtgccaaggtggggaagatggtagcccagagtctctgagcagatgcctcattctgaggtgccgagaccagcctgaggctctcaaggcctcctgctccccagagcctcactgaaggggagggcactgcctagagccagaggccaacagcaggggcctggacactgagcttctgatgcccacggccaggcctgggcacatgcctgccccctgccttcccaccacgatccgcaagccaagggtgcaccccaggaggctggcaggggccccctcacggctactctgtgggagggtcagacctacatgaccgagtctggggagcttggcgaggggcacccctctccagccaggactcagaggtctgccccctgctgcgagaagagcacctggtccaagtgtggctctggacatcctcagagctcagagctccgagctaggaggccagctcctctccccacacacctgtctcctaatgagctcattcattggctgccaggcagggttcaacagctctctcctgccgcataaaccctatttgtttaatgga

SEQ ID NO: 162927 - DNA, 2516 bp, Homo sapiens
  Payload ID: 12101
  Gene Symbol: OTOP3
  Gene Name: otopetrin 3
  ENST ID: ENST00000580749
  CDS Start-End: 54-194
ttggctgcaccctctgggtccgagcccccgggagggtaattaacgagggattaatgagatttccaaagtcaacagaaaaatcgatgggccgcggagcccgagcggcggctgcgcagtcccgctgggggagggcgtcgcgggcatcggtctcacctggacggacgatccgctcagcgcccgcagtcggtggttagcccacggcgatgcctctcccggcctcagcccctgctgaggctacacccatgccttcttcagaagcacaggagactgaagcagccccggagaaggagaaccgagtggatgtgggggccgaggagagagcggccgccacccggccccggcagaagtcctggctggtgaggcatttctctctgctgctgcggcgggaccggcaggcccagaaggctggacaactcttctcggggctcctggccctgaatgtggtgttcctgggtggcgccttcatctgcagcatgatcttcaacaaggtggccgtcactctgggtgacgtgtggatcctgctggccacgctgaaggtcctctccctgctttggcttctctactatgtggcaagcaccacccgccgaccacacgccgtgctctaccaagatccccacgcggggcccctctgggtgcggggttccctagtgctcttcggcagctgcaccttctgcctcaacatcttccgagtgggctacgatgtgagccacatccgctgcaagtcacagctggaccttgtcttctctgtcatcgagatggtcttcatcggcgtccagacctgggtgctctggaaacactgcaaagactgtgttcgggtccagaccaacttcactaggtgtggcctgatgctgaccctggccacaaacctgctgctgtgggttctggccgttaccaatgactccatgcaccgagagatcgaagctgagcttggcatcctcatggaaaaatccacaggcaatgagaccaacacctgtctgtgcctcaatgccaccgcgtgtgaagctttccggagaggcttcctgatgctctaccccttcagcactgagtactgcctcatctgctgtgctgtgctgtttgtcatgtggaagaacgtgggccgccacgtggcaccccacatgggtgcccaccctgccaccgcacccttccacctgcacggggccatcttcgggccgctgctgggcctgctggtgctgctggcaggtgtgtgcgtctttgtgctcttccaaatcgaggccagtggccctgccattgcttgccagtacttcaccctctactatgccttctatgtggctgtgctgcccaccatgagtctggcgtgcctggcgggcacagccatacacgggctggaggagagagagctggacacggtcaagaaccctacccgcagcctggatgtggtgctgctaatgggtgctgcactgggccagatgggcatcgcctatttctccatcgtggccattgtggccaagcgcccgcatgagctgctcaaccgcctcatcctggcctactcgctgctgctcatcctgcagcacatcgctcagaacctcttcatcatcgagggcctgcaccggcgcccactctgggagacagttcccgagggcctggcaggaaagcaggaggctgagcctccccgcagaggctccttgctggagctgggccagggcctgcagcgggcctcactggcctacatccactcctacagccacctcaactggaagcggagggcactcaaggagatctcactcttcctcatcctctgcaatatcacactgtggatgatgcctgcatttggcatacacccggagtttgagaacgggctagaaaaggatttctacggctaccagatatggttcgccatcgtcaacttcggcctgcctctgggggtcttctaccgcatgcactctgtgggaggcctggtggaggtctacctgggggcctgaggctgcccacccccggcagaacctcgaagtgccaaggtggggaagatggtagcccagagtctctgagcagatgcctcattctgaggtgccgagaccagcctgaggctctcaaggcctcctgctccccagagcctcactgaaggggagggcactgcctagagccagaggccaacagcaggggcctggacactgagcttctgatgcccacggccaggcctgggcacatgcctgccccctgccttcccaccacgatccgcaagccaagggtgcaccccaggaggctggcaggggccccctcacggctactctgtgggagggtcagacctacatgaccgagtctggggagcttggcgaggggcacccctctccagccaggactcagaggtctgccccctgctgcgagaagagcacctggtccaagtgtggctctggacatcctcagagctcagagctccgagctaggaggccagctcctctccccacacacctgtctcctaatgagctcattcattggctgccaggcagggttcaacagctctctcctgccgcataaaccctatttgtttaatggattgc

SEQ ID NO: 162928 - DNA, 1477 bp, Homo sapiens
  Payload ID: 12102
  Gene Symbol: OTOR
  Gene Name: otoraplin
  Uniprot ID: Q9NRC9
  ENST ID: ENST00000246081
  CDS Start-End: 45-431
ccccgcttccagtcagagttcaagttaaaacagaaaaaaggaagatggcaagaatattgttacttttcctcccgggtcttgtggctgtatgtgctgtgcatggaatatttatggaccgtctagcttccaagaagctctgtgcagatgatgagtgtgtctatactatttctctggctagtgctcaagaagattataatgccccggactgtagattcattaacgttaaaaaagggcagcagatctatgtgtactcaaagctggtaaaagaaaatggagctggagaattttgggctggcagtgtttatggtgatggccaggacgagatgggagtcgtgggttatttccccaggaacttggtcaaggaacagcgtgtgtaccaggaagctaccaaggaagttcccaccacggatattgacttcttctgcgagtaataaattagttaaaactgcaaatagaaagaaaacaccaaaaataaagaaaagagcaaaagtggccaaaaaatgcatgtctgtaattttggactgacgttttaagaatttgttaccttacagaagagcaagggcttaggggttggaggtggcagataaaagaggattttcaactcaaatcttgtttcctgctggcctggtctgcccacgagctagagcggggaaatgttgagctcaaatgggtaaattgagaccagaaaattattttttcaacctagagaatctcctcttacagggggatgcatataacagatcatgtatgtgtagttatttctaagtagtaattcttcccagctctttgatttgccatatataaaataggtgggtcgtatgtcttccctttagacatgatgttttctactcatttgtctctctggccaattgaattattaataaaaggtctgtattatcaaagagtattctagtatttttgttacttttaatatttgatgccttttggaggtaaagctgttgggggaagaagagtttttggacccatagatgtttggatgatgtctctaatttgtcatttagaaaaatctcaaaaatgatttcagttgaataacttgccttctaaatgatcaatttacttctcccccaattttaaagaagtatgtgtatatttaataggggaaggtagtttatggaaatatttttaatggaatagttttcccttaatatgtatccttgctggatattattcaagctgcaagtcatcaaaagacccagaaaaaaaaaagtctgtaggttattttctctacttctatttcaactttgaatttcctcttcctgtgcaaattcctctagtcaagtgtgatatatcaagaaatctgaggaggatgcaggttttgtggtcctgatgggcccacaagtttttctatatttaactggaaatatgctttgattttgtgttattaatataattcttttgatgtagtcatgagtttttctttgtttgcatataattaaaatgcctctacttaatgtca

SEQ ID NO: 162929 - DNA, 566 bp, Homo sapiens
  Payload ID: 12103
  Gene Symbol: OTOS
  Gene Name: otospiralin
  Uniprot ID: Q8NHW6
  ENST ID: ENST00000319460
  CDS Start-End: 156-425
cccatccaggcagcacggctggctgagcagagacaagggctgcccacactgggactggtagaggaagccggccctgacggatgggtggtctcgcccttcctgggttcatcctgctgcaggtgggcctgagtcgcagatcaggaagcaccgggaagatgcaggcctgcatggtgccggggctggccctctgcctcctactggggcctcttgcaggggccaagcctgtgcaggaggaaggagacccttacgcggagctgccggccatgccctactggcctttctccacctctgacttctggaactatgtgcagcacttccaggccctgggggcctacccccagatcgaggacatggcccgaaccttctttgcccacttccccctggggagcacgctgggcttccacgttccctatcaggaggactgaatggtgtccagcctggtgcccgcccaccccgccaggctgcactcggtcgggcctccacaggcatggagtccccgcaaaaacctggcccctgcaggagtcaggcctggtctcacgctcaataaactccggactgaagatgca

SEQ ID NO: 162930 - DNA, 645 bp, Homo sapiens
  Payload ID: 12103
  Gene Symbol: OTOS
  Gene Name: otospiralin
  Uniprot ID: Q8NHW6
  ENST ID: ENST00000391989
  CDS Start-End: 232-501
cagcgtggacttgccagaagcctccctggcagccgagggcccttctataaagaggactcttgagctggcagcagagcccatccaggcagcacggctggctgagcagagacaagggctgcccacactgggactggtagaggaagccggccctgacggatgggtggtctcgcccttcctgggttcatcctgctgcaggtgggcctgagtcgcagatcaggaagcaccgggaagatgcaggcctgcatggtgccggggctggccctctgcctcctactggggcctcttgcaggggccaagcctgtgcaggaggaaggagacccttacgcggagctgccggccatgccctactggcctttctccacctctgacttctggaactatgtgcagcacttccaggccctgggggcctacccccagatcgaggacatggcccgaaccttctttgcccacttccccctggggagcacgctgggcttccacgttccctatcaggaggactgaatggtgtccagcctggtgcccgcccaccccgccaggctgcactcggtcgggcctccacaggcatggagtccccgcaaaaacctggcccctgcaggagtcaggcctggtctcacgctcaataaactccggactgaagatgcacaa

SEQ ID NO: 162931 - DNA, 2933 bp, Homo sapiens
  Payload ID: 12104
  Gene Symbol: OTUD1
  Gene Name: OTU deubiquitinase 1
  Uniprot ID: Q5VV17
  ENST ID: ENST00000376495
  CDS Start-End: 1-1446
atgcagctctacagcagcgtctgcacccactaccccgccggggccccgggtcccacggccgccgcccccgcgccacccgccgccgctacccccttcaaggtctcgctgcagcccccgggagccgccggcgccgcgcccgagcccgagaccggtgagtgccagcccgccgcggccgccgagcaccgggaagccgccgctgtccccgccgccaagatgcccgccttctcctcctgcttcgaggtggtgtccggggccgccgcgcccgcctccgccgccgccggcccgcccggcgcgtcctgcaagccgccgctgccgccgcactacacgtccaccgcacagatcaccgtgcgggccctgggcgccgacaggctcctgctgcacgggcccgatcccgttcccggcgccgcgggctccgccgctgccccgcgcggccgctgcctcctgctcgccccggcgcccgcagccccggtcccgccgcggcggggctcctcggcctggctcctggaggagctgctgcggcccgactgccccgagcccgcgggcttggacgcgacacgggaggggcccgatcggaacttccgactgagcgagcaccgccaggccctggccgccgccaagcaccgaggccccgcggcgaccccggggagccccgatcccggccccggtccgtggggcgaagagcacttggcggagaggggccccaggggctgggagaggggcggcgatcgctgcgacgcgcccggtggggacgcggcgcggaggcccgacccagaggccgaggcaccccccgccgggagcatcgaggccgccccgagtagtgcggcggagccggtgatcgtctccaggtcggatcccagagacgagaagctggccctatacctggccgaggtggagaagcaggacaagtatctgcggcagaggaataagtaccgattccacatcattccagacggcaactgcctctaccgagctgtcagcaagacggtgtatggggaccagagcctgcaccgggagttgagggagcagacggtgcactacatcgccgaccatctcgaccacttcagccccctgattgagggcgacgtgggggagtttatcatcgctgctgcccaagacggggcatgggccgggtacccggagttgctggccatggggcagatgctgaatgtgaatatccatttaactactggagggaggctggagagtcccacggtgtctaccatgattcattatttgggcccagaggattccctgaggcctagtatttggctcagttggctcagtaacggacactatgatgctgtatttgatcactcctatcctaacccagagtacgacaactggtgcaaacaaactcaagtgcaaaggaaacgcgacgaagaacttgccaaatctatggccatatccttgtctaaaatgtatattgaacaaaatgcatgctcttgaaatgtctcaaaaccttacaccctgggaataattgcatatataacttgtgtttggagaatcacatgaactttaatcagggtaatagcactttcaaacttgctagtagattttactgtaggtgtaatgccttaatcatctttttgaatgttttctcagagctggaggttgctgggcacctaaatgatgtttcatgatagctttgggtgattttactgctatttataatttgctgtataaagtgagcattacttaatttgcaagctgatttctcacagtgtaaatttgttcattcctggtagtctattttctataaaaatgtatttttgcacaacatttttaaaaactggtgtaccttcatctatgacgtgttccattttgacaaacagctttcaggcgtaaatccagagaagtgctttatatgaaatgtattattttgaacagagtttgtgatttggtagttattttatgttgttgaaatttgaatttcacaattcttagataattatttcaaatggatattgatgcattcttgttaccagatgtttggcccattccattttgatgaaacagagctgttgttttggaagtcattatttttctagaaatggcgaatcttttaaagaaaattacttaatggaaggttgtgggaaggtgtttttttgtgttttttttttggtttttgttttgtttttcctcttttaagggatagtagcaggtcttacttgaatgaaagtctgatatttgctgatggcagaatgattattctgtaccctggttgatgtgtagagtagattgtctggtgctctcagttgtttttatttacatttgtcacgttgttgtaagagaatgttaacatggtataaaactctgtgacaagataagcctcctgctttatataacttcttgaatccagctaagagatttataaactaatggcataaatgtctggagccaaccttggcagttatagcaggagaacactgtcttaatatttctttacattctttcaaaaggcaaaataggattgccctgtattgatgtagaaatgtctgtaaacagagcttgtatggtttgctgggtcaaacaatgtttccaacttaaaatcaatctcattgccactttaactacttttagtcatatttattaagtaatgcagtttgtactttttttattttgtaacattttgtgatttttttgtacaaaactgtatttgtacaatagagcaattcccagctgatggaatgaatgaataaaatgcaaaattatacttttacaatgcctttttggatagagtggtttttaaattgtgatgtttgtaggaaactttcttgcatgtatgcatgtacacaattttttttttccataaagatgccacagcaatagagaggtttcctaaattatcacatgaagaggataggctaatcatgagtaatttcaaaggataagtctgaataaaatataatttaaaagtggagtaatccaagaaa

SEQ ID NO: 162932 - DNA, 6397 bp, Homo sapiens
  Payload ID: 12105
  Gene Symbol: OTUD3
  Gene Name: OTU deubiquitinase 3
  Uniprot ID: Q5T2D3
  ENST ID: ENST00000375120
  CDS Start-End: 2-1198
catgtcccgaaagcaggcggcgaagagccggccgggcagcggcagccggaaagccgaggccgagcgcaagcgggacgagcgggcggcgcgccgggccctggccaaggagcggcggaatcggccggagtctggcggcggcggcggctgcgaggaggagttcgtcagcttcgccaaccagctgcaggccctggggctgaagctgcgggaggtgccgggggacggcaattgcttgttcagagctcttggtgatcaattggagggacactcacgaaatcatctcaagcacagacaggagacagtggactacatgataaagcagcgggaagattttgaaccctttgtagaagatgacattccttttgagaagcatgtggccagtttggcaaagcctggtacttttgctggcaatgatgcaattgtagcctttgcaagaaatcatcagttgaatgtagtgattcatcaacttaatgcccctttgtggcagattcgtggtacagagaaaagcagcgtgagggagttacacatcgcatatcggtatggagagcactacgacagtgttcggaggatcaatgacaactcagaggcacctgcacatctccagacggattttcagatgcttcatcaagatgaatcaaataaaagagaaaagatcaagacaaagggaatggactctgaagacgacctgagagatgaagtagaggatgctgtccagaaagtttgtaatgcaactggatgttcagattttaatttaatagtccagaacctggaagctgaaaattataatattgaatctgcaataattgccgtgcttcggatgaaccaagggaagagaaataatgcagaagagaatcttgagcccagtggtcgagtgctgaagcagtgtggccctttgtgggaggagggtggcagtggtgccagaatctttggaaatcagggcttaaatgaaggcaggaccgaaaacaataaggcacaggccagccctagtgaagaaaacaaagcaaataaaaaccagctcgcaaaggtcacaaacaaacagaggcgagaacagcagtggatggagaagaagaagcggcaggaggagaggcaccgccacaaagccctggagagcagaggtagccacagggacaataacagaagcgaagcagaggcgaacacgcaggtcaccttggtgaagaccttcgccgctctcaacatctgactctttggcctcttgggagttgtaagaagcggctggaaaaggattgctgtgtgctagactttccagtgaggccgtccttttataaaacgcaacacaaccaacgaagcccacacatgagctcacacactgagttagtttcgttcaagctgcctctttttttgttcgaagttttattagtgatatgttggtgttttatgaaaatgcagtgaggccattcatattctgtaatacaaaattaaaatactgagttttaggggcagatagttaggtcaggaaaaaccttttaagtggtggctttatttgccctgaaaatcagacttcagtgaccctaggatctttccttaacatttggggtgagttttgctgtaattgttcatgagtagtttagaataattgttagaaattcagaatgacaagtttccttagtttctctttcattctcaaacagatatatagggtagcttataaatgatctccaactcaggaatatgctttgatttacttctaatccaagttactcagaaaataattcaggaattgttttcccaaagttacgtgagggttgtggcctgcagtcaggatggaaattaaccgcatttctctccttcctgattctgatgttatttcagatgggatgcaggtgctgttagttcatttgcactcaagccatatgataaatgcagctgactgttaattaggcctggccttgttgggaagttgatagtggtgttgggtttttggtatttgtttcctgacagtggggagatggcatgttactgcttgtgatacagttctggaattctgatagtgtgtagagcagggtctatagttgtaacaggagacgaactcctggggttttgcctaagaggagtctaaagaattatgtttttataggagaagcctggaagaataaggtttttcatgttcgcattttaaataacgattttcttcccttctgttgtagacttagatgccttcagagagatacgtggtaacttgaccttataggtcgctaaacttagtattgtggaaattaaatcttataaaatgctacatttatttctttttatttaagccctgtttggcatttcaaagttgggaaaactccagcatctgctggaagttgttggaccagcagggttggttgacttaggttggaccagcagagaagagaacatactttggttgaggccttcgaatcactcttcagttctgaaatagacagacttgagcagtggagagacgtctttcctaaaactgagttaggtggatgtgaacttaagaactataacgtatgaggcagcccatcttggatcatctttgtcttttgggacctaatacttgggcaaataattgatgctgagttgaaaggtaaattattagttatcttccccacccctcgcatttcagaattataaaaattcggaggcaaattgaaaactaaaatgtttggtaggccctggagtcgccagattgtctttatcaccaggcctttggctttcttcagtttcactggtatcttttggttttgtttttgactttggtggctttttgtagttggagcatcagtagtctcttggaattgctcctaggacattgtggtttaggtttcttcctgggtacagtacattgtaaaatttagcagattaaaaaaagtacacagcattttttttctgtgcacgtcgcagagtcctgagcttgaggctgtgttactctactcattccaaacgaatgaaagatctctgttgccttactctaaggaagtgggatcgagtgcgttaggatctatggttgtcttggttttcaactctgggcagattcctgactggctgagtgtttctgaatgaagatgttttcctgtctgttttgtactgcttgagtgcagaggccagatcctctcagaaagataagattgtatgccagaaattcagattagcagtcagcttaagagagacttattgtcagaagtagtagaattgctttatttacttggttaatgaaggtggccttgggccctattgggttttagaagttttagaagctgctaaaaagttattaaagaatattgggaacatttattttttaaattacctaattctggtaataggcttcagcatttctggagtataataatggtggtttaaaaaactaatcaaacggctttagtaattttactactggtttcacagcttttcagttacagttggtctgtttagtgtgttaattattaggaatcgggtacatgcatccaacttcagtgataccttctagctaatggtttcaatttagacttcactgcctcagtctcactgggtacatgagaaggttggaatcaacatgcttagttgcctcagtgggcacttgaaaattccttcactggcagcccgagtggaggcccagtatgtctagtcctgggatgactgttgtcagcagctgttactctagtacaggtgctcctgtgaactctttattaggaactgaatgtgtcttaacctctgtgttacatcttggctggcagagatttatgttacatgagattgtcttggtagcttgtagtgtggtcaggagaaaggggatggagcagtggtgcatagctgcttactgctcttataaacggtatataaaggttttacggattttgaaaatatttttttttagaggtcaaaataaataccattttagtggcaacagctttgaactagagaggtagatgtattaaagcagcatagaaccataacttctagataatgtagttgccactaggagatattagaaagttagaatgtatgtgtgtatttagtttttcaataataatgaacatacactttcaggagcaaagtatggttgagaaattgtggcagaaagaattttaaatgttagtcgaagttgtctgtagtttctttattaagctctgaaaacacttccaatgccagtttgattctgagggcttgggaagtgggatctcccttgtggagcagctggagctggctgggagggagcctctccatgggtaatttattatgcctgccctgcttcccccagggagctgcttcagtgtgaaatgatgtgattgtcgggggtggggtgggaggagggccaccttcagtcggggagttgctcacatattacacaggtagcatcaggtggacttcagcgctgaactgtactagtagtgagtccctgtagtcaatgtgcaatttctctaattctgagaaactctgtagactctgcctgggttttactgggtcagcatagaatgctatcagtttacctctgtgaaatattcagtcagttgaaggaaacttggattcctagtcagaggtgactaaaagttaccctgaccaaaaggatctctgcggggggaagagaatggagcttcctgattttaatgtgttgcgtcagtggccctcttcgactcccgttttgggtagatgcgtagctcttcactttcttacctcaaggctctgtctagccatgttaaatctttagactcagtctgatgccgtttttctgttttgccattctcattattcacagctttcagaacaagtgttgctaaaactccggggcctttgacagttgttctgaggtgatttaataatggactttttataagttatgttttcctggctctaaagtaaatttttttttttttttttttgagacagagtcttgctttgttgcccaggctggagtgtggtggggcaatctcggctcactgcaacctccacctcccgggttcaagcgattctcctgcctcagcctcctgagtagctgggattacaggtgtgtgccaccatgcttggctaatttttgtatttttagtagagacggggtttcaccatgttagccaggctggtctcaaactcctgaccttgtgatctgcccgcctcagcctcccaaagtgctaggattacgggtgtgagcaaccctgcccggccagtaaattgtatttttttaatgacatcattgatttgaagatctagatggcataaattacgacgtctgccatcgcatattagaaaggggacagtcatatttgtaacgtggagagaacacggagcaccagtcaccacgtgcacttaggatgcagagcttaccgcacaccgctgatggggacctccggaaagagcggtgccttgtggttggcctggaagttctctcccaaggtgaaattcctttaaaacctcaggctctgacctatgtctttgaagcagctgctttgtagagtccctctctttactgtcctcgttaggactgttttgtggttccatgaaaatgtttagcatccttgcagaattacttgagaaggggctggtaccagtgtaaagaatctatttctgtaaaactacgaacttttgcatagggaatttattctaagcaggtcatagccgtgatccagagctgctgctgctcactgccagtccttgcggctggcggcgattgccggacagactctctgtggcctggctctcatccttggcgtgtcagcctgcggcaggctgccagccatccatgacaatcatgtgagctcagccacagacctcagctggcggtttgatccctggcaggtccctcgagcagtactggtaagaggcttcacacattttcccactcttacagttcatttttcatagtaggaagggcccttggcctccccagtgcctcttccagagcctccaccagcactaagctcagaggaaagaagaaaagggccaggagtcagacgtcacacccgggggctcccctttcccatgtagaagtgttggcatgcgtcagtctcctttacagaggggtggatgtatccgtggaggaggggccttctctctttctaattgcactatacttgttctagcttcagtctggagatacttaagacctccatggggtcgtgatccatagacttagcaagtcttgccttatctatggagctcgatggtgagaattgtgaccattgtctgatgtccatagttccttccccctagattgtttctttccacggattgtgttcatctgaaccattttattttttatttaccaaagtactgtacttggctatttgcagtgttttcaaaaccaaatgtttctttttttgtgtttttaatcttcgatacttggtgcaatagaagctgcaaagatgtgccactttatctatgaaatggagttttgtataccaataaattctagtttaaaaacaaa

SEQ ID NO: 162933 - DNA, 3829 bp, Homo sapiens
  Payload ID: 12106
  Gene Symbol: OTUD4
  Gene Name: OTU deubiquitinase 4
  Uniprot ID: Q01804
  ENST ID: ENST00000447906
  CDS Start-End: 189-3533
ggcagggcttccctatgcgcccggagagcgcggaccgctgcctcgggccgccgccgcctgccgccgctcgcggagcccgagccccagcccgagccgccgcctgccccaggccggggcgtcgagcagccggcggcctggccatgtggggctagccctcgccgcgcctggcctgcagcaggaccagcaacatggaggctgccgtcggcgtccccgacggcggggaccagggcggcgcggggccccgcgaggacgcgacgcccatggacgcctatctgcggaaactgggcttgtatcggaaactggtcgccaaggacgggtcgtgcctgttccgggccgtggcggagcaggtattgcactctcagtctcgccatgttgaagtcagaatggcctgtattcactatcttcgagagaacagagagaaatttgaagcgtttatagaaggatcatttgaagaatatttaaagcgtttggaaaatccacaggaatgggtaggacaagtggaaataagtgccctttctcttatgtacaggaaagattttataatttatcgggaaccaaatgtttctccttcacaagtaacagaaaataattttcctgaaaaggtgttactgtgtttttcaaatggaaatcattatgatattgtgtatcccataaagtataaagaaagctctgctatgtgtcagtctctcctttatgaattgctgtatgagaaggtatttaaaactgatgttagtaaaattgtgatggaactagacacgttggaagtagctgatgaagataacagtgaaatatcagattcagaggatgacagttgcaagagtaagactgctgctgctgctgctgatgtgaatggatttaaacctttgtcaggcaatgagcagctgaagaacaatgggaactctactagcctgcctttgtctagaaaggttcttaagtcactcaatcctgcagtctatagaaatgtggaatatgaaatttggctgaagtctaaacaagctcagcaaaaacgtgattattccattgctgctggcttacaatatgaagttggagacaaatgtcaagttaggttggatcacaatggaaaatttttgaatgcagatgttcaaggaattcattctgagaatggaccagttttggttgaagaactgggaaagaagcacacatcaaagaacctcaaggcacctcccccagaaagctggaacacagtgtcagggaagaagatgaaaaaaccttccacttctggacaaaatttccattctgatgtggattacagagggccaaagaatccaagcaagccaataaaagccccatcagcactacctcctcgactgcagcatccttcaggagtaagacaacatgcgttctctagtcattcttcagggtcacagtctcagaaattctccagtgagcacaaaaatcttagccggacaccttcacagatcataagaaaacctgatcgtgaaagagttgaggattttgatcacacaagtcgagaatctaactatttcggcctttccccagaagagcgcagagagaagcaagctatagaagaatcccgtttactctatgagattcagaacagagatgaacaggctttcccagccctttccagctcatcagtcaatcagtcagcttctcagagtagcaatccatgtgtccagagaaaatcatcacatgtaggtgatagaaaaggaagcaggcggagaatggatacagaagaacgaaaagacaaagactctattcatggacatagtcagttggataaaagacccgaaccaagcacattggagaatattactgatgataaatatgcaacagtttcatcaccatcaaagtcaaagaagttagagtgcccttctcctgcggaacaaaagccagcagaacatgtgtctttgtcaaatccagctccccttctagtttctccagaggtacatctaactcctgcggtgccttctttaccagccactgtgccagcctggccaagtgaacctacaacttttggaccaacaggtgtccctgctccaattcccgttttgtcagtgacacagactttgaccactggacctgattcagctgtatcccaagctcatttaacaccctctccagttcctgtgtcaatacaggcagttaaccagcccttgatgcctttgcctcagacattgagcctttatcaagacccactctatcctgggtttccttgtaatgaaaagggagatcgagccattgtaccaccttattcactgtgtcagactggggaggacctacctaaagataagaatattcttcgattcttcttcaatcttggtgtgaaggcatacagttgtcctatgtgggccccacattcttacctgtaccctctgcaccaggcctacctggcagcctgcaggatgtacccaaaggtccctgtccctgtttatcctcataatccctggttccaagaggctcctgctgctcagaatgaaagtgattgtacctgtactgatgcccactttcctatgcagactgaggccagtgttaatggtcaaatgccacagccagagattggaccgccgacattttcttcacctctggttatccctccatctcaggtgtctgaaagtcatggacaattgtcttaccaggctgatcttgaatctgagacccctgggcagcttctgcatgctgattatgaagagtcactaagtggcaagaatatgttcccccagccatcttttggacccaatccattcttaggcccagttcctattgcacctcctttctttcctcatgtttggtatgggtacccttttcagggattcatagaaaatccagtaatgaggcagaatattgtcctgccctctgatgaaaaaggagaattggatctgtctctggaaaatctggatctgtctaaagattgtggttcagtttcaacagtagatgagtttccagaagccaggggtgaacatgtacattctctccctgaagcaagtgtgagcagtaagccggacgaaggccggacagagcaatcttcccagacacgaaaggcagatacggcattggcttccatccctcctgtagcagagggaaaggctcatcctcccactcagattctaaacagagagagagaaactgtgcctgttgaacttgaacctaaaaggaccattcaaagcctgaaagaaaaaacagaaaaagtaaaagatcctaagactgctgctgatgtggtcagccctggggccaactctgttgatagcagagtgcaaagaccaaaagaagagagttcagaagatgaaaatgaagtgtctaatattttgagaagtggtagatccaagcagttctataatcaaacttatggaagcaggaagtacaaaagtgattggggctattctggtaggggtggatatcaacatgtgagaagtgaggagtcctggaaaggacagccaagcagaagtcgggatgaaggttatcagtaccatcgaaatgtcagagggcgaccatttaggggagataggaggagatcagggatgggagatggccataggggacagcacacttgatggttgttgccgaagtattttctaacagaaactcttaggtggaatgtttctgaaggctttaaaaaaaatacaataaagtaaaaaccgcagttggaactctttcctctccccagccccccttaccttcactcccatactggacaagacattttggacatgagttcaagggggcaggttaattcctggcattgccagttttcttcattcagaatctgtttgttgatcaagtgactgtccccgtaaaaagtagaagataagtttgttaaagtattttttataaacagcttaatataaaa

SEQ ID NO: 162934 - DNA, 7069 bp, Homo sapiens
  Payload ID: 12106
  Gene Symbol: OTUD4
  Gene Name: OTU deubiquitinase 4
  Uniprot ID: Q01804
  ENST ID: ENST00000454497
  CDS Start-End: 139-3288
cccattgtaacgccggagtgggacgctgctttgcgtctgaaaggtgcaaattgaaactcgaaagcccgcaaattaacggggtgtctctctcctgatgaagaggtattgcactctcagtctcgccatgttgaagtcagaatggcctgtattcactatcttcgagagaacagagagaaatttgaagcgtttatagaaggatcatttgaagaatatttaaagcgtttggaaaatccacaggaatgggtaggacaagtggaaataagtgccctttctcttatgtacaggaaagattttataatttatcgggaaccaaatgtttctccttcacaagtaacagaaaataattttcctgaaaaggtgttactgtgtttttcaaatggaaatcattatgatattgtgtatcccataaagtataaagaaagctctgctatgtgtcagtctctcctttatgaattgctgtatgagaaggtatttaaaactgatgttagtaaaattgtgatggaactagacacgttggaagtagctgatgaagataacagtgaaatatcagattcagaggatgacagttgcaagagtaagactgctgctgctgctgctgatgtgaatggatttaaacctttgtcaggcaatgagcagctgaagaacaatgggaactctactagcctgcctttgtctagaaaggttcttaagtcactcaatcctgcagtctatagaaatgtggaatatgaaatttggctgaagtctaaacaagctcagcaaaaacgtgattattccattgctgctggcttacaatatgaagttggagacaaatgtcaagttaggttggatcacaatggaaaatttttgaatgcagatgttcaaggaattcattctgagaatggaccagttttggttgaagaactgggaaagaagcacacatcaaagaacctcaaggcacctcccccagaaagctggaacacagtgtcagggaagaagatgaaaaaaccttccacttctggacaaaatttccattctgatgtggattacagagggccaaagaatccaagcaagccaataaaagccccatcagcactacctcctcgactgcagcatccttcaggagtaagacaacatgcgttctctagtcattcttcagggtcacagtctcagaaattctccagtgagcacaaaaatcttagccggacaccttcacagatcataagaaaacctgatcgtgaaagagttgaggattttgatcacacaagtcgagaatctaactatttcggcctttccccagaagagcgcagagagaagcaagctatagaagaatcccgtttactctatgagattcagaacagagatgaacaggctttcccagccctttccagctcatcagtcaatcagtcagcttctcagagtagcaatccatgtgtccagagaaaatcatcacatgtaggtgatagaaaaggaagcaggcggagaatggatacagaagaacgaaaagacaaagactctattcatggacatagtcagttggataaaagacccgaaccaagcacattggagaatattactgatgataaatatgcaacagtttcatcaccatcaaagtcaaagaagttagagtgcccttctcctgcggaacaaaagccagcagaacatgtgtctttgtcaaatccagctccccttctagtttctccagaggtacatctaactcctgcggtgccttctttaccagccactgtgccagcctggccaagtgaacctacaacttttggaccaacaggtgtccctgctccaattcccgttttgtcagtgacacagactttgaccactggacctgattcagctgtatcccaagctcatttaacaccctctccagttcctgtgtcaatacaggcagttaaccagcccttgatgcctttgcctcagacattgagcctttatcaagacccactctatcctgggtttccttgtaatgaaaagggagatcgagccattgtaccaccttattcactgtgtcagactggggaggacctacctaaagataagaatattcttcgattcttcttcaatcttggtgtgaaggcatacagttgtcctatgtgggccccacattcttacctgtaccctctgcaccaggcctacctggcagcctgcaggatgtacccaaaggtccctgtccctgtttatcctcataatccctggttccaagaggctcctgctgctcagaatgaaagtgattgtacctgtactgatgcccactttcctatgcagactgaggccagtgttaatggtcaaatgccacagccagagattggaccgccgacattttcttcacctctggttatccctccatctcaggtgtctgaaagtcatggacaattgtcttaccaggctgatcttgaatctgagacccctgggcagcttctgcatgctgattatgaagagtcactaagtggcaagaatatgttcccccagccatcttttggacccaatccattcttaggcccagttcctattgcacctcctttctttcctcatgtttggtatgggtacccttttcagggattcatagaaaatccagtaatgaggcagaatattgtcctgccctctgatgaaaaaggagaattggatctgtctctggaaaatctggatctgtctaaagattgtggttcagtttcaacagtagatgagtttccagaagccaggggtgaacatgtacattctctccctgaagcaagtgtgagcagtaagccggacgaaggccggacagagcaatcttcccagacacgaaaggcagatacggcattggcttccatccctcctgtagcagagggaaaggctcatcctcccactcagattctaaacagagagagagaaactgtgcctgttgaacttgaacctaaaaggaccattcaaagcctgaaagaaaaaacagaaaaagtaaaagatcctaagactgctgctgatgtggtcagccctggggccaactctgttgatagcagagtgcaaagaccaaaagaagagagttcagaagatgaaaatgaagtgtctaatattttgagaagtggtagatccaagcagttctataatcaaacttatggaagcaggaagtacaaaagtgattggggctattctggtaggggtggatatcaacatgtgagaagtgaggagtcctggaaaggacagccaagcagaagtcgggatgaaggttatcagtaccatcgaaatgtcagagggcgaccatttaggggagataggaggagatcagggatgggagatggccataggggacagcacacttgatggttgttgccgaagtattttctaacagaaactcttaggtggaatgtttctgaaggctttaaaaaaaatacaataaagtaaaaaccgcagttggaactctttcctctccccagccccccttaccttcactcccatactggacaagacattttggacatgagttcaagggggcaggttaattcctggcattgccagttttcttcattcagaatctgtttgttgatcaagtgactgtccccgtaaaaagtagaagataagtttgttaaagtattttttataaacagcttaatataaaacattatagatttagtgtttggcttttttccttataagtttataagtttgatttcagatgttggaaatgtgtgctttatagtgtttactaaagtgacaagaaaatataccatttgacacactatagattccaaacataacgttgcaccaaatagaaatgtatattttattatgcaatgccttagtcataaactgggctcaaacaattctcagcctaaaacactgttgtcttttaaaatgcttccaacccaaaggcctttcatctcaatatctgtcaaacttgaataatgtcttctctttaatattcacataaggcagcctattaactgtgtcttagcaatgttgtatatagttcttttaatattcataaggtatatttttgaattttggtatttgttgagattgcatagaagaatagtaggaaatccaatgaaatggctgtttccaccaagaattcttagcactggtgtaaatatcatggtgcctactcgaaagaaatgtagatgctatgcattttgaaaataatctgcatcagttagaactgcagaagtttttttaatgccactttaacactaatgcactgacagattctaaatattttgtgagaagaaatgttaaaaatttttagcttgacaggtttctagagttgttttcttcctcccccccccccccgcaccattggttgtgtatcactttcactttacacttgcatgttctacttgtcagggctggaactattgtatagaagataatatgattgtgacttctagttcttttctagaggatgctgctagaaaatggttttgctttgtattttatagcttgttacccttaggtaggtaacatcttacattctgttttcttccagtctttgcagtattcactagaggttccctttgcatgttgcactctgttctcatttggagattgaactctgaattaacacagtattcattcatctgtgttattttgtaaaaataactgtagcttatattctttatttgtgcataccaatgtgaaaatccactcttttattatgttgagattatcttctgatcaggaagtttgagtgctatgcaaataacatagtagtaatttctctttgcatgccatgtgtaatatacctagccaaaaccagatgcggtgactttctttttttgtaaagcaaattacttaagaaaatacaattcacttgaatttgacaaactgaaacagatgggttttctgggttctctgataacctatgggaatgtttggatgccagttgggctagtgaatcgccactgtactgtaataatggttatttacctctgtgctgttttaattacctaacgtctgtgtaactgctgatttgagtagtgattagcatttagataatgtaacaggattttagagagcactttgaaagataacattttattatgatggtgctaggtaaaaaattgtaaagactgggatggttgtgtggaaaacttttcttgagagaacctattgaaaggaatttgttgtcaccttcttaactagaatagttgttgaaggtaccgcttaagccatttttttcttaacatcggtggctcagttaaggaatgagaagatagagggtcctccactttcagctcatgcttttttatgtaggactagcttacctgattttaatgaaaatcacattttgatacaaacaccagatttgaaagttcaatgtgtttgatctcaggagtccaaaataagttgttgcttctagtgtcctgcattttattgactggggtttgatctcagcttctgaaaatgtttaaaaattggaaggaaatactactcatatcttcattgtcactttgtcttacctcaattgagtaacagaatatagctcctgaaggaaacactgatttgctttctgtttcccatatctcacctctaggatatgatggaagaagtgcttgaaagagaattttagcagatggtacttttctcagtgacctctggaataaaagaactgacttttgatagttttaaaattaatctttgcatgaaggttggtttcgctttttttcctttaagtttgtttttaaatgtattagtccaggggattttgccttatgctgaggtcaaactaaggataagcaagcttttgtccttcattttaactgttatgtcatactgttatgttgacatatttctttataagagaatagaggcaaaagtatagaactgaggatcatttgtatttttgagttggaaattatgaaacttcaccatattatgatcatacatattttgaagaacagactgaccaaagctcacctgttttttgtgttaggtgctttggctgaacttgattccagcccccttttccctttggtgttgtgtatgtctcttcatttcctctcaaatcttcaactcttgccccatgtctccttggcagcaggatgctggcatctgtgtagtcctcatactgtttactgataacccacaaattcattttcatggcagacctaagctcagaccctgccttgtcctggcaagcataggttttcccagaccacaatgctgatatatcttatttaatgcagactgtattcttgcagcgtgttgtttcctttgtgactcaaggttgaattaaaatgcctgtgaactgcaaacttgcttatgattgacttggtgcaataaagttcctttctaaccatttctggtttagaaaacattcagccatcctagaaactagcaatatttatttttgcctctttcgttttaccttcatttttagatgaggtaaatgttttgtcttttacttaagggtactaagcaaggtccactctagtgtagctgaagagaatgcatatttggctacactatttctgtttactgtattttgcttcctactttatgtctaaatgctattgtttgtttaaaatcctaataatgtctcatttccaatatgttattttcagataactaaggttttgctactaatgtcagccatttactctcccactaattgggattattttttaaaagaggtctttctccccgaaatacaagttttagaaaatcttagaagaggggtgggtgcatgtcttaatgctgggaagcggcaactttggggttgaacttacttgaatggattaaaaattgcattgtgttacagagctagaaaattttatgtatgaaaaacgataatagccttacactgagtacaaataatactttaagagcatgtgaagatgtgatcatttgtgatgttacttgtaaaaaaaagtatatatacatatcttttgaagtgttaaaaggaaactagtactttatattctttatcatatcactttttgtaagtgttgaatatattcctgtttatttttctatgttctgttttgtagccttaagaagtgtttcaaacatatctgaatgtataaaataagagtaaatgccctacatggtgtgatgctgcattatatataaaactgtgtgcatatattaaattttgtctcttgat

SEQ ID NO: 162935 - DNA, 543 bp, Homo sapiens
  Payload ID: 12106
  Gene Symbol: OTUD4
  Gene Name: OTU deubiquitinase 4
  ENST ID: ENST00000504501
  CDS Start-End: 127-543
aaattaacggggtgtctctctcctgatgaagagtgttgctgtggggtatgttcacagccacccactgcctccggtccttattgttagtaggtattgcactctcagtctcgccatgttgaagtcagaatggcctgtattcactatcttcgagagaacagagagaaatttgaagcgtttatagaaggatcatttgaagaatatttaaagcgtttggaaaatccacaggaatgggtaggacaagtggaaataagtgccctttctcttatgtacaggaaagattttataatttatcgggaaccaaatgtttctccttcacaagtaacagaaaataattttcctgaaaaggtgttactgtgtttttcaaatggaaatcattatgatattgtgtatcccataaagtataaagaaagctctgctatgtgtcagtctctcctttatgaattgctgtatgagaaggtatttaaaactgatgttagtaaaattgtgatggaactagacacgttggaagtagctgatgaagataacagtgaaatatcagattca

SEQ ID NO: 162936 - DNA, 864 bp, Homo sapiens
  Payload ID: 12106
  Gene Symbol: OTUD4
  Gene Name: OTU deubiquitinase 4
  Uniprot ID: Q01804
  ENST ID: ENST00000509620
  CDS Start-End: 65-502
ttacactaagaactctttgttacatcaggtattgcactctcagtctcgccatgttgaagtcagaatggcctgtattcactatcttcgagagaacagagagaaatttgaagcgtttatagaaggatcatttgaagaatatttaaagcgtttggaaaatccacaggaatgggtaggacaagtggaaataagtgccctttctcttatgtacaggaaagattttataatttatcgggaaccaaatgtttctccttcacaagtaacagaaaataattttcctgaaaaggtgttactgtgtttttcaaatggaaatcattatgatattgtgtatcccataaagtataaagaaagctctgctatgtgtcagtctctcctttatgaattgctgtatgagaaggtatttaaaactgatgttagtaaaattgtgatggaactagacacgttggaagtagctgatgaagataacagtgaaatatcagattcagaggatgacagttgcaagtaagaatgaaatcctaaaatacctttcttagtgccatacaaggaaagttaagtaaatgtctttacatttcagtaaatgtctttctataacatatattgaggtattaatggtattcataaaatacagcagtctgctgaagtttctttatccctgtcactaattttacctaatttctattatgggactgtttgttttgaaagttggtgtttttggttgatgagaatttacgtctgcaatctagatgcatatttgtagaataaatttggtcctacctatatgtgtgtgtattgtaaaattttaaagttaacttgtcaattgttcacatacccagtaatgaaataaaatggccgtttggatttccttca

SEQ ID NO: 162937 - DNA, 1255 bp, Homo sapiens
  Payload ID: 12106
  Gene Symbol: OTUD4
  Gene Name: OTU deubiquitinase 4
  ENST ID: ENST00000514973
  CDS Start-End: 139-1255
cccattgtaacgccggagtgggacgctgctttgcgtctgaaaggtgcaaattgaaactcgaaagcccgcaaattaacggggtgtctctctcctgatgaagaggtattgcactctcagtctcgccatgttgaagtcagaatggcctgtattcactatcttcgagagaacagagagaaatttgaagcgtttatagaaggatcatttgaagaatatttaaagcgtttggaaaatccacaggaatgggtaggacaagtggaaataagtgccctttctcttatgtacaggaaagattttataatttatcgggaaccaaatgtttctccttcacaagtaacagaaaataattttcctgaaaaggtgttactgtgtttttcaaatggaaatcattatgatattgtgtatcccataaagtataaagaaagctctgctatgtgtcagtctctcctttatgaattgctgtatgagaaggtatttaaaactgatgttagtaaaattgtgatggaactagacacgttggaagtagctgatgaagataacagtgaaatatcagattcagaggatgacagttgcaagagtaagactgctgctgctgctgctgatgtgaatggatttaaacctttgtcaggcaatgagctgaagaacaatgggaactctactagcctgcctttgtctagaaaggttcttaagtcactcaatcctgcagtctatagaaatgtggaatatgaaatttggctgaagtctaaacaagctcagcaaaaacgtgattattccattgctgctggcttacaatatgaagttggagacaaatgtcaagttaggttggatcacaatggaaaatttttgaatgcagatgttcaaggaattcattctgagaatggaccagttttggttgaagaactgggaaagaagcacacatcaaagaacctcaaggcacctcccccagaaagctggaacacagtgtcagggaagaagatgaaaaaaccttccacttctggacaaaatttccattctgatgtggattacagagggccaaagaatccaagcaagccaataaaagccccatcagcactacctcctcgactgcagcatccttcaggagtaagacaacatgcgttctctagtcattcttcagggtcacagtctcagaaattctccagtgagcacaaaaatcttagccggacaccttcacagatcataagaaaacctgatcgtgaaagagttgaggattttgatcacacaagtcgagaatctaact

SEQ ID NO: 162938 - DNA, 2740 bp, Homo sapiens
  Payload ID: 12107
  Gene Symbol: OTUD5
  Gene Name: OTU deubiquitinase 5
  Uniprot ID: Q96G74
  ENST ID: ENST00000156084
  CDS Start-End: 62-1777
ccgggttctctcccggcgtgccccgcgccgggtttgttggggggtactcggcagtgcagccatgactatactccccaaaaagaagccgccgcctcccgacgccgaccccgccaacgagccgccgccgcccgggccgatgcccccggcgccgcggcgcggcggaggtgtgggcgtgggcggcggcggcacgggcgtgggcggcggcgatcgcgaccgtgactccggcgtcgtgggggcccgtccgcgagcttcgccaccgcctcaaggcccgctaccaggaccgccgggcgctcttcatcgctgggcgctggccgtgccgcctggtgcagtggcgggtccccggccacaacaggcttctccacctccttgcgggggcccaggtggtcccggcggcggtcccggcgacgcgctgggcgcagcggcggcgggtgtgggtgccgcgggcgtggtggtgggtgtgggtggtgccgtaggcgtgggcggctgctgctccgggcctgggcacagcaagcggcgacgtcaagctcccggggttggcgcggttggcgggggcagtcccgagcgtgaggaggtcggcgcaggctacaacagtgaggacgagtatgaggcggctgcagcacgcatcgaggctatggaccctgccactgtcgagcagcaggagcattggtttgaaaaggccctacgagacaagaagggcttcatcatcaagcagatgaaggaggatggcgcctgtctcttccgggctgtagctgaccaggtgtatggagaccaggacatgcatgaggttgtgcgaaagcattgcatggactatctgatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacaggtacttctgcagtggaacccatcaacacattccatgggatacatcaaaacgaggacgaacccattcgtgttagctaccatcggaatatccactataattcagtggtgaatcctaacaaggccaccattggtgtggggctgggcctgccatcattcaaaccagggtttgcagagcagtctctgatgaagaatgccataaaaacatcggaggagtcatggattgaacagcagatgctagaagacaagaaacgggccacagactgggaggccacaaatgaagccatcgaggagcaggtggctcgggaatcctacctgcagtggttgcgggatcaggagaaacaggctcgccaggtccgaggccccagccagccccggaaagccagcgccacatgcagttcggccacagcagcagcctccagtggcctggaggagtggactagccggtccccgcggcagcggagttcagcctcgtcacctgagcaccctgagctgcatgctgaattgggcatgaagcccccttccccaggcactgttttagctcttgccaaacctccttcgccctgtgcgccaggtacaagcagtcagttctcggcaggggccgaccgggcaacttccccccttgtgtccctctaccctgctttggagtgccgggccctcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagacaagagttgatggagacccagggattggacaccatctcccaaccccagtactcctgctctccggtgccacctcaccttctttggcttcttccctcttgcctccttctgttctttctgctctcccctcttttccctcctcctcacttccctctggctagcccacccctgcactctctctcattgccgctgccactatcacctgtctctctgccagctgatgtgccctgttgccccccaccccatcccgcacagaaccatccctgcattccacaggggactcgggcaagggtgccgaagatagacaagaggcacacagagacagaccaactggcagccaggcagccccagaggagagagacattcagacagaggaaagtctccctgcccctcattccttccaagatgagaaaaacttgccgccaccccccgacactgatgccagggaggtgggaggaagaagtgggaaatttcccttcccagtacccccaagaacgtctgagccttcaatgttgaattttttctttattaaaattacttttatcttataaaatcaactaatcaaaaatgatatagacgacagcactggctctgtgaaggtggcatctttctgggcaggcaggccatggggcatggaggagggtgcaaagatatgggttgctgtcttctggcctccagctgcatggaggccggcccagggtctagggtgtgcactgggcaagggcagggcggcaggtgtcaggccggcttggacaatgaaaccctgaccttgctgcattccttttgcttccaccaccactagcttctttggaatcttggggtgggggtcatctttggggattatggctgccacccgggatttgagtgtagggagtgtgggagcagccttggcagatggggcacccgtgccctgcaggtgttgacaagatccgccatctgtaatgtccttggcacaataaaaccaaatgtcagtttc

SEQ ID NO: 162939 - DNA, 2692 bp, Homo sapiens
  Payload ID: 12107
  Gene Symbol: OTUD5
  Gene Name: OTU deubiquitinase 5
  Uniprot ID: Q96G74
  ENST ID: ENST00000376488
  CDS Start-End: 30-1730
tttgttggggggtactcggcagtgcagccatgactatactccccaaaaagaagccgccgcctcccgacgccgaccccgccaacgagccgccgccgcccgggccgatgcccccggcgccgcggcgcggcggaggtgtgggcgtgggcggcggcggcacgggcgtgggcggcggcgatcgcgaccgtgactccggcgtcgtgggggcccgtccgcgagcttcgccaccgcctcaaggcccgctaccaggaccgccgggcgctcttcatcgctgggcgctggccgtgccgcctggtgcagtggcgggtccccggccacaacaggcttctccacctccttgcgggggcccaggtggtcccggcggcggtcccggcgacgcgctgggcgcagcggcggcgggtgtgggtgccgcgggcgtggtggtgggtgtgggtggtgccgtaggcgtgggcggctgctgctccgggcctgggcacagcaagcggcgacgtcaagctcccggggttggcgcggttggcgggggcagtcccgagcgtgaggaggtcggcgcaggctacaacagtgaggacgagtatgaggcggctgcagcacgcatcgaggctatggaccctgccactgtcgagcagcaggagcattggtttgaaaaggccctacgagacaagaagggcttcatcatcaagcagatgaaggaggatggcgcctgtctcttccgggctgtagctgaccaggtgtatggagaccaggacatgcatgaggttgtgcgaaagcattgcatggactatctgatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacagaacccatcaacacattccatgggatacatcaaaacgaggacgaacccattcgtgttagctaccatcggaatatccactataattcagtggtgaatcctaacaaggccaccattggtgtggggctgggcctgccatcattcaaaccagggtttgcagagcagtctctgatgaagaatgccataaaaacatcggaggagtcatggattgaacagcagatgctagaagacaagaaacgggccacagactgggaggccacaaatgaagccatcgaggagcaggtggctcgggaatcctacctgcagtggttgcgggatcaggagaaacaggctcgccaggtccgaggccccagccagccccggaaagccagcgccacatgcagttcggccacagcagcagcctccagtggcctggaggagtggactagccggtccccgcggcagcggagttcagcctcgtcacctgagcaccctgagctgcatgctgaattgggcatgaagcccccttccccaggcactgttttagctcttgccaaacctccttcgccctgtgcgccaggtacaagcagtcagttctcggcaggggccgaccgggcaacttccccccttgtgtccctctaccctgctttggagtgccgggccctcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagacaagagttgatggagacccagggattggacaccatctcccaaccccagtactcctgctctccggtgccacctcaccttctttggcttcttccctcttgcctccttctgttctttctgctctcccctcttttccctcctcctcacttccctctggctagcccacccctgcactctctctcattgccgctgccactatcacctgtctctctgccagctgatgtgccctgttgccccccaccccatcccgcacagaaccatccctgcattccacaggggactcgggcaagggtgccgaagatagacaagaggcacacagagacagaccaactggcagccaggcagccccagaggagagagacattcagacagaggaaagtctccctgcccctcattccttccaagatgagaaaaacttgccgccaccccccgacactgatgccagggaggtgggaggaagaagtgggaaatttcccttcccagtacccccaagaacgtctgagccttcaatgttgaattttttctttattaaaattacttttatcttataaaatcaactaatcaaaaatgatatagacgacagcactggctctgtgaaggtggcatctttctgggcaggcaggccatggggcatggaggagggtgcaaagatatgggttgctgtcttctggcctccagctgcatggaggccggcccagggtctagggtgtgcactgggcaagggcagggcggcaggtgtcaggccggcttggacaatgaaaccctgaccttgctgcattccttttgcttccaccaccactagcttctttggaatcttggggtgggggtcatctttggggattatggctgccacccgggatttgagtgtagggagtgtgggagcagccttggcagatggggcacccgtgccctgcaggtgttgacaagatccgccatctgtaatgtccttggcacaataaaaccaaatgtcagttt

SEQ ID NO: 162940 - DNA, 2682 bp, Homo sapiens
  Payload ID: 12107
  Gene Symbol: OTUD5
  Gene Name: OTU deubiquitinase 5
  Uniprot ID: Q96G74
  ENST ID: ENST00000396743
  CDS Start-End: 62-1762
ccgggttctctcccggcgtgccccgcgccgggtttgttggggggtactcggcagtgcagccatgactatactccccaaaaagaagccgccgcctcccgacgccgaccccgccaacgagccgccgccgcccgggccgatgcccccggcgccgcggcgcggcggaggtgtgggcgtgggcggcggcggcacgggcgtgggcggcggcgatcgcgaccgtgactccggcgtcgtgggggcccgtccgcgagcttcgccaccgcctcaaggcccgctaccaggaccgccgggcgctcttcatcgctgggcgctggccgtgccgcctggtgcagtggcgggtccccggccacaacaggcttctccacctccttgcgggggcccaggtggtcccggcggcggtcccggcgacgcgctgggcgcagcggcggcgggtgtgggtgccgcgggcgtggtggtgggtgtgggtggtgccgtaggcgtgggcggctgctgctccgggcctgggcacagcaagcggcgacgtcaagctcccggggttggcgcggttggcgggggcagtcccgagcgtgaggaggtcggcgcaggctacaacagtgaggacgagtatgaggcggctgcagcacgcatcgaggctatggaccctgccactgtcgagcagcaggagcattggtttgaaaaggccctacgagacaagaagggcttcatcatcaagcagatgaaggaggatggcgcctgtctcttccgggctgtagctgaccaggtgtatggagaccaggacatgcatgaggttgtgcgaaagcattgcatggactatctgatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacagaacccatcaacacattccatgggatacatcaaaacgaggacgaacccattcgtgttagctaccatcggaatatccactataattcagtggtgaatcctaacaaggccaccattggtgtggggctgggcctgccatcattcaaaccagggtttgcagagcagtctctgatgaagaatgccataaaaacatcggaggagtcatggattgaacagcagatgctagaagacaagaaacgggccacagactgggaggccacaaatgaagccatcgaggagcaggtggctcgggaatcctacctgcagtggttgcgggatcaggagaaacaggctcgccaggtccgaggccccagccagccccggaaagccagcgccacatgcagttcggccacagcagcagcctccagtggcctggaggagtggactagccggtccccgcggcagcggagttcagcctcgtcacctgagcaccctgagctgcatgctgaattgggcatgaagcccccttccccaggcactgttttagctcttgccaaacctccttcgccctgtgcgccaggtacaagcagtcagttctcggcaggggccgaccgggcaacttccccccttgtgtccctctaccctgctttggagtgccgggccctcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagacaagagttgatggagacccagggattggacaccatctcccaaccccagggactcgggcaagggtgccgaagatagacaagaggcacacagagacagaccaactggcagccaggcagccccagaggagagagacattcagacagaggaaagtctccctgcccctcattccttccaagatgagaaaaacttgccgccaccccccgacactgatgccagggaggtgggaggaagaagtgggaaatttcccttcccagtacccccaagaacgtctgagccttcaatgttgaattttttctttattaaaattacttttatcttataaaatcaactaatcaaaaatgatatagacgacagcactggctctgtgaaggtggcatctttctgggcaggcaggccatggggcatggaggagggtgcaaagatatgggttgctgtcttctggcctccagctgcatggaggccggcccagggtctagggtgtgcactgggcaagggcagggcggcaggtgtcaggccggcttggacaatgaaaccctgaccttgctgcattccttttgcttccaccaccactagcttctttggaatcttggggtgggggtcatctttggggattatggctgccacccgggatttgagtgtagggagtgtgggagcagccttggcagatggggcacccgtgccctgcaggtgttgacaagatccgccatctgtaatgtccttggcacaataaaaccaaatgtcagtttccctgagcgactctgttctgtgtggggcaggggttgggcgggcctctgggcagaggatgcaatggcacggaccttggcttgacctcagaggtgtgaatgctctccagcagggtctgtctgggggcctggagtttgtatttgatttgctgcttattaaacctccttctggacctattgccactgg

SEQ ID NO: 162941 - DNA, 2077 bp, Homo sapiens
  Payload ID: 12107
  Gene Symbol: OTUD5
  Gene Name: OTU deubiquitinase 5
  ENST ID: ENST00000455452
  CDS Start-End: 1-1335
ggcgtggtggtgggtgtgggtggtgccgtaggcgtgggcggctgctgctccgggcctgggcacagcaagcggcgacgtcaagctcccggggttggcgcggttggcgggggcagtcccgagcgtgaggaggtcggcgcaggctacaacagtgaggacgagtatgaggcggctgcagcacgcatcgaggctatggaccctgccactgtcgagcagcaggagcattggtttgaaaaggccctacgagacaagaagggcttcatcatcaagcagatgaaggaggatggcgcctgtctcttccgggctgtagctgaccaggtgtatggagaccaggacatgcatgaggttgtgcgaaagcattgcatggactatctgatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacaggtacttctgcagtggaacccatcaacacattccatgggatacatcaaaacgaggacgaacccattcgtgttagctaccatcggaatatccactataattcagtggtgaatcctaacaaggccaccattggtgtggggctgggcctgccatcattcaaaccagggtttgcagagcagtctctgatgaagaatgccataaaaacatcggaggagtcatggattgaacagcagatgctagaagacaagaaacgggccacagactgggaggccacaaatgaagccatcgaggagcaggtggctcgggaatcctacctgcagtggttgcgggatcaggagaaacaggctcgccaggtccgaggccccagccagccccggaaagccagcgccacatgcagttcggccacagcagcagcctccagtggcctggaggagtggactagccggtccccgcggcagcggagttcagcctcgtcacctgagcaccctgagctgcatgctgaattgggcatgaagcccccttccccaggcactgttttagctcttgccaaacctccttcgccctgtgcgccaggtacaagcagtcagttctcggcaggggccgaccgggcaacttccccccttgtgtccctctaccctgctttggagtgccgggccctcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagacaagagttgatggagacccagggattggacaccatctcccaaccccagggactcgggcaagggtgccgaagatagacaagaggcacacagagacagaccaactggcagccaggcagccccagaggagagagacattcagacagaggaaagtctccctgcccctcattccttccaagatgagaaaaacttgccgccaccccccgacactgatgccagggaggtgggaggaagaagtgggaaatttcccttcccagtacccccaagaacgtctgagccttcaatgttgaattttttctttattaaaattacttttatcttataaaatcaactaatcaaaaatgatatagacgacagcactggctctgtgaaggtggcatctttctgggcaggcaggccatggggcatggaggagggtgcaaagatatgggttgctgtcttctggcctccagctgcatggaggccggcccagggtctagggtgtgcactgggcaagggcagggcggcaggtgtcaggccggcttggacaatgaaaccctgaccttgctgcattccttttgcttccaccaccactagcttctttggaatcttggggtgggggtcatctttggggattatggctgccacccgggatttgagtgtagggagtgtgggagcagccttggcagatggggcacccgtgccctgcaggtgttgacaagatccgccatctgtaatgtccttggcacaataaaaccaaatgtcagtttccctga

SEQ ID NO: 162942 - DNA, 1493 bp, Homo sapiens
  Payload ID: 12107
  Gene Symbol: OTUD5
  Gene Name: OTU deubiquitinase 5
  Uniprot ID: Q96G74
  ENST ID: ENST00000428668
  CDS Start-End: 213-1262
gtgacgctacaggggccagctatgctcccgggagtgttgatgttttccagtcattccggctgacagcgttcaagttggaatcctggaggggaggtgtttttcctgtcgtacgtgggacaggccacgctgtccgtccgcagtaccgacgcctgcagcaggagcattggtttgaaaaggccctacgagacaagaagggcttcatcatcaagcagatgaaggaggatggcgcctgtctcttccgggctgtagctgaccaggtgtatggagaccaggacatgcatgaggttgtgcgaaagcattgcatggactatctgatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacagaacccatcaacacattccatgggatacatcaaaacgaggacgaacccattcgtgttagctaccatcggaatatccactataattcagtggtgaatcctaacaaggccaccattggtgtggggctgggcctgccatcattcaaaccagggtttgcagagcagtctctgatgaagaatgccataaaaacatcggaggagtcatggattgaacagcagatgctagaagacaagaaacgggccacagactgggaggccacaaatgaagccatcgaggagcaggtggctcgggaatcctacctgcagtggttgcgggatcaggagaaacaggctcgccaggtccgaggccccagccagccccggaaagccagcgccacatgcagttcggccacagcagcagcctccagtggcctggaggagtggactagccggtccccgcggcagcggagttcagcctcgtcacctgagcaccctgagctgcatgctgaattgggcatgaagcccccttccccaggcactgttttagctcttgccaaacctccttcgccctgtgcgccaggtacaagcagtcagttctcggcaggggccgaccgggcaacttccccccttgtgtccctctaccctgctttggagtgccgggccctcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagacaagagttgatggagacccagggattggacaccatctcccaaccccagtactcctgctctccggtgccacctcaccttctttggcttcttccctcttgcctccttctgttctttctgctctcccctcttttccctcctcctcacttccctctggctagcccacccctgcactctctctcattgccgctgccactatcacctgtctctctgccagctgatgtgccctgttgccccccacccc

SEQ ID NO: 162943 - DNA, 2487 bp, Homo sapiens
  Payload ID: 12107
  Gene Symbol: OTUD5
  Gene Name: OTU deubiquitinase 5
  ENST ID: ENST00000610466
  CDS Start-End: 325-1953
gtttcctttgaagcagaaggccggaacaagcgtagcaataaacttgctggacttggagagaaggctaagacaaactcgccgcactgccttcatcttggactttacatccgggttctcctctcggcgtgacccgcgcgccgccaccgccgccgccgccgccgccgcctcctccgccgccgagggttctcgaaccggtgccgcgatccctttatccgggtctcgccgttcccgtcgtgcctcgcgcactacactagccccctcatccgggttctctcccggcgtgccccgcgccgggtttgttggggggtactcggcagtgcagccatgactatactccccaaaaagaagccgccgcctcccgacgccgaccccgccggcgcgggcgtgggcggcggcgatcgcgaccgtgactccggcgtcgtgggggcccgtccgcgagcttcgccaccgcctcaaggcccgctaccaggaccgccgggcgctcttcatcgctgggcgctggccgtgccgcctggtgcagtggcgggtccccggccacaacaggcttctccacctccttgcgggggcccaggtggtcccggcggcggtcccggcgacgcgctgggcgcagcggcggcgggtgtgggtgccgcgggcgtggtggtgggtgtgggtggtgccgtaggcgtgggcggctgctgctccgggcctgggcacagcaagcggcgacgtcaagctcccggggttggcgcggttggcgggggcagtcccgagcgtgaggaggtcggcgcaggctacaacagtgaggacgagtatgaggcggctgcagcacgcatcgaggctatggaccctgccactgtcgagcagcaggagcattggtttgaaaaggccctacgagacaagaagggcttcatcatcaagcagatgaaggaggatggcgcctgtctcttccgggctgtagctgaccaggtgtatggagaccaggacatgcatgaggttgtgcgaaagcattgcatggactatctgatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacagaacccatcaacacattccatgggatacatcaaaacgaggacgaacccattcgtgttagctaccatcggaatatccactataattcagtggtgaatcctaacaaggccaccattggtgtggggctgggcctgccatcattcaaaccagggtttgcagagcagtctctgatgaagaatgccataaaaacatcggaggagtcatggattgaacagcagatgctagaagacaagaaacgggccacagactgggaggccacaaatgaagccatcgaggagcaggtggctcgggaatcctacctgcagtggttgcgggatcaggagaaacaggctcgccaggtccgaggccccagccagccccggaaagccagcgccacatgcagttcggccacagcagcagcctccagtggcctggaggagtggactagccggtccccgcggcagcggagttcagcctcgtcacctgagcaccctgagctgcatgctgaattgggcatgaagcccccttccccaggcactgttttagctcttgccaaacctccttcgccctgtgcgccaggtacaagcagtcagttctcggcaggggccgaccgggcaacttccccccttgtgtccctctaccctgctttggagtgccgggccctcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagacaagagttgatggagacccagggattggacaccatctcccaaccccagtactcctgctctccggtgccacctcaccttctttggcttcttccctcttgcctccttctgttctttctgctctcccctcttttccctcctcctcacttccctctggctagcccacccctgcactctctctcattgccgctgccactatcacctgtctctctgccagctgatgtgccctgttgccccccaccccatcccgcacagaaccatccctgcattccacaggggactcgggcaagggtgccgaagatagacaagaggcacacagagacagaccaactggcagccaggcagccccagaggagagagacattcagacagaggaaagtctccctgcccctcattccttccaagatgagaaaaacttgccgccaccccccgacactgatgccagggaggtgggaggaagaagtgggaaatttcccttcccagtacccccaagaacgtctgagccttcaatgttgaattttttctttattaaaattacttttatctt

SEQ ID NO: 162944 - DNA, 1689 bp, Homo sapiens
  Payload ID: 12108
  Gene Symbol: OTUD6A
  Gene Name: OTU deubiquitinase 6A
  Uniprot ID: Q7L8S5
  ENST ID: ENST00000338352
  CDS Start-End: 35-901
agcaaatttcaactcccgcttgccattcaacatcatggatgatccgaagagtgaacagcagcgcatactgcgccgccaccaacgcgagaggcaggagctgcaggcccagatccggagcttaaaaaactcggtccccaagaccgacaagacgaaaagaaagcagttgctccaagacgtggcccgcatggaggccgagatggctcagaagcaccggcaggagctggagaagttccaagacgacagtagcattgaatctgtcgtcgaagacctggccaagatgaatctggaaaaccggcctccccgctcctccaaagcccacagaaagagagaaagaatggagtccgaggagagggagcgccaggagagcatcttccaggctgagatgtcggagcacctggccggcttcaagcgcgaggaggaggagaagctcgccgccatcctgggagccaggggtctggagatgaaagcgatcccggccgacggccactgcatgtaccgcgccatccaagaccagctggtgttcagcgtgtctgtggagatgctgcgctgccgcaccgccagctacatgaagaagcacgtcgacgagttcctgcccttcttcagcaaccccgagaccagcgactccttcggctacgacgacttcatgatctactgcgacaacatcgtgcgcaccacggcatggggaggccagctggagctgagggccctgtcgcacgtcctgaagacccccatcgaggtgatccaggccgactcgcccaccttgatcatcggggaggagtacgtcaagaagccgatcatcctggtctacctgcgctatgcctacagcctcggcgagcactacaactccgtgacaccgctcgaggccggcgccgccgggggcgtgctcccgcgtctcctgtaggccccaaggcgctgagcagccccgggaaactgtcgccgtcgccgcatctcctcagtaggctcagtttattttccccttttgcttttctctgtttttcttttccttccttttaatcaaaactacccgcccccgccccgcccccgctttcctaaccttgctgctttcacagggtgggaaacgaaattcgagggaaattccccggaaatatgagggaaatctctgcattgcaccaccagaggggcataaatttgaaagttctaacctcttcttgcccttaagggtcttttacctccctcaccaactaagatttggtcatgttgcgtataacttcaccacaaaaatggaaatattggccgggcgcggtggctcacgcctgtaatcccagcactttgggaggccgaggcgggcggatcacgaggtcaggagttcgagaccagcctggccaacatggtgaaaccccacctctacaaaaaatacaaaaattagccgggcgtggtggcaggcacctgtagtcccagatactcgggaggctaaggcaggagaatcgcttgacgggaagcggaggttgcagtgagccgagatcgtgcctttgcactccagcgtggaagacagtgagactccgtctcaaaaaaatgaaaaattagccaggcaggttggcgggggcctgtaatcctagctacttggggtgctgaggcaggagaatcaactgaacccgggaggcggaggctgcagtgggccgggatcgtactactgcactccagcatggaagacagcgagactccgtctcc

SEQ ID NO: 162945 - DNA, 10770 bp, Homo sapiens
  Payload ID: 12109
  Gene Symbol: OTUD7A
  Gene Name: OTU deubiquitinase 7A
  Uniprot ID: Q8TE49
  ENST ID: ENST00000307050
  CDS Start-End: 94-2874
gttctctcgctcaggtctctgcatgtagttgtcacttgcagctccatttccatcacgtggtaaaatgccctttctcttctttcctgcagatggatggtttctagtgtgcttccaaaccccacctcggctgagtgttgggcagcacttctacatgatcctatgactcttgatatggacgcagtcctgtcagactttgttcggtccacgggggcagaacctggtctggccagagacctgctggaaggcaaaaactgggacctgacagccgctctgagcgactatgagcagctccgccaggtgcacacagccaatctgccacatgtgttcaatgaagggcggggtcccaagcagccagagcgagagccacagcccgggcacaaggtggagcgaccctgcctgcagaggcaggacgacattgcccaagaaaagcggctttcccgggggatttcccacgccagctcagccatcgtctccctggcccggtcccacgtggcaagtgaatgcaacaacgagcagttccccctggagatgccaatctacacattccagttgccagacctgagcgtgtacagcgaggatttcaggagcttcatcgagcgggacttgatcgagcaggcaacaatggtggctttggagcaggcaggtcgcctgaactggtggtccactgtgtgcacgagctgtaaacggcttcttcctctggccacaacaggggatgggaactgccttttacatgctgcttcactgggaatgtgggggtttcacgaccgggacctggtgttacggaaagctctctataccatgatgaggacgggagctgagagggaagccctgaagcggaggtggaggtggcagcagacgcagcagaataaggaggaggagtgggagcgggagtggacggagctgctgaagctggcctccagcgagccgcgcacacacttcagcaagaatggcggcacgggcgggggtgtggacaactctgaggaccccgtgtacgagagcctggaagagttccacgtttttgtcctagcccatatattaagaaggcccatcgttgttgtggcagatacaatgttaagagactcaggtggagaagcgttcgcacccatcccattcggagggatctacctgcccttggaggtccctcccaacagatgccactgctcgcctctggttctggcctatgatcaagcccatttctctgcccttgtgtccatggaacagagagaccagcaaagagaacaagccgtgatccccctgacggattctgagcacaagctgctgcctctgcactttgcagtggaccctggcaaggactgggagtgggggaaagacgacaacgataacgcccggctggcccaccttatcctgtcgctagaagccaagctgaaccttctgcacagctacatgaacgtgacgtggatccggatcccctccgagacacgggcgcccctggcacagccggagtctcccacggcctcggcaggggaggacgtgcagtccctggccgactcgctggactcggaccgcgattcggtgtgcagcaattctaacagcaataacggcaagaacggcaaggacaaggagaaggagaagcagcgcaaggagaaggacaagacgcgcgccgactccgtggccaacaagctgggcagcttcagcaagacgctgggcatcaagctgaagaaaaacatgggcggcctcggcggcctggtgcacggcaagatgggccgcgccaactccgccaatggcaagaacggggactcggccgagcggggcaaggagaagaaggccaagtcgcgcaagggcagcaaggaggagtctggtgcgtcggccagcacgtcgccgtcggaaaagaccacgccgtcgcccacagacaaggcagcgggcgcgtcgccggcggagaagggcggtgggccgcggggcgacgcctggaagtacagcacggatgtgaagctgagcctcaacatcctgcgcgccgccatgcagggggagcgcaagttcatcttcgccggcctgctgctcaccagccaccggcaccagttccacgaggagatgatcggctactacctgacgagcgcgcaggagcgcttcagcgccgagcaggagcagcggcgccgcgacgccgctactgcggccgccgctgccgccgccgccgccgccgccacggccaagcggccgccgcgcagaccggagacggagggcgtgccggtcccggagcgcgcctctccgggcccacccacgcagctggtgctcaagctcaaggagcggccgagccccgggcccgcggcagggcgtgcggcgcgggcggcggcgggcggcacggcctccccggggggaggcgcgcggcgtgcgagcgccagcggaccagtgcctggccgcagccccccggcgccagcgcgccagagcgtcatccacgtgcaggcgtcgggcgcgcgggacgaggcgtgcgcgccggccgtgggggcgctgcggccgtgcgccacgtacccgcagcagaaccgctcgctgtcgtcgcagagctacagcccggcgcgcgccgccgccctgcgcaccgtcaacacggtcgagtcgctggcgcgcgcggtgcccggggccctaccgggcgcggcggggacggcgggggcggccgagcacaagtcgcagacctacaccaacggcttcggcgccctgcgcgacggcctggagttcgccgacgccgacgcgccgaccgcgcgctcgaacggtgagtgcggccgtggcggcccggggccggtgcagcggcgctgccagcgcgagaactgtgcgttctacgggcgcgccgagaccgagcactactgctcctactgctaccgcgaggagctgcggcggcggcgcgaggcgcgcggggcccggccctgagcggcgcggcgcggcgcgggcggcgaggttctaccttcgaggatttcttttccattgtgtcggtgtcttttttacatgccctggtccaccggaaggccggcgcctcctctgtcagtgccgtgtacgtgtttggtcaaacgttcctaatggtgcctgaacctacactgacgccactcaggtagtagacggataggaaacaagtcatactgttggaagtgggtgtgctagcctagcatctgcctcgtacctgtggaaactcaatagccattgcaagagtatttttgttcctcagtaagagaaataaagaaattcgcagccctttgttttaagaagggagtgttttacatgctttttttgcttttttttttttctcctaccctagcgatgacctcttccaggtagcggtcccttgtgcgcggttggtagtacccagggcttagagcgagcgcgcacccggggctgcggtggaggctcctctgtgagctctacctgcctcccatcccgaggcctaggagaaggcgggtacctggccgccagctgacgccctggtggtcactgtggccctttagaaacacacagctccatttcataagcaaaacctcctcccccagccccggctcaagcaccattcacactgccatccaagccgcgggcggccgtggaaagggcactggaccacccgtctcgcgggcgccgtgaggtacagcgatggctcccagtgccgggcagttcaggtgacaggagctttccaaagacacctagggtccaaaaagcagggttcccatctcacaatttggatttgctcatagaggagcagataggacaggctgctcacatttctcctttgaaggcacttccacagtggactgtcgctggcgggcccctgggcggtgaccatcggtgccccgggagacagcgaggaattgaccctttggtcactgtgtaagcccccactaggctgctgctctttccaaagggaaggggctgggggaaccaggaaggaagcccacccccacacctgcatctgtctgggttcagccaggtaaagggactcactgtgatcgtggcccctccacggggcaggacgaccctgcctccgtctcgtgacacaatgagggagcagcccgatccctgagcggtctcttttttggtgcctcctacatttcttgaggaaaaaaaaaatgtgtccttagctaccctgttttgagcagcaatatgcagcctcttccttccaagattacctccggagaacaccgttcttggccaaggacactgaggagctaaatctgcctcactaaggaacgagcttgtttccaagaaatgaggataagatgggtaaaatcctcactaacaaagaatactataaaacctgtgagagccttagaatagcttctaataatcctaggacaggagaaagcgcctggctttgctgtgagtgtatcctcagaaaaagcaggaggtcgaccatctcttcactggagccagcttctcctctagaaacgatgcttttttccctaactaaagagcagcaaaaacaaaaaaaaagggggggcgaggggattttttttacttgtttgagaaattataataaaataattgagtatctcctgtgagtaatgcctttttgtttttaattattccacagcaggtggagttttcagtaatttgttcaagttttgcataagtggttccttaaatcaaaaattatttattaaataggatctttaagaaattttttgaaagttttacttttcctgctgaacaatattttcaatgtgtggtaattactgtactaacatccatgtccctaatattactggggtttcttttattactcagaaaacaaaagtggttttttaaaaatctcatggagagggtctgtggcagctttctggactgattcttcgtgtcacgctgagcagctgctttggcatccaaagctgtgggatcacagaaagtgttgcttcaggtgtggatgccagccactcctcatgctcgtcactcttaaaagattgagacacccaaccttaaaaatgctccaataatccattcagaaaccaaactcatatgcacaagatgtcaaggaggcataaagtcaattcttgcttgtttttttcatttcttaatgtaaaaacagccaaccagaaatttctaaaactggctatgctaattcagatattttctttctcacgctatctgccaggtttgtctaatttaaaaaataaaaaaataaaacagaataaaaaccgtccattgtaatagaggaaaaccttccaaaccaggcagagtacgtaattatcaaaacaccaggacctattctacccttgcatttccaagttacctccacccatcaccatctgatgacagatgtgccctaaataagagcctgagataaagccactggctgcatcctgcaccccagcttctcaatgtggtaacgaggcgccagacgcctgtagacacctgctccaggctgatacattaccactcagtccacatgacttaggaatagccatttccttttgtgagagagctggatccatccttcctctaaacagtattaaaaatgcaaaagggagagagcggatggtcatattaaatgtgctagtcccgtgcaccgacagcatgctccttgagaagaggcgtgtagacctcgtccctggccagagaccaacttcagcaggctggccagaaactattaaaaactgtgttgactgcatgtgggccaagggcttccctcgtgttccatggcgtgagggccctttgtggagcagggagaaagggaagaaggtgagtcctaccggggtgcatggccctgctgccctagctgaccctgcctgagagcagccttccccacctgatctggccacacttccctttctaggaaggacaggtgtctccaagggactgcaggtttccagaggatcccagatacttctaaacccctgcgaaggttatttcagaaatttactttacatttcctgcacatttgttatctgggtaaatgatttttttaaaatattgttaagggaaggtgtttttcagtgtattctgttggtagactttatgctgtgttacgttgaaattttacaagccaagtttaaactgtactataaaaattatttttgtattattttcagaacatgccacagagcaatattttgcacccgttattgccacagggttgtcccttggaagggtaactggaggtgggaaggagctccactgtgggctccggggggttaaacgctttttgctgcttgttcaaataccttctgaaagtgggaatgtatcagtgtctttttttattgaaagcttgatttccttttttctgttcatggattttggtactgcacctttcctcttaaatgaatactttgtattcactaaattactgtggaccttttcatacctattaccacccagtggcatttgaatctatttacaaatcgaatgttttcccaaatgatttaatttactacttctcgtagcttactgtcaagaattgggggtgctgaagataaaaggactctccatgccccccaggtgcacacctcagggtgtggacatcctccatgcagagcccgccctgtctctggggaggggtcatgggcccatcaccccccccccccacttagtgtccacaaacttattttgcgaactattctactttgcaaaaataaacttaaaatatacttcccattggttaagataaaagggctgtacttatcagtggtgggaaatttgtacaagaaaaaacagacttttccaaatccatgtgtgtaagttccattccatgtgagtcttttatttacgaagagacctggagtaaaagctgaaggcatctactgtatgtttggggctcctttctttatggccatgattttttttctcctcatcttggtgtggactttaaaattaagtacccccagtgttctgtcctttttctttcctcagtgcttctaatagataagaagaaatgtgtttctgtggctgagcaagccctgctgggccagacagaccttaccagccctggcttcatcctcgctgggctgcagaggcggcccctgctctagttgagtccggttctgctgccagctgaggacagacacaccgtatgaagggcctagaggtggctggcatgccagggagcaggtggccccttccaaaacgccttaaagtggtggctctctagagatctgaggcaccaccttcccatttactcctgactctaaactctagctggcctgttttagtgtggctggccggggcagtgaccagcgctcagctttgttcttgtttaattcaagtccaccctgttgcccgtgtcctctccacagctctgggtctgttggcccggagtgtatttctgccagtgctgcctcactgactcgggagtgggtcctgggtagttcacgatagagaggccagcacacgccatggggagagccccccacgctcaccccaggaggccctgcggcacatccaggctggaccactctgcaagcttctgtcacaaaagacagctccgggcactgtgcaaattggcctgttagcagttatgcaggtcccttctttgccaaaagatctattattcctccccactgcacccccagcagaaaagagcgagggagatgccctgcagggaccccttgggaacaacagttatgtgcagtctgtgcagtatgaagaacttggccccaccaggctgagccgaagacacacgtagttgcagagtagcactgaagccatcatctccaaccatgctagtaatgttactgtttctatttattttgccaaatgatttgttgaaaattgcatttttgctattttaatcttgccaaaaaagggggcctcactaatcctaattatgtacatacagaatgatgcacattgcttgcatctttttattcctcccaaagagcatatcaaggatatatatatacataatttgttagtttaacataaggcgaagagtaccatttggttttaagagtaaatataggctgaatttattcaagaccaaagcaacctatttaatgaggacaaatgagtgaaaccagctgttttagaatttatctgcagacactggagtgctcctttaaacgaagaaacagcctcccatggcagaggaaaagccaggtccttacaaaggcctctcccatcccagtacttcttctgcctgctgctctgccctgggacgtaggccttcctgccgtttctagtcacaggcaccctcctgcctcagggcctttgcacatgccattccttctacctgaacattcttccccagagagccacatggttcacccctcactacctgccagtctttgctccaatgtcacctttcaacgaggccttccctgacttatttaaaaggacaacacaccccaccctccctccctacccacctctctgcatcttcttcttgtgcacctatcaccatctgagtgctgcagatgttaatcattcatccatttatttgattctcgcctccccatctcccatagactgtaagctccatgtgggcaggaacttttatatgtcttgctcattgctgtatcctggtgcctacaacagtgcctgacacatattaggcactggataagtatttattgaaaaaaggaaattaaatcagtaaattgaaaactattaagaggccagaaaatgtcaatttcagctttcatcaaatctaggttctattattgtgagaactttagctgacccagtgacctggctcctatgggtacaagatggttagatacaccgggcagcagcggtggcttctgttcacagacaagtgaatgcctgccctgccgctagccccacctcacaaatatgaggctcactgttcgcaggggagcattttggaaccagctgggatgaagacagttttctgcaggtagcttttgtagccagatgcacagtagtgggttcccatcactccatgaggtcactgtagacctggaccattccagagaatcctttgtaatcagtctttaggtgtctcccagtccttcccagttcaacacgggtggcagcagatggcccagcccagggaaagtccacctgaccattagaaggactcatcctccagccaccaaagcaaggctgcagaggaagaggagcttgtcacaaacattaaccggctcagggctgggtaactgcattgacaaatttggaagcagcagggccagagagccaaggcccccgggtatccccattggccactggtggaggtgcactggaaggtcagggccttgacaccacagagccaagcaacacacacctccttgggcccaggccccagcacggtggccctccagtgctggcaggtggcctcacccacagcaggggaggcgtgggtcctccaatgaccttcctgcccctgccagatgattttcacaactacctaactttggtgtttacttctaggtcctttggccaaatgcgttttcttctaagagttgttggcaaaatactgttacaagcttcttatgggacttttgtcctactgtggcctggttaaaggctttgtcctcctgtttaatccacttccgtggttttgctgtcatttctcttgatgccatattttcaggtccctcgtgggagggggcataaggtctccatcgtgatgccctctctgcagctgtccagccagcagtgagtgggcccacacatgtgcattcctgtgcttgaattgccaaataaacagtgtccctttcattgctgcccaaacagactggaagcctgctcctgccagcactcagggagggagtgtgtgcttcccaagagcctgcccccttggcccatgcaaactttctccatggcaggtgtccgtgaaggtctcccaggccctatgggctgtccagctctttgcacacattcttcccgcttgcaggaatggaatccaaacacctgatacggaatgatgacttggcagtggggagtggggcagcttgtctccgctaacttaggaccaaaactaggaaactcaccatgagcatgtgttggagatcagctgtggcctccagcccctgtacacacagaggcaagccccacctctgacagagccagtcaccgttcagtaggagcttgtcttccctgggcccccaggtgggaaaggctgggctcttagtcctacaagtaaaggcgctgttaggagcaaggagcaggcttagctgggtccacagagggactaagctccttagtgacctgttactgcctcatctacggagtttgaactccattcaccatcacctttgagaatttggccttgttttaactaaggattgttgaagttaattataacaagggaccatcctcaccctgtgtttgctttgttccattaaacgtgcgtttggcctaatgaagtcagtgaatgttcctcttttttcttttttggtttctttgactgatttttggatgatatatgttgctttatttctcccattttctttgattactgtggacaaaggaaaacactgaggcaaaagtaggtcgtcaatcacattactttgacccagttgtgcagaacccctttctacctgcaggtgttaattccaattcaatgcaaatatccttttcaatccggtccattcttggagaagaaacccattgtaagagctgtcttctgtggttgggatattactttgtaaagtattaaagcactaaaccagtttttgcaatatgtagtaaatcttgctttcattttggaaaacttccagtaatgactactgcactttttatagaagaattgtatttaatttctttcttttatgaaagattatttcaagtaaaaatagctctgtaatctgtgtgacatggcttctccattacctgacacagagagaagctttgatgcctactcaataaaattaacatgtttgtaaagta

SEQ ID NO: 162946 - DNA, 3431 bp, Homo sapiens
  Payload ID: 12109
  Gene Symbol: OTUD7A
  Gene Name: OTU deubiquitinase 7A
  ENST ID: ENST00000560536
  CDS Start-End: 349-690
agaggagggcgcgcgcccggaggcagcaggcggagccgggaggcgggcgttcgagagaaaatggaagtcgggtagcggcgactgcggcgctgcgggctggcggagcggagcggcgcggcgcggcagagttctcaggcgctgtggtctcaccttccactggggcaacaatgggccatttccagcagggacggcgcagtgttggcctgcatgcctgactgccacacacctccagaatcaggtgtctgaaaagtggcagtgacgaaagaagagactctcccggccgaggccccagtgcatggagagaaggaagaaatcaatttcctaattggtaccatatacatcagatggatggtttctagtgtgcttccaaaccccacctcggctgagtgttgggcagcacttctacatgatcctatgactcttgatatggacgcagtcctgtcagactttgttcggtccacgggggcagaacctggtctggccagagacctgctggaagcacctccaactgtgatccaccttcctgagcccggtcgctgctgcctgcacgctgtccaggggtcccggctgcacccagtgggacagagggtggcagtggtgagtgctcactcacctcacccactgctgggtcctgcctttggctttcacaggcaaaaactgggacctgacagccgctctgagcgactatgagcagctccgccaggtgcacacagccaatctgccacatgtgttcaatgaagggcggggtcccaagcagccagagcgagagccacagcccgggcacaaggtggagcgaccctgcctgcagaggcaggacgacattgcccaagaaaagcggctttcccgggggatttcccacgccagctcagccatcgtctccctggcccggtcccacgtggcaagtgaatgcaacaacgagcagttccccctggagatgccaatctacacattccagttgccagacctgagcgtgtacagcgaggatttcaggagcttcatcgagcgggacttgatcgagcaggcaacaatggtggctttggagcaggcagtgtttcctcaccaccctaacatcccaatgaagaaagcgttcaagaagcaagacaaactctcttctttggaatgtttaaggagaaaataatgagtccaaaacaaatgtctaaaacagatttaggttcttcctgagacaaagcaatgccagtttcactcataatcattcacattataaacattgcaaaatcacatatctgggggtttctcaggcacgcatgtggaagatgttatggctgtctcctcaggcccaccacgcccctcccagtgggagccccgcctgcctgcacgggctgacagtgcacatggagcatgtcctcagccagtgggaagccctgctcctgctggggtggggaagcatcgccttccagtgctgacccagccttcagccagctcttcatgtccactgtggagtggagcctccacttccaaggcttggtccgtggagacgtccccagatgtgtcatcccaggagtttagggctgcagccagcaatgcactgttagggagtagagcttttctcggtgctcggcgaagacccaataaaattaccaagcactttctagagttccagaagaagacaggagagaagtacctgtaggttggtatgattctgatattggtggatggaccaatcaggaccctggtaggaaagaaaaggcagcacaaaactgtgagataaaggactccataaagggactgctttccaaggagtgggcaggatttaaggacactagtgaaggatactaccgttcctgggactaccctcaggcctggcaaaaagacaagggatgagagtggctgatggagatagccacgggcagtaggtgtggcatccgggagagagaagatgctggggaaataaatactctgaccacactcttcctccaccatccaggttctgaccagtgcctcttaatggcagaagggcagattgcggggagctcactgatgtggtccacgcaggtcaccctctgcatacagagcagcatggagaaggatagacggtagatctgtggggccaatgggaaacatccagaaagtcaatgtgccgggaagttttaccagacctggcttctgtgtacacgtgtacacctgctttcatgccattgcttgtcattgtttgcccagggctgtcgtcatccaccactttcaagagggaaggcacaagatgcgtttagacaaaggacgagatgtgcctagtggggcttatttgtgttgggcaggcttgcagtcaggtcgtagccacaggactcatagaagcctcaccaatggcatgcttgacattagaacaggctctacattcccaacagctggatctcatgttgtgactgtggagaaattctcatctcagctgcttcgcagccatcaagagcaatccaatgactggcacccacagccttgctctgtcttacctcagcaagactcaacaaacaaaacaattcagctagattagcaataatctaaaccactcactgtgggggctggctattttaaagacgcttctatatgactaattcagataagatattttcaatagaaaaagctcactattcatagagaagcggaaattagtatttgttaagaaagaaacaagtttcatgggttactctctgttgaatgctacggcggtgtagacctttatacagctcagcactgacgattgctaatagcttgggtgatcatagcagctgcctgagtgctgtgtttcgtgtgaagcacagtctcatgcaaggttgtaggtagaccccaccatgttaccttctccttgagccctaccatgcttagcaaaagccttcacttcttttgaacgtcttttctgttatttttttccatattttgcattttaatttttatcacttatattttaccttccagactagcattttaagatgggactctggcttcatccagtcttgaaaaataccttttaaaaacccaaacttagtgagttaagatgttaaattatgaatagctcattgtttatgttgggcaccacgaagagaaccaactggaagcagagatcagtgaaggcaggaagctcaggctcccacccagtggtggagaagccatctggtctacactcgcaggaggccttgaggaagtgggtctcactcttcagggagtggtcaaaggtgcttgtggtgcaattcgcgcctgaagatcagggatctgcctgggacaggagtcctagtagccaacatgtcttcctcgtccctcacgctgaaaaataataaaagtggccaaacgcgatggctcacgcctataatcctagcactttgggaggccaaggcaggagaatcacttgagctcagaagtccgagaccagcttgagcaacatagtaagaccccatctctacaaataataaacaaattagccaagc

SEQ ID NO: 162947 - DNA, 724 bp, Homo sapiens
  Payload ID: 12109
  Gene Symbol: OTUD7A
  Gene Name: OTU deubiquitinase 7A
  ENST ID: ENST00000560598
  CDS Start-End: 394-724
ggggaggagaggccaccgggaccgcgagcggcagctggggagggggccgcggagcccgagcgggagcaaaacagctgatctggttttcctttaaagcgagagaaaatggaagtcgggtagcggcgactgcggcgctgcgggctggcggagcggagcggcgcggcgcggcagagttctcaggcgctgtggtctcaccttccactggggcaacaatgggccatttccagcagggacggcgcagtgttggcctgcatgcctgactgccacacacctccagaatcaggtgtctgaaaagtggcagtgacgaaagaagagactctcccggccgaggccccagtgcatggagagaaggaagaaatcaatttcctaattggtaccatatacatcagatggatggtttctagtgtgcttccaaaccccacctcggctgagtgttgggcagcacttctacatgatcctatgactcttgatatggacgcagtcctgtcagactttgttcggtccacgggggcagaacctggtctggccagagacctgctggaaggcaaaaactgggacctgacagccgctctgagcgactatgagcagctccgccaggtgcacacagccaatctgccacatgtgttcaatgaagggcggggtcccaagcagccagagcgagagccacagcccgggcacaaggtggagcgaccctgcctgcagaggcaggacgacattgcccaag

SEQ ID NO: 162948 - DNA, 1425 bp, Homo sapiens
  Payload ID: 12110
  Gene Symbol: OTUD7B
  Gene Name: OTU deubiquitinase 7B
  ENST ID: ENST00000417191
  CDS Start-End: 143-1425
ggcaaaaagccactgggggaggccagtcccgatcagtcctttctggctccagctccagatcccgtgcggagcaacagctgcggcctgaattttgatctatgttctacctacatccagctggctgaaagtacttgaggatcacatgaccctggacatggatgctgttctgtcagattttgtccgttccacaggagcagagccagggctagcgcgagatctcctagaaggaaagaattgggatgtgaatgccgccctcagtgattttgaacagctacgtcaagtccatgctggaaacctacccccatcctttagtgaggggagtggtggctccaggacccctgaaaaagggttttctgacagagagcctactcgccctccccgacccatcctccagcggcaggatgacatcgttcaagaaaaacgcctgtctaggggcatctcccacgccagctccagcattgtttccctggcccggtcccatgtctcctccaatggtgggggtggggggagcaatgagcaccccctggaaatgcccatctgtgccttccagcttccagatctcactgtatacaatgaagacttccgcagcttcatagagagagacctcattgagcagtccatgctggttgccttggaacaggcagggcgtttgaactggtgggtgagtgtggatcccacctctcagaggctgcttcctttggcaactactggagatgggaactgcctcctgcatgcagcctcccttggaatgtggggtttccatgatcgggacttgatgctgcggaaagctttgtatgcactgatggagaagggagttgagaaggaagcgttgaaaaggcgctggaggtggcagcagacacagcagaataaagagtcagggctggtatacacagaagatgaatggcagaaggagtggaatgaactgatcaagcttgcctcaagtgaaccccgaatgcatctaggtaccaatggagccaactgtggtggggtggagagttctgaggagcctgtatatgagagccttgaagagtttcacgtctttgtccttgctcatgtgcttaggaggcccatagtcgtcgtggcagacaccatgctgagggactccggaggggaagcatttgcccctattccctttggaggaatctatctgcctttggaggtcccagccagccagtgtcaccgctcccctctggtgctcgcctatgatcaggcccacttttctgcactcgtgtccatggagcagaaggagaataccaaggaacaagctgtgatcccacttacagattcagagtataagctgctgcccttgcactttgctgtggaccctggaaagggctgggagtggggcaaagatgatagtgacaatgtccgattggccagtgtaattctgtccctagaggtcaaattgcatctgctgcatagcta

SEQ ID NO: 162949 - DNA, 8872 bp, Homo sapiens
  Payload ID: 12110
  Gene Symbol: OTUD7B
  Gene Name: OTU deubiquitinase 7B
  Uniprot ID: Q6GQQ9
  ENST ID: ENST00000581312
  CDS Start-End: 296-2827
gggcaaaaagccactgggggaggccagtcccgatcagtcctttctggctccagctccagatcccgtgcggagcaacagctgcggtcgcagtctccaccaccgcctccacctccatcgccgtcgggggaggggccggccggaccccggggtcactgccgaggaatgaagagaggcggccgggccccgcgctccgccccggcctagggccttgccccgggagcccgcgagggtggaggcctgaattttgatctatgttctacctacatccagctggctgaaagtacttgaggatcacatgaccctggacatggatgctgttctgtcagattttgtccgttccacaggagcagagccagggctagcgcgagatctcctagaaggaaagaattgggatgtgaatgccgccctcagtgattttgaacagctacgtcaagtccatgctggaaacctacccccatcctttagtgaggggagtggtggctccaggacccctgaaaaagggttttctgacagagagcctactcgccctccccgacccatcctccagcggcaggatgacatcgttcaagaaaaacgcctgtctaggggcatctcccacgccagctccagcattgtttccctggcccggtcccatgtctcctccaatggtgggggtggggggagcaatgagcaccccctggaaatgcccatctgtgccttccagcttccagatctcactgtatacaatgaagacttccgcagcttcatagagagagacctcattgagcagtccatgctggttgccttggaacaggcagggcgtttgaactggtgggtgagtgtggatcccacctctcagaggctgcttcctttggcaactactggagatgggaactgcctcctgcatgcagcctcccttggaatgtggggtttccatgatcgggacttgatgctgcggaaagctttgtatgcactgatggagaagggagttgagaaggaagcgttgaaaaggcgctggaggtggcagcagacacagcagaataaagagtcagggctggtatacacagaagatgaatggcagaaggagtggaatgaactgatcaagcttgcctcaagtgaaccccgaatgcatctaggtaccaatggagccaactgtggtggggtggagagttctgaggagcctgtatatgagagccttgaagagtttcacgtctttgtccttgctcatgtgcttaggaggcccatagtcgtcgtggcagacaccatgctgagggactccggaggggaagcatttgcccctattccctttggaggaatctatctgcctttggaggtcccagccagccagtgtcaccgctcccctctggtgctcgcctatgatcaggcccacttttctgcactcgtgtccatggagcagaaggagaataccaaggaacaagctgtgatcccacttacagattcagagtataagctgctgcccttgcactttgctgtggaccctggaaagggctgggagtggggcaaagatgatagtgacaatgtccgattggccagtgtaattctgtccctagaggtcaaattgcatctgctgcatagctacatgaatgtgaagtggatcccactgtcctctgatgcacaggctcctctggcccagcctgagtcccccaccgcctcagctggagatgagccccggtccactcctgagtctggagactcagacaaggagtcagttggcagcagttccaccagcaacgagggcggccggcggaaggagaagtcaaagcgagatcgggagaaggacaagaagagagcagattctgtggctaacaaactgggcagctttggcaaaaccttgggcagcaagctcaagaagaacatggggggcctgatgcacagcaagggttcaaagcctggaggggtggggacagggttgggaggaagcagcggcactgagacactggagaagaagaagaaaaactcactgaagagctggaagggtggcaaggaggaggcagctggggatgggcctgtgtctgagaagcccccagctgagtctgttggtaacggagggagcaagtatagccaggaggtgatgcagagcctgagcattctgaggactgccatgcaaggggaggggaagtttatttttgttggaaccctgaagatgggtcaccgtcaccagtatcaggaggaaatgatccagcgctacctttctgatgctgaggagagattcctggcagaacagaagcagaaggaggcagagaggaagatcatgaatggaggaatagggggtggccctcctccagccaaaaagccagagccagatgctagggaagagcagccgaccggtcccccagcagagtccagggcaatggcattttccactggctaccctggggactttactatccctcggccgtctgggggcggagtccactgccaggaaccccggaggcagttggcagggggtccatgtgtcgggggcctaccaccatatgccaccttccccagacagtgccctcctgggcgaccctacccccaccaggacagcatcccttctctggagccaggcagccactctaaggatggacttcacaggggtgccttgttaccacccccctaccgagtggctgattcctatagcaatggctacagagagccccctgagccagatggatgggctggaggtctccggggccttcccccaactcagaccaaatgcaaacaaccgaactgcagcttctatggacaccctgagacaaacaacttctgttcctgttgttacagggaagaactgaggaggagggagcgggaaccggatggggagctcctggtgcacaggttctgaacgggtggaacactgaagggcaaggaggctaaacaaagttaagctcaactaattggctcatcaagaacacagtccccatgttgagggggaaaatgcagtaatgtttgtgggagcctggctggaaacttttaagtgtgtgcacacaggagtgctgccaggctggcaagagcaggtcggggctggatggcacctcaggggctgtactattcctctgcagagcttgacttgatgaggtttgaggtacaaggggaaaagatggcgattctgtcttataacctcctgggtcccatccagggacctaagagaaagtagcaggggaaggtttggtgtgtgggggtgggaggtgggcagaagtcttggggaggaatgggcaaaggaggttctcagtcaataaaaccaaagttctttaggttgggaaaaagcacatggtggagtgagaagtgtggaggggaagtgggaaattggacacatttgctattgatttgaattaagctagaaattaaggttggataaattcttccccttgaaggatctggaaagacaaggcagtaatgtgtcctcatgggtgcctgttaggaggtgggggtagtttaaatccgtttgtttagatgggaaagggaggaacttaagagggaaatccttttcctcttaaggtttatttccttccaagcagtcatatgtcatctgttacagtttgagaagagattgctgattaccccctgtcttttcctcatctaagtctttaattgtatttgtttaaagggaagagtgtggtgagaacagccgtcatgtgtgttgcattttctccaggtgaattggggcagagctgatctattttttaaccacagcaataaccatacgttggggtttgagtgcaccttgggaggggtgggaggacagacattttagccagaggctgtttcaaacaaaaccaaaaacctaagtagagcattacaggcctctgtggctgctgcgtttctgtagaaagcaacttattttattgacttttttttttaaggaaaagaaataaaaagaccccagcaagcaaaaacatttaaaaaatgattttttttcctcctacttaagtggttctttctccctttgctctacttttggagaatgaacttaacatcccggcttcttttgttaagccatagctgaccttaatctgtggttagtttattaaaataattaaaaatactttctaagaagagatatttttgatattaggactgatgttgaaacatataggggcaatttataaaaaggtagttagagaaatatattttagtgaactataaccacagagcacagatgactcccaatgagctgatctgtctttaggtttctccctttccctgacccttccctgttctctaggggctgggagtggggatgcggacacagtagggggagctccttcgcattttgcacaaagcacaagtctgaacagcctatgctctggccagagccatttctaagagctttaaaccggaagacctatcctgggccaattttcctttttctttatatttttttccgggaaaaaaagtcaactatgcaattgtatacactcccgggtgcatgtgaagaaggggaataagtgtacttatgtgtccagagtattaactggggctgtttttctgtgtttggatttctcttttgaggtatgtactcataacccatcccttggaacgtaatccccacatttgatctaaagcacttgagcgtgcatgcatgtgcgtgcgtgcatatgtgtgtgtgttttcctcctcggtagccagtcaagattgtccttgttggaaatgctcacggtttataaaggttattttctcctcaacaaactcagaagtcacctattttccaaatctgatttaataatttcctatggctattaattcttagggttttctttgaaaatagatttgtgttaaggaagcagtgagattccaaaggaagggatgtgtatatgtctaggcaggtctggaacctggtatgagatgagcactcccctaagttgcaaaatttaagggttactataaaactcattaatcaagatactataaaaaatgcagtatttaaaaaaattaatgcaaaaaatttatgttggataaaatagcgaaatcttacaggatctgacaggactgagattaggaggagggaagtgaggctgaattgaataagtatggggatgaatccttcttatttaaatttttgatacattgtccatcatagactttttacattaattgtgattttttaaaaatgttgcattaaaatagtatttatcttggttactgggttttttggcactccttaaattttgtgcccaaggtgagtgctttgctcacctcaccctagttacgtccctgtttctgtgatttgaacactagcgagaacaccactgtgtgcgcctccacccccatcacacaccaaacaacaggtggctcagacaccctgaatttgcacagctcacctagctttcctaatttaggccttcatatcatagaatggtggcctggaccaataggaatgaaaacagaccaggggttttcccagagaataaagccggaaaagttttgattctccactggactgctgtgtttggatttgatctgttgttagattctagttaacacttttgtttttaaaaactaaggacaaatgaacaaaaaaccttgtatcatgtttgtttttatttataagttagccaatcccaattccgtttgctttattttcaaataaaaaaagatggaaattttgaggggtggtctaggggtgaatatggtaaaatggggctttaggccttatagctttttattaagaaataaattattttttttatttgggagggtaactatttattgaggcattgaaaaacctctccattctaaggatgagagaccctgagacaatggatattttttataggagatagtgaagtttgttttgcttcattctttcggggagggtcttggtgggatggggggaggtgaaggaataatgcctgggaaattaatatagattcagcttggtttgtggtattttgggaagatgagggaatagaagaggcaagcccatgtcgttactgggttggggagaaggaaagaaggggcatatggcctgcactcgaaatgggcagaaaaattccttagttaaggaggggtgtgtgagtgaagggggaaggtagaccctttaaccccaagtgagggatgatatcatctctcaggcttaaatttaagtgcacttagttcctttaatccagggcaactggggtacctactgaagtttttaatggagaggggagattttcagggttcttgtttttccctttttgatgttagacagtgctactccctccctgctgtgctctctgccccatctccaatggagtaagtattactgtaggataggcctccgcttctcccttaacctatgctgcatttattgaaagttacaagatttaaccagaagtttttcctccatactggtttttatcaacaaaataaaaagattatatccaaagattttttaaagattcagtctttttaaggagtggagatggtgttaaactcagtgctgtagagggcagtggaagggaagtaccttccctctattagctcagtttttttttttctatcaagcgaaactaaggcccacagacaaacaagaattagcagtgacttcgtgttgtatatctgcggggtgatactgagcccaaaagaataaagctggttttgaatgtgttctgagaacctagcttttgccattcttaactccttttagccatgtgtccaaggttccagtcacatttttttttctcaataaagagtatttcagagatgattgtctctgaattactcagacacctctggactctgagtcttctttctttttcctttttctttctttcttttttttttggtttgagacggagtctcgctcagctgcccaggctggagtgcagtggtgcaatctcggctcactccaaccaccgtctcctgggttcaagtgattctcctgtctcagcctcccaggtggctgggattacaggcacccgcaatcatgcccggctaatttttgtattttagtagagatggggtttcaccatgttggccaggctgatcttgaactcctgacctcaggtgatccgccagcctcggcctcccaaagtgctgggattacaggcatgagccaccgcgactggcctctgtgtcttccttctccaatgagtcagtgccccagacatatagccacaggtgagaagacagaattagaagccccttcccggcctggaatcacctgcactccagatttttctaatttccttctttccctccaggcctttcaactatagatctggatgagtcatgcaggcattctgtctcttctactttgcagacagccagtctgcaaatcacagggtattttgccaccatacatcagttgggtaacaaaatattacgatgtccccatgtagactttctctgtgccatctcttgcattggccaagtgggtaaggggcagtacaaaagagcaacggaagctggctggcagcagttaagaggagtaggggtgggaaggaccttggcctctttctgtgcttataactggatctgtgactcatcttgtgagtcactcagctccacctccctcctccggctgcccctcccagcagcctttactcctggcacaaacctgcagccagaacaggattctgaaaatggaaaaatctgatatagccccttgcctctccacccttcccttcatctagtgcttctactgggggtgtgtggggtggtgagaggcagccttaaccctcagctcctgcccactccattcctggttaagtattgatccaaatcgcccaattcttttctcctcctgatttccccccaccccgcttttttttttttttttttttgagacagagtttcgctcttgtcgcccaggatggagtgcaatggcgcgatcccggctcactgcaaccttcgtctcctgggttcaagcgattctcctgcctcaggctcccgagtagctgggattacaggagcctaccaccatgcctggcttaatttttttttttttttttttttttagttagagtcgggggtttcgccatgttggccaggctggtcttgaattcctaacctcaggtgatccgtgatccacccacctcagccttccaaagtgctgggattacaggcatgagccaccacacccctaccccccgattttttttctccgtgttcctccactgtctccacacctcaaagtgctaaagaatagaatgaggctcttgaatgaaggatggtggtgagaaggaaagtggataatgggatttaaaagttatggtacacacctcttcctatgtctttttttttttttttttttttgcgatggagtcttgctctgttgcccaggctggagcgtagtcattagatcttggctcactgcaacctctgcttcctgggttcaagcgattctcctgcctcagcctcccaagtagctgggattataggtgtgagccaccacgcctggctaatttttgtattttcagtagagatggggcttcatcatgttggccaggtggtcctgaactcctgacctcaagtaatctgcctgccttggccttccaaaatgcttgggattacaggcgtgagccactgcgcctggtccctattttctttttacaacagaccttgggaaatattttcttcccccaagaggttgaggcccatggaatgcattaggggcaggtggggtggtggtgctctgtagcctttaggacttctagaatcaggcttctgggccaccttcttagcaggtgtatacctctttgttccagactgactttctgtctcacaatatcttcactatttccacagttgcagccaagacaggaaactgaaagctgaggccagaagggtggtgtactggggggaggggaaaattgagtgtcactttggaaaactggggcccccatctaaggattgctgcctctgtagattcaaaagcaataaaacagcagctcattaactctta

SEQ ID NO: 162950 - DNA, 7800 bp, Homo sapiens
  Payload ID: 12111
  Gene Symbol: OTULIN
  Gene Name: OTU deubiquitinase with linear linkage specificity
  Uniprot ID: Q96BN8
  ENST ID: ENST00000284274
  CDS Start-End: 79-1137
gccactgcctggcaccccgacgggaggggctccggatcgttcggagccggctgaaccccttcggccgcgagcgaccgcatgagtcgggggactatgccccagcccgaagcgtggccaggcgcgagctgcgccgagacgccggcgcgggaggcggcggccacggcgcgggacggcgggaaggcggcggccagcgggcagccgcggcccgagatgcagtgcccggccgagcatgaggaggacatgtaccgtgctgcagatgaaatagaaaaggagaaagaattgcttatacatgaaagaggggcatcagaaccgagattaagcgtagctcctgaaatggatatcatggactactgcaaaaaagaatggagaggaaatacacagaaagcaacgtgtatgaaaatgggctatgaagaggtttctcagaagttcacctccatacggcgagtccgtggtgataattactgtgcactgagggccacgctgttccaggccatgagccaggctgtggggctgccgccctggctgcaggacccggagctcatgctgttaccagaaaaactcataagcaaatacaactggatcaagcaatggaaacttggactgaaatttgatgggaagaatgaggacctggttgataaaattaaagagtcccttactctgctgaggaagaagtgggcaggcttggctgaaatgagaactgctgaagcaagacagatagcttgtgatgaactattcacaaatgaggcggaggaatatagcctctatgaagctgtaaaatttctaatgctaaacagagccattgaactatataatgataaagagaaaggaaaggaagtaccatttttctctgtgcttctgtttgctcgggacacatcaaatgacccaggacagcttctgaggaaccacctcaaccaggtgggacacactggtggtcttgaacaggttgaaatgttccttcttgcctatgctgtgcgccacaccatccaggtgtaccggctctccaagtacaacacggaagaattcatcacagtctaccccaccgacccacccaaggactggccagtggtaacgctcattgctgaggacgatcggcactataacatccccgtcagagtgtgtgaggagaccagtctatgagagacgcatgctcctgacagcctggcgacgtggcgaagatgcacaggtggctcctgggcttgggctgcaggtttgggggtctctaagaacaatctctgagaagaacccttgggcccctgggagccaagttggacaggatgtcctgaagactagcttttgataagagaaattaaccaagtctttcccctcatctatgatgcaatatatttcagtgggggccttcagagcacacctgttggacggtgcaaaccatatcttctccagaaggcaaatacttttgtatcagaggaaactcagttttggagaggaatatgttctttatgtctcaaatcaaaactctctctaatggtaaactggcttctaatttttttaagtacagtatttttttttcccctttagtagtaacgggtttctatagatcttcctatacagtctgctttaactcaggaccttgagattatgagactgacgtgctgcccactgcactgagggggcttctaacagtctgctttaagtggtataattctgggatagatctgttactggcatagtcatgacaacctctggtaatcttaccttctcctttttatgaagggaagagcaatggtttggacttacatcttaattaaggctattttaagcagattgttttgcaacagattaagaattgggtcccaaagtgggttatttcaaggcatttttgaagactggaggagcgtaggagggagtggtgagggaacctagaacttcttgctccttgtgactatgacagatgtctgatgcccccagcgcactggagtctggggcttggtgcaggtggtgccccatcagtgtggacagacactacttgcctttgtggtttagtgttggaagctttaattattctacagttccatagattcacaattttatagccaaacagtttgtatccacctgctttcagaggaggaaccaaaggccaaattactttgaggtagggcttagctggacctgggttttcctatgctcttttcatgctgtgttggagggtgtgtccactgccagatctgtgtaacccgtctgggtcaggggatgagtgacagcaaaccatcttaaaatttttcatgagtacatttaagcggaagcatacgggaatatgagtgcaaaagtgtggctgagccgcgtatgcccttgattggttttgggaagcctgagggaggcagccttcctggctatgagccatcgcctgcccaatcaggctaagggtggtgactggggtggtgaaggggcagctctgctgagcatggtctgccttatggcctgaattgtcctcaaggggtgtggactgcagatggtgttcacatgaaccggagacatcactctttaggattctactggcagcccctgaattggctcaacgtttgtggaggtggtatttccctgaagtactgagctttgttttataataattaaaatccttatttggtccaatttaatatagtttagaagctattttttttgaggcaaaccgtttttgaaaatgtaaattttgtttttaattaaaaataaagtcttagttaagaaaactcaggatgcacaaaactattcagactgttactttagctttctcccattacctcatcagtaatattcaccacattttgctaaatatttattgattagagtgttgaaatcaaattctgctctaaatgtgtgtgaatatgttggagaggctttgtgttcttcactgtgaaatgcaattgtgccttgaataagaaggtacctagaagccaaattaaagtaataatgacttcttattggctttgatttttcattgcagtatatgggattgtacagcaggaaatgcttatcattaatttctgatgttttttaaagcacaactcgaaacatttcgatcatacatacatagcagtagagatctgtgcccttcaggtacattgaatctgaccatcagtttatatatgtcattgaattttaagaatactcatgttaataatagtcatctatccttgcattttgaaactgttctaatcttagtgaacttgaattggatttctgggtaaaagaatgtgtttcttttatgttgcttatgtccgaaggccttgtcagaatctgtcagactcttgtttaggtttagtgtgatcatggcgtcagagaagcaaagctttcaaataaatagtacttcaggaaatagaaatgattgaccaactttaaaaataatttttttttaattgcaatatgcagcttcagttgcccagaatcttagttccgtttctcattcttggtcttgagctggtcaggtgacatcagcagattagaagttgaatggagattaagtggattcaggaggatgttccacttagagcagtcttcaaaatgataaggtgttctagaagaaaggaatgtagtaggaactatactatgcctaactttctatcccagagtgtcttgcaagagtttaggagttttggaccctgtgtattggcagaaaagttatctccatcttaagcaggcatgacttttatacctgtgagctcatttaaggtgcatttaaacctaaaataatttccctgtattatgcttcatgggattaacactgcttttccagaacattttcagattcccctccttacatcctgagctccttctgtatatacatctgttgattttatccatccacaaggaacaatgatagtcacattagagaacaagaaaccagtaatacatggtctctaactgatgattcgggcctggatttgattgaaagtgtttgcagttcctcttccgtagaatacagagtggatgaaaatgttttcaatgcacagaacaggatgaatccttttttctttatttagcgatttacacttttgttactctattatatattcagttagtgtctgataagattttctttgcttaaggagaacggacattgccttggtatgtttttttttttttttccctccacttttggagcttatcaggtaaaaatctcaagccacatgaattgttaacacctctgttgggaaaagcctttgtgagtttttatgtacttggtctttgtttttgttattcatcctgtgtcctccctcttcccgatgtgctgttttacctaggagttagtctgctttctgaggatcttttagagagaggctgtgaagtgctgaatcacctttaatgatacagcacttctgccatctcagcatctacataggacttacatagacttcctgaatgtgtcttcttcagatactaaagtacagttggatcattttcttatctccttttcttaagcagtactttgcaggtactcccctttgaaagccagaagcataaaccattggggaatcttaacttgtagacatgcagtaaaagaaatgcatttatgtaagatctgtgagtacttaaaaagaaagccctcagtgtgtgtgaagtgaatgtgaaatgtgtgtgaaatacatagaattcccaaatagtttagcaaaggcagggcgcaatatcaagtaatttaaaaatggtccaaggaactgtaagaaggaggaactaattctagaataaatgttaaaatgccattcaagaacaaaaccacagatgccatacagacctcctgtgcttaagttatagaagaataaaaatctgaatgaatggaaggccttacgtgtatacagtttacaaattcctatttctaaaatttaagtcccttatttaacagaagtatgtattttaatgcttaactgtctcgggaaacctcatttgtgacatcatctaaggggatgggaagactagggagccagtgccacgttgaacagaacagtggtttagtgaatgtgtgaggaaagacatgggcaactgattattaatgtttttgtaattcagtttataacttggaaccaatgaaaagcaacaaaactaaactggtttgacagcctgccacttctggcatttcctgtaagtcactagcagtaggtgtgaggtgggcttgcccatgaccaggaggggtgtgtgtgtgtgtgtgcatgtgtgtatatgcgtgttggtctgcagtcacagcatacctttatgtgcatgtgtcctcgcagcttgggactcagcagtattctgggagggtggaggtgaactgtcccatgtattgtattatatattttttgagatggggtcttgctctgttgcccaggctggagtgcagtggtgcgatctcagctcactgcaacttttgcctcctggttcaagcagttctcctgcctcagcctgccaaatagctgggattacaggtgtgtaccaccactcccagctaatttttgtatttttagtagagatggggttttaccatgttggccaggctggtctcgagctcctggcctcaggtgatccacctgctttggcctcccaaagtgctgagattacaggcgtgaactaccgcgcctggccccatgtattgtatttttttcaggttatattgaaatctactaccaggaatgtcggaatgggttttggtatgtataatggaaatagatagagtggttaagtctagaaacacatacattaattgtattgaaatgttatatcaatacatcatttatgatgtgtgtgtggtcccagacctcatggccaccagtttgtttaagcattgtgaatgctttttaatagcattcattagcattaatggaggaggacactgtgttttctcaattaatctcattgatttgtttggtataagtttgggtcagaaatgaaactgccaaaacatcgatcagtacaaggaagggacacagggcttaaaatgtccacagtcttggcagtggacttggcagttctcccagtaagcagaagtacttgagcttaattctgaacttcaaagtaatattttatacttaattttaggagttttcatttacatattgaaaaatgccttgactgtattcacataaatggtgctaaaacattgtaccccttataagaactgcagcaatccacagtaatgttggttacttctgagtatttgataaaggaacaaagtcaaaatgaatgtatttaataagcttctttctcatttccattgtttttataaaaatattttggtattgttgcctgcattttagccacttctaactttttgtattatgaatttggagaggataacaagccaactttagaccctctgccagtggcgatggtgtttttcttccatgggtaagccattgtgaatggaggctggtggagcagcacactgtgtgaacctggcagcgctcatcttggcttgtttagcagtgcctctgtttacaccataagatgttccgcatgtgtccaaaatttcgcctgctctgaaaaacatgcccccgaggctctgtgcagtttggggccttggttcccacctgcagatgcggtcagttgcctggctcctggggccagagtttcctctgttacttgttgagtctcttgtcttcactgtcagaagctgaactgacttgggggctttgctgttgatccactttagcaaaccctgctgcagaggactgtaaaaacaaataactaaaaataaacttagaaaatacaactcagaagcctggctctgttgctgtggtcaaatgcttgcctttgaggactttggcagattgtgctattacattgggctctaactttctggcacccgcaaggcagacctatgatgtccacatggctgactcttgacccctggccattgtgagcagaggaatcaagggtttagggaggcagtattgggcagtgtggaagagttagatgagatgaagcagttagcacagtgcttaacccatactaagtgcccccaaccctgccagccaaattaggtgcatagttttcagcttgggtctggattcaacagcattcccgctgcccactaaaagggtgggcttggacagttcctgaacctccctaaatctgtttcttcatctttaccacacacagtctgtctcagtggtggtgtggattaagtgaggtgctagcacttattaggggaagatcctccagacctgcaaagcagggctgcagccccaattctgacccagccctgctgtgtgtttgccgcaaagaggtttggtgtgtgcgagacatttctttatgaaccatttacactgctggaaatgtacccactaatgtgatggcaagaacttcaacaaattgcttatgaatcaggctctcaatggaagaagttaatcctctgaagagggggaagactggactttcagaagtatgttggggatagagaatgaagtttgagtcagcagagctctgccttcctgtttgtcaaagaactagagtctgggagtcttgcaagatggagctgggcttctgaagaacccagtgggtaggtactgggcatccattagacggcagtgctaagtcggtcatgtgcagcagaaagacctccccactgtgaacaacaaaccactttcctcctccagtggcccattcatttggattgatacactttttcagtgtcagaaatgcactttctccctctacttgtctgaattacgatgctctgctcaactctgtggacagtgtttcttgaatttccttttccaccgccttttcccactcaagaaagtggagagaaaaacagggatgcaggctgtgggtcttgtggaagccctttacaaccattaaataaagaacaccagctgc

SEQ ID NO: 162951 - DNA, 420 bp, Homo sapiens
  Payload ID: 12111
  Gene Symbol: OTULIN
  Gene Name: OTU deubiquitinase with linear linkage specificity
  ENST ID: ENST00000514913
  CDS Start-End: 1-200
aagcaacgtgtatgaaaatgggctatgaagaggtttctcagaagttcacctccatacggcgagtccgtggtgataattactgtgcactgagggccacgctgttccaggccatgagccaggctgtggggctgccgccctggctgcaggacccggagctcatgctggtacgctgctgctgcagttaccagaaaaactcataagcaaatacaactggatcaagcaatggaaacttggactgaaatttgatgggaagaatgaggacctggttgataaaattaaagagtcccttactctgctgaggaagaagtgggcaggcttggctgaaatgagaactgctgaagcaagacagatagcttgtgatgaactattcacaaatgaggcggaggaatatagcctctatgaagctgtaaaatttctaat

SEQ ID NO: 162952 - DNA, 605 bp, Homo sapiens
  Payload ID: 12111
  Gene Symbol: OTULIN
  Gene Name: OTU deubiquitinase with linear linkage specificity
  ENST ID: ENST00000506417
  CDS Start-End: 1-253
ggccatgagccaggctgtggggctgccgccctggctgcaggacccggagctcatgctggttgaaatgttccttcttgcctatgctgtgcgccacaccatccaggtgtaccggctctccaagtacaacacggaagaattcatcacagtctaccccaccgacccacccaaggactggccagtggtaacgctcattgctgaggacgatcggcactataacatccccgtcagagtgtgtgaggagaccagtctatgagagacgcatgctcctgacagcctggcgacgtggcgaagatgcacaggtggctcctgggcttgggctgcaggtttgggggtctctaagaacaatctctgagaagaacccttgggcccctgggagccaagttggacaggatgtcctgaagactagcttttgataagagaaattaaccaagtctttcccctcatctatgatgcaatatatttcagtgggggccttcagagcacacctgttggacggtgcaaaccatatcttctccagaaggcaaatacttttgtatcagaggaaactcagttttggagaggaatatgttctttatgtctcaaatcaaaactctctctaatggtaa

SEQ ID NO: 162953 - DNA, 911 bp, Homo sapiens
  Payload ID: 12111
  Gene Symbol: OTULIN
  Gene Name: OTU deubiquitinase with linear linkage specificity
  ENST ID: ENST00000503023
  CDS Start-End: 163-339
agaggccgtggggcgggccacggtgacgcgcgcggaagcgctctgcgggccctcggaaaccgccccggcggctgagaggctgcggccactgcctggcaccccgacgggaggggctccggatcgttcggagccggctgaaccccttcggccgcgagcgaccgcatgagtcgggggactatgccccagcccgaagcgtggccaggcgcgagctgcgccgagacgccggcgcgggaggcggcggccacggcgcgggacggcgggaaggcggcggccagcgggcagccgcggcccgagatgcagtgcccggccgagcaaaccgagattaagcgtagctcctgaaatggatatcatggactactgcaaaaaagaatggagaggaaatacacagaaagcaacgtgtatgaaaatgggctatgaagaggtttctcagaagttcacctccatacggcgagtccgtggtgataattactgtgcactgagggccacgctgttccaggccatgagccaggctgtggggctgccgccctggctgcaggacccggagctcatgctgttaccagaaaaactcataagcaaatacaactggatcaagcaatggaaacttggactgaaatttgatgggaagaatgaggacctggttgataaaattaaagagtcccttactctgctgaggaagaagtgggcaggcttggctgaaatgagaactgctgaagcaagacagatagcttgtgatgaactattcacaaatgaggcggaggaatatagcctctatgaagctgtaaaatttctaatgctaaacagagccattgaactatataatgataaagagaaaggaaaggaagtaccatttttctctgtgcttctgtttgctcgggacacatcaaatgacccaggacagcttctgaggaacc

SEQ ID NO: 162954 - DNA, 1296 bp, Homo sapiens
  Payload ID: 12112
  Gene Symbol: OTUB1
  Gene Name: OTU deubiquitinase, ubiquitin aldehyde binding 1
  Uniprot ID: Q96FW1
  ENST ID: ENST00000428192
  CDS Start-End: 324-1139
gctgctccgcactgcagctatggtcgcatgcagtgcctgccgaagcccgcagcaggaatgctgccttcggtgattttaatttcacttttctacttctctcaataacaaaatccgcgtttcaaactccagggaaaagaaaacggaattggctccaggaggatctgcaatcaccaccgggaactttgggaggctgggaagatggagccaaaccaatgtgtggggtggagggctgttgccaaggcggggcaacgaggaggggctcgcttccgggaggacggcaattggcaacccggaagcggtcggtagtgcggcgctgtttaaagatggcggcggaggaacctcagcagcagaagcaggagccgctgggcagcgactccgaaggtgttaactgtctggcctatgatgaagccatcatggctcagcaggaccgaattcagcaagagattgctgtgcagaaccctctggtgtcagagcggctggagctctcggtcctatacaaggagtatgctgaagatgacaacatctatcaacagaagatcaaggacctccacaaaaagtactcgtacatccgcaagaccaggcctgacggcaactgtttctatcgggctttcggattctcccacttggaggcactgctggatgacagcaaggagttgcagcggttcaaggctgtgtctgccaagagcaaggaagacctggtgtcccagggcttcactgaattcacaattgaggatttccacaacacgttcatggacctgattgagcaggtggagaagcagacctctgtcgccgacctgctggcctccttcaatgaccagagcacctccgactaccttgtggtctacctgcggctgctcacctcgggctacctgcagcgcgagagcaagttcttcgagcacttcatcgagggtggacggactgtcaaggagttctgccagcaggaggtggagcccatgtgcaaggagagcgaccacatccacatcattgcgctggcccaggccctcagcgtgtccatccaggtggagtacatggaccgcggcgagggcggcaccaccaatccgcacatcttccctgagggctccgagcccaaggtctaccttctctaccggcctggacactacgatatcctctacaaatagggctggctccagcccgctgctgccctgctgcccccctctgccaggcgctagacatgtacagaggtttttctgtggttgtaaatggtcctatttcacccccttcttcctgtcacatgacccccccccatgttttattaaagggggtgctggtggtgag

SEQ ID NO: 162955 - DNA, 2297 bp, Homo sapiens
  Payload ID: 12112
  Gene Symbol: OTUB1
  Gene Name: OTU deubiquitinase, ubiquitin aldehyde binding 1
  ENST ID: ENST00000422031
  CDS Start-End: 605-1423
agttaggtcatgaggctttggccttgacaccaagggatgctgtctccttgccggaagcagctcaccaaagccggcagagaacccaggttccgtggggccacgatgtggggctccgcgggcgccccggcgctggccgacttcctgtctcctgggtcagatgctgctccgcactgcagctatggtcgcatgcagtgcctgccgaagcccgcagcaggaatgctgccttcggtgattttaatttcacttttctacttctctcaataacaaaatccgcgtttcaaactccagggaaaagaaaacggaattggctccaggaggatctgcaatcaccaccgggaactttgggaggctgggaagatggagccaaaccaatgtgtggggtggaggtgcggatctggggcggccggcctctcctacaggtctcaggtccgcaggcctggcgtgccagcacctgccacgggactggaagcccattccttgacaacgcctaaggggatcccgttgctagggctgttgccaaggcggggcaacgaggaggggctcgcttccgggaggacggcaattggcaacccggaagcggtcggtagtgcggcgctgtttaaagatggcggcggaggaacctcagcagcagaagcaggagccgctgggcagcgactccgaaggtgttaactgtctggcctatgatgaagccatcatggctcagcaggaccgaattcagcaagagattgctgtgcagaaccctctggtgtcagagcggctggagctctcggtcctatacaaggagtatgctgaagatgacaacatctatcaacagaagatcaaggacctccacaaaaagtactcgtacatccgcaagaccaggcctgacggcaactgtttctatcgggctttcggattctcccacttggaggcactgctggatgacagcaaggagttgcagcgcaggttcaaggctgtgtctgccaagagcaaggaagacctggtgtcccagggcttcactgaattcacaattgaggatttccacaacacgttcatggacctgattgagcaggtggagaagcagacctctgtcgccgacctgctggcctccttcaatgaccagagcacctccgactaccttgtggtctacctgcggctgctcacctcgggctacctgcagcgcgagagcaagttcttcgagcacttcatcgagggtggacggactgtcaaggagttctgccagcaggaggtggagcccatgtgcaaggagagcgaccacatccacatcattgcgctggcccaggccctcagcgtgtccatccaggtggagtacatggaccgcggcgagggcggcaccaccaatccgcacatcttccctgagggctccgagcccaaggtctaccttctctaccggcctggacactacgatatcctctacaaatagggctggctccagcccgctgctgccctgctgcccccctctgccaggcgctagacatgtacagaggtttttctgtggttgtaaatggtcctatttcacccccttcttcctgtcacatgacccccccccatgttttattaaagggggtgctggtggtgagccgtgtgtgcgtgtccctgctctgctgcccgcctggctgctctgtctgctgccccctccccccaggtgggtccccctgcttttcacctatctactcctgagcttccccaacaggagcaggtttgaggggccaggcctcttggaggcccctcctgcttcgttgggttctgcttccttcccttcttagctggctcaggggcttctatgggatcctggaagttccttagggacttgcccagggtcccagggccacccacacttcatctgctccctcataggccccacctccacgtcccggctgggccccagaccccagcttcctgccctccaccgggagtctgcatggttgggagtcctgggtggaggggcctttgtgaggctggacccggctcagggcaggtggaggagctgggcctcccacagggtgcccgggcagtgccatcctggtgggggagggcagccttcaaacgtgtggggtctacagtcctcaggtctaggcagggctgccggttctccacctccccatccgccccaggccccctgcctgtgcctgccttgcaccccctctgcttgggccacggtgtctctgcattgcctgcctttttgccttcacctcttttcttccccgccccctgcacattcggggtctcagcccccaggctgtgagctccttgggggcaggccctcaataaatgtgaactgctgctgccgcctctgc

SEQ ID NO: 162956 - DNA, 1647 bp, Homo sapiens
  Payload ID: 12112
  Gene Symbol: OTUB1
  Gene Name: OTU deubiquitinase, ubiquitin aldehyde binding 1
  ENST ID: ENST00000543004
  CDS Start-End: 12-854
gctgtttaaagatggcggcggaggaacctcagcagcagaagcaggagccgctgggcagcgactccgaaggtgttaactgtctggcctatgatgaagccatcatggctcagcaggaccgaattcagcaagaggacatgacagatccctgcctcctccagattgctgtgcagaaccctctggtgtcagagcggctggagctctcggtcctatacaaggagtatgctgaagatgacaacatctatcaacagaagatcaaggacctccacaaaaagtactcgtacatccgcaagaccaggcctgacggcaactgtttctatcgggctttcggattctcccacttggaggcactgctggatgacagcaaggagttgcagcggttcaaggctgtgtctgccaagagcaaggaagacctggtgtcccagggcttcactgaattcacaattgaggatttccacaacacgttcatggacctgattgagcaggtggagaagcagacctctgtcgccgacctgctggcctccttcaatgaccagagcacctccgactaccttgtggtctacctgcggctgctcacctcgggctacctgcagcgcgagagcaagttcttcgagcacttcatcgagggtggacggactgtcaaggagttctgccagcaggaggtggagcccatgtgcaaggagagcgaccacatccacatcattgcgctggcccaggccctcagcgtgtccatccaggtggagtacatggaccgcggcgagggcggcaccaccaatccgcacatcttccctgagggctccgagcccaaggtctaccttctctaccggcctggacactacgatatcctctacaaatagggctggctccagcccgctgctgccctgctgcccccctctgccaggcgctagacatgtacagaggtttttctgtggttgtaaatggtcctatttcacccccttcttcctgtcacatgacccccccccatgttttattaaagggggtgctggtggtgagccgtgtgtgcgtgtccctgctctgctgcccgcctggctgctctgtctgctgccccctccccccaggtgggtccccctgcttttcacctatctactcctgagcttccccaacaggagcaggtttgaggggccaggcctcttggaggcccctcctgcttcgttgggttctgcttccttcccttcttagctggctcaggggcttctatgggatcctggaagttccttagggacttgcccagggtcccagggccacccacacttcatctgctccctcataggccccacctccacgtcccggctgggccccagaccccagcttcctgccctccaccgggagtctgcatggttgggagtcctgggtggaggggcctttgtgaggctggacccggctcagggcaggtggaggagctgggcctcccacagggtgcccgggcagtgccatcctggtgggggagggcagccttcaaacgtgtggggtctacagtcctcaggtctaggcagggctgccggttctccacctccccatccgccccaggccccctgcctgtgcctgccttgcaccccctctgcttgggccacggtgtctctgcattgcctgcctttttgccttcacctcttttcttccccgccccctgca

SEQ ID NO: 162957 - DNA, 1803 bp, Homo sapiens
  Payload ID: 12112
  Gene Symbol: OTUB1
  Gene Name: OTU deubiquitinase, ubiquitin aldehyde binding 1
  ENST ID: ENST00000541478
  CDS Start-End: 461-973
tctcctgggtcagatgctgctccgcactgcagctatggtcgcatgcagtgcctgccgaagcccgcagcaggaatgctgccttcggtgattttaatttcacttttctacttctctcaataacaaaatccgcgtttcaaactccagggaaaagaaaacggaattggctccaggaggatctgcaatcaccaccgggaactttgggaggctgggaagatggagccaaaccaatgtgtggggtggaggtgcggatctggggcggccggcctctcctacaggtctcaggtccgcaggcctggcgtgccagcacctgccacgggactggaagcccattccttgacaacgcctaaggggatcccgttgctagggctgttgccaaggcggggcaacgaggaggggctcgcttccgggaggacggcaattggcaacccggaagcggtcggtagtgcggcgctgtttaaagatggcggcggaggaacctcagcagcagaagcaggagccgctgggcagcgactccgaaggtgttaactgtctggcctatgatgaagccatcatggctcagcaggaccgaattcagcaagagttcatggacctgattgagcaggtggagaagcagacctctgtcgccgacctgctggcctccttcaatgaccagagcacctccgactaccttgtggtctacctgcggctgctcacctcgggctacctgcagcgcgagagcaagttcttcgagcacttcatcgagggtggacggactgtcaaggagttctgccagcaggaggtggagcccatgtgcaaggagagcgaccacatccacatcattgcgctggcccaggccctcagcgtgtccatccaggtggagtacatggaccgcggcgagggcggcaccaccaatccgcacatcttccctgagggctccgagcccaaggtctaccttctctaccggcctggacactacgatatcctctacaaatagggctggctccagcccgctgctgccctgctgcccccctctgccaggcgctagacatgtacagaggtttttctgtggttgtaaatggtcctatttcacccccttcttcctgtcacatgacccccccccatgttttattaaagggggtgctggtggtgagccgtgtgtgcgtgtccctgctctgctgcccgcctggctgctctgtctgctgccccctccccccaggtgggtccccctgcttttcacctatctactcctgagcttccccaacaggagcaggtttgaggggccaggcctcttggaggcccctcctgcttcgttgggttctgcttccttcccttcttagctggctcaggggcttctatgggatcctggaagttccttagggacttgcccagggtcccagggccacccacacttcatctgctccctcataggccccacctccacgtcccggctgggccccagaccccagcttcctgccctccaccgggagtctgcatggttgggagtcctgggtggaggggcctttgtgaggctggacccggctcagggcaggtggaggagctgggcctcccacagggtgcccgggcagtgccatcctggtgggggagggcagccttcaaacgtgtggggtctacagtcctcaggtctaggcagggctgccggttctccacctccccatccgccccaggccccctgcctgtgcctgccttgcaccccctctgcttgggccacggtgtctctgcattgcctgcctttttgccttcacctcttttcttccccgccccctgcacattcggggtctcagcccccaggctgtgagctccttg

SEQ ID NO: 162958 - DNA, 1391 bp, Homo sapiens
  Payload ID: 12112
  Gene Symbol: OTUB1
  Gene Name: OTU deubiquitinase, ubiquitin aldehyde binding 1
  ENST ID: ENST00000535715
  CDS Start-End: 453-1313
gtcagatgctgctccgcactgcagctatggtcgcatgcagtgcctgccgaagcccgcagcaggaatgctgccttcggtgattttaatttcacttttctacttctctcaataacaaaatccgcgtttcaaactccagggaaaagaaaacggaattggctccaggaggatctgcaatcaccaccgggaactttgggaggctgggaagatggagccaaaccaatgtgtggggtggaggtgcggatctggggcggccggcctctcctacaggtctcaggtccgcaggcctggcgtgccagcacctgccacgggactggaagcccattccttgacaacgcctaaggggatcccgttgctagggctgttgccaaggcggggcaacgaggaggggctcgcttccgggaggacggcaattggcaacccggaagcggtcggtagtgcggcgctgtttaaagatggcggcggaggaacctcagcagcagaagcaggagccgctgggcagcgactccgaaggtgttaactgtctggcctatgatgaagccatcatggctcagcaggaccgaattcagcaagagattgctgtgcagaaccctctggtgtcagagcggctggagctctcggtcctatacaaggagtatgctgaagatgacaacatctatcaacagaagatcaaggacctccacaaaaagtactcgtacatccgcaagaccaggcctgacggcaactgtttctatcgggctttcggattctcccacttggaggcactgctggatgacagcaaggagttgcagcggttcaaggctgtgtctgccaagagcaaggaagacctggtgtcccagggcttcactgaattcacaattgaggatttccacaacacgttcatggacctgattgagcaggtggagaagcagacctctgtcgccgacctgctggcctccttcaatgaccagagcacctccgactaccttgtggtctacctgcggctgctcacctcgggctacctgcagcgcgagagcaagttcttcgagcacttcatcgagggtggacggactgtcaaggagttctgccagcaggaggtggagcccatgtgcaaggagagcgaccacatccacatcattgcgctggcccaggccctcagcgtgtccatccagggggtgctggtggtgagccgtgtgtgcgtgtccctgctctgctgcccgcctggctgctctgtctgctgccccctccccccagatggacaaaccaaggccaccttctccttcatcacctcagtctcggcacagttccagggatgccagggagaaaggcagctgtagcccagggcgaggctgagatggagcaagaaggcagggcccagagcgggcgtccaggctggagctcccagtgctgggaag

SEQ ID NO: 162959 - DNA, 1259 bp, Homo sapiens
  Payload ID: 12112
  Gene Symbol: OTUB1
  Gene Name: OTU deubiquitinase, ubiquitin aldehyde binding 1
  ENST ID: ENST00000543988
  CDS Start-End: 230-955
ccttgcagtcaggcagagaggcctacgccagggccgagccccccggcctgctccagcggcggcccgcgccgtgagggcctcgagtttcgctgggctacggagcacaaaggtccgggcgggccattcgggatgtcgtaggcggccctgggatgtgaggggcctgcgggatctgtccctgaggcctgcgactttttctggtgttaactgtctggcctatgatgaagccatcatggctcagcaggaccgaattcagcaagagattgctgtgcagaaccctctggtgtcagagcggctggagctctcggtcctatacaaggagtatgctgaagatgacaacatctatcaacagaagatcaaggacctccacaaaaagtactcgtacatccgcaagaccaggcctgacggcaactgtttctatcgggctttcggattctcccacttggaggcactgctggatgacagcaaggagttgcagcggttcaaggctgtgtctgccaagagcaaggaagacctggtgtcccagggcttcactgaattcacaattgaggatttccacaacacgttcatggacctgattgagcaggtggagaagcagacctctgtcgccgacctgctggcctccttcaatgaccagagcacctccgactaccttgtggtctacctgcggctgctcacctcgggctacctgcagcgcgagagcaagttcttcgagcacttcatcgagggtggacggactgtcaaggagttctgccagcaggaggtggagcccatgtgcaaggagagcgaccacatccacatcattgcgctggcccaggccctcagcgtgtccatccaggtggagtacatggaccgcggcgagggcggcaccaccaatccgcacatcttccctgagggctccgagcccaaggtctaccttctctaccggcctggacactacgatatcctctacaaatagggctggctccagcccgctgctgccctgctgcccccctctgccaggcgctagacatgtacagaggtttttctgtggttgtaaatggtcctatttcacccccttcttcctgtcacatgacccccccccatgttttattaaagggggtgctggtggtgagccgtgtgtgcgtgtccctgctctgctgcccgcctggctgctctgtctgctgccccctccccccaggtgggtccccctgcttttcacctatctactcctgagcttccccaacaggagcaggtttgaggggccaggcctcttggaggcc

SEQ ID NO: 162960 - DNA, 1729 bp, Homo sapiens
  Payload ID: 12112
  Gene Symbol: OTUB1
  Gene Name: OTU deubiquitinase, ubiquitin aldehyde binding 1
  Uniprot ID: Q96FW1
  ENST ID: ENST00000538426
  CDS Start-End: 45-860
aattggcaacccggaagcggtcggtagtgcggcgctgtttaaagatggcggcggaggaacctcagcagcagaagcaggagccgctgggcagcgactccgaaggtgttaactgtctggcctatgatgaagccatcatggctcagcaggaccgaattcagcaagagattgctgtgcagaaccctctggtgtcagagcggctggagctctcggtcctatacaaggagtatgctgaagatgacaacatctatcaacagaagatcaaggacctccacaaaaagtactcgtacatccgcaagaccaggcctgacggcaactgtttctatcgggctttcggattctcccacttggaggcactgctggatgacagcaaggagttgcagcggttcaaggctgtgtctgccaagagcaaggaagacctggtgtcccagggcttcactgaattcacaattgaggatttccacaacacgttcatggacctgattgagcaggtggagaagcagacctctgtcgccgacctgctggcctccttcaatgaccagagcacctccgactaccttgtggtctacctgcggctgctcacctcgggctacctgcagcgcgagagcaagttcttcgagcacttcatcgagggtggacggactgtcaaggagttctgccagcaggaggtggagcccatgtgcaaggagagcgaccacatccacatcattgcgctggcccaggccctcagcgtgtccatccaggtggagtacatggaccgcggcgagggcggcaccaccaatccgcacatcttccctgagggctccgagcccaaggtctaccttctctaccggcctggacactacgatatcctctacaaatagggctggctccagcccgctgctgccctgctgcccccctctgccaggcgctagacatgtacagaggtttttctgtggttgtaaatggtcctatttcacccccttcttcctgtcacatgacccccccccatgttttattaaagggggtgctggtggtgagccgtgtgtgcgtgtccctgctctgctgcccgcctggctgctctgtctgctgccccctccccccaggtgggtccccctgcttttcacctatctactcctgagcttccccaacaggagcaggtttgaggggccaggcctcttggaggcccctcctgcttcgttgggttctgcttccttcccttcttagctggctcaggggcttctatgggatcctggaagttccttagggacttgcccagggtcccagggccacccacacttcatctgctccctcataggccccacctccacgtcccggctgggccccagaccccagcttcctgccctccaccgggagtctgcatggttgggagtcctgggtggaggggcctttgtgaggctggacccggctcagggcaggtggaggagctgggcctcccacagggtgcccgggcagtgccatcctggtgggggagggcagccttcaaacgtgtggggtctacagtcctcaggtctaggcagggctgccggttctccacctccccatccgccccaggccccctgcctgtgcctgccttgcaccccctctgcttgggccacggtgtctctgcattgcctgcctttttgccttcacctcttttcttccccgccccctgcacattcggggtctcagcccccaggctgtgagctccttgggggcaggccctcaataaatgtgaactgctgctgccgcc

SEQ ID NO: 162961 - DNA, 638 bp, Homo sapiens
  Payload ID: 12112
  Gene Symbol: OTUB1
  Gene Name: OTU deubiquitinase, ubiquitin aldehyde binding 1
  ENST ID: ENST00000535140
  CDS Start-End: 126-434
ttgcagtcaggcagagaggcctacgccagggccgagccccccggcctgctccagcggcggcccgcgccgtgagggcctcgagtttcgctgggctacggagcacaaaggtgttaactgtctggcctatgatgaagccatcatggctcagcaggaccgaattcagcaagagattgctgtgcagaaccctctggtgtcagagcggctggagctctcggtcctatacaaggagtatgctgaagatgacaacatctatcaacagaagatcaaggacctccacaaaaagtactcgtacatccgcaagaccaggcctgacggcaactgtttctatcgggctttcggattctcccacttggaggcactgctggatgacagcaaggagttgcagcggtggagaagcagacctctgtcgccgacctgctggcctccttcaatgaccagagcacctccgactaccttgtggtctacctgcggctgctcacctcgggctacctgcagcgcgagagcaagttcttcgagcacttcatcgagggtggacggactgtcaaggagttctgccagcaggaggtggagcccatgtgcaaggagagcgaccacatccacatcattgcgctggcccaggccctcagcgtgtccatcca

SEQ ID NO: 162962 - DNA, 3922 bp, Homo sapiens
  Payload ID: 12113
  Gene Symbol: OTUB2
  Gene Name: OTU deubiquitinase, ubiquitin aldehyde binding 2
  Uniprot ID: Q96DC9
  ENST ID: ENST00000203664
  CDS Start-End: 210-914
acgtcaatcgcagggcgtgtgtcttgctgggacacagtggaggtctaacctttggtttgcggagcggtcgggtgtattctccgccgcccccacgccctcgaggtccccgccaccgaaccagcggcggagcccgcccgcgcctcccgcggcattcccgcaccggatcgctcctcgctggggcgggacctggcctggcggctctggtcactatgagtgaaacatctttcaacctaatatcagaaaaatgtgacattctatccattcttcgggaccatcctgaaaacaggatttaccggaggaaaatcgaggaactcagcaaaaggttcaccgccatccgcaagaccaaaggggatgggaactgcttctacagggccttgggctattcctacctggagtccctgctggggaagagcagggagatcttcaagttcaaagaacgcgtactgcagaccccaaatgaccttctggctgctggctttgaggagcacaagttcagaaacttcttcaatgctttttacagtgtggtggaactggtagagaaggatggctcagtgtccagcctgctgaaggtgttcaacgaccagagtgcctcggaccacatcgtgcagttcctgcgcctgctcacgtcggccttcatcaggaaccgagcagacttcttccggcacttcattgatgaggagatggacatcaaagacttctgcactcacgaagtagagcccatggccacggagtgtgaccacatccagatcacggcgttgtcgcaggccctgagcattgccctgcaagtggagtacgtggacgagatggataccgccctgaaccaccacgtgttccctgaggccgccaccccttccgtttacctgctctataaaacatcccactacaacatcctttatgcagccgataaacattgattaattttaggccatgcagtggaacctgtcacctaatgggactgcattctgaatggaacattccggctcttcaattttttaagcaatttagactgtagcaagaaaatgtgcagccttttgggcaaagcccctgggaacgaggcctatccactatggactatggtaacttggtaggatttttagtatttattttaatggagggacaaatgctttctaactgggcccccgactccgcaccccagttcgcagtgaggccctgggtgggtcacctgccctctctggacttgtttcttcaactggaggaggtccctgcctatgctgacattccattgtagaaaaatggggcctctggtgtctctttaccaggggcagtgcctctctgcgggggaggaaaagctcaaggttagctgtcttaacccaagtgacttaccaggcctacaaaagagtccagtccagtcacttgttggactgggctctgacagatggcctattgaggtcaacttgaatgtgagggctacggtgtggtttcaaacattcatgatggatgtattttcctacccctaacttaaggagaaaaaaaaaaagacttcctttttttgccaaagtccagaaaggggcctttagcctttagtaggagctcaaattgttggggcccctctacctctctcagggctagaactgcctgactcttggtggacgagcccttcagggttctgctttcagccccacctggacagaggcttacaagactagggtctggaccagaatctgtgtatttctgtctgggaccaggaagccgcagctgtcccatcatccccagcaaatcctagaagtggagtctggatacttcaaggatagaagtgttggcacgcacagccatggacccagctgagcagagcagacgctttgcaggctgcccctggcttcttcctccctttcccgcttctgctctctttatggactggtcagagggtaggtgggaaagaacagacaagccatgggaagttggcagtggggagatttccactgtggaaaccgcctgggaattccggccagcagcttcctccttcagccacctggccataccccttaaataagcccctcaccttgctgcctcaggaccttcaagattccatctgtgggctggccggcaagatggcaccagtggggacccacaccctggctgggcagaggtgctgctagcaacctctcttcctctataagaggaaatggaaaatgcagggtgtggaattgccctttggggtccttccttaattgaaggccaccttctcacaggtttcattctgcagggatttactggaatctattggtgctgctgcatgagtctgctgacaacctgactgcacaaggactgggtagcagactcctcagagtcctcttgacacaaatgtcagatttgtgtcactcttctgccttcgtgaaaagccaatagcactctcagatatcaggggattttagttccaagcagggaccctggtttccatactgccctcagctggagtttggatccaaaggctctggctaagtcattatgtcactttttcacaggaatgtaaatttgactgtcacctctgaatttgttcagtgtcccaccatggtctatgagaagtacactggaagcgtggggggaacacatgacatgatttgtgaatatcatcatctttgccagacaagtctccaggggatccctgtttcccaactgaaaggtgtgaacggacacacacacagcctggatgacgccttggctgttctaaggggctgtaaggtgggctctgggccttccagctaggctctcaagcacagcagaagcctcactgggctgctatgtctctgtatttgtggcttgtgtggtagcctcagaagcagagctgtttggcagactggctggagaaattccctctaggagacttgcctgtgctgtgcttccaggtcacagagccccccggaaactcacaggggccctcttcccagaaaagaatctattctatcacttcagaatcaggacactcaagctctggcagaggaaggccaagttactttcatggtcttaccctctgcttttcccctttttgcaaaaaaccactggccaaatccgaaccattgcccttgtttcccccacgttctctctcagatctttgtctcgaagggaaaacatagtggatgaaaaggtgtggcaggctttggcaccttgttaaaatttctagtcatctgtggatgttaccttgcttgtccacagcagccagtcaccctggccagtcccacttcctggataattctctaccctcaccccacagagccatctctctccagaccaaaagctggaaggagagttgctttgagagcttgtttttacaactgcatgtttattatgatactttctctccaaaggaaacttttaaatcaatgggaacaattagcaacagaaagagcacagtccctgcttttgactgggttcctattttaagcacaaatgagagctctggagccagaatgccagggttctaacttcagcattcacttactagctgtatgatcttggccaagtcacttcacctccctgagccccaattcccaagtttgtgaaatggcaacaatacctatgtgtcactggattattggttaaaacagaatgagattccttgtgtgaaaatagctattatacctgacacactcatcgtatgggctctgcaaagggatattccccaacctgtccttcctgacaggaagcatagggcactgcagatggggaagcatgtcaccttggcagtgactcggtggcttcccaagcaggagtgtcaggggaaccatgagagagagtctaggagcaaacacatcaccaccctgagcagatacaggagtggggagggggctgtaactcagtgagtggcttccaggggccccaggccctgctggatgtgggccaagccctacagcttccctaggcagtaagtaaaaacattctcctagcattaaaatggtttccataa

SEQ ID NO: 162963 - DNA, 708 bp, Homo sapiens
  Payload ID: 12113
  Gene Symbol: OTUB2
  Gene Name: OTU deubiquitinase, ubiquitin aldehyde binding 2
  Uniprot ID: Q96DC9
  ENST ID: ENST00000553723
  CDS Start-End: 161-382
ctttggtttgcggagcggtcgggtgtattctccgccgcccccacgccctcgaggtccccgccaccgaaccagcggcggagcccgcccgcgcctcccgcggcattcccgcaccggatcgctcctcgctggggcgggacctggcctggcggctctggtcactatgagtgaaacatctttcaacctaatatcagaaaaatgtgacattctatccattcttcgggaccatcctgaaaacaggatttaccggaggaaaatcgaggaactcagcaaaaggttcaccgccatccgcaagaccaaaggggatgggaactgcttctacagggccttgggctattcctacctggagtccctgctggggaagagcagggagatcttcaagtgagtgccggggccccttggcctgtcagggctgtgttctctgtgctaggtcagcctcaagtctctcggaggttttcgttacactcaggctggttaacccagagaatgagctgaagagctgcctggcagaggcgtttgatgttgggggtgcccagctgcctgctgtggtgaagttgggggcagccaaggggtggaggatggaatctgtgacctcccagatgctttccagcctctgcttccaccacaggcctgggtcagcccaggtgagtcgcagggagcaggtacttcgtgacccactctgaaaagaaaagaaaagacaaacaaaaagaa

SEQ ID NO: 162964 - DNA, 4616 bp, Homo sapiens
  Payload ID: 12113
  Gene Symbol: OTUB2
  Gene Name: OTU deubiquitinase, ubiquitin aldehyde binding 2
  Uniprot ID: Q96DC9
  ENST ID: ENST00000617748
  CDS Start-End: 210-914
acgtcaatcgcagggcgtgtgtcttgctgggacacagtggaggtctaacctttggtttgcggagcggtcgggtgtattctccgccgcccccacgccctcgaggtccccgccaccgaaccagcggcggagcccgcccgcgcctcccgcggcattcccgcaccggatcgctcctcgctggggcgggacctggcctggcggctctggtcactatgagtgaaacatctttcaacctaatatcagaaaaatgtgacattctatccattcttcgggaccatcctgaaaacaggatttaccggaggaaaatcgaggaactcagcaaaaggttcaccgccatccgcaagaccaaaggggatgggaactgcttctacagggccttgggctattcctacctggagtccctgctggggaagagcagggagatcttcaagttcaaagaacgcgtactgcagaccccaaatgaccttctggctgctggctttgaggagcacaagttcagaaacttcttcaatgctttttacagtgtggtggaactggtagagaaggatggctcagtgtccagcctgctgaaggtgttcaacgaccagagtgcctcggaccacatcgtgcagttcctgcgcctgctcacgtcggccttcatcaggaaccgagcagacttcttccggcacttcattgatgaggagatggacatcaaagacttctgcactcacgaagtagagcccatggccacggagtgtgaccacatccagatcacggcgttgtcgcaggccctgagcattgccctgcaagtggagtacgtggacgagatggataccgccctgaaccaccacgtgttccctgaggccgccaccccttccgtttacctgctctataaaacatcccactacaacatcctttatgcagccgataaacattgattaattttaggccatgcagtggaacctgtcacctaatgggactgcattctgaatggaacattccggctcttcaattttttaagcaatttagactgtagcaagaaaatgtgcagccttttgggcaaagcccctgggaacgaggcctatccactatggactatggtaacttggtaggatttttagtatttattttaatggagggacaaatgctttctaactgggcccccgactccgcaccccagttcgcagtgaggccctgggtgggtcacctgccctctctggacttgtttcttcaactggaggaggtccctgcctatgctgacattccattgtagaaaaatggggcctctggtgtctctttaccaggggcagtgcctctctgcgggggaggaaaagctcaaggttagctgtcttaacccaagtgacttaccaggcctacaaaagagtccagtccagtcacttgttggactgggctctgacagatggcctattgaggtcaacttgaatgtgagggctacggtgtggtttcaaacattcatgatggatgtattttcctacccctaacttaaggagaaaaaaaaaaagacttcctttttttgccaaagtccagaaaggggcctttagcctttagtaggagctcaaattgttggggcccctctacctctctcagggctagaactgcctgactcttggtggacgagcccttcagggttctgctttcagccccacctggacagaggcttacaagactagggtctggaccagaatctgtgtatttctgtctgggaccaggaagccgcagctgtcccatcatccccagcaaatcctagaagtggagtctggatacttcaaggatagaagtgttggcacgcacagccatggacccagctgagcagagcagacgctttgcaggctgcccctggcttcttcctccctttcccgcttctgctctctttatggactggtcagagggtaggtgggaaagaacagacaagccatgggaagttggcagtggggagatttccactgtggaaaccgcctgggaattccggccagcagcttcctccttcagccacctggccataccccttaaataagcccctcaccttgctgcctcaggaccttcaagattccatctgtgggctggccggcaagatggcaccagtggggacccacaccctggctgggcagaggtgctgctagcaacctctcttcctctataagaggaaatggaaaatgcagggtgtggaattgccctttggggtccttccttaattgaaggccaccttctcacaggtttcattctgcagggatttactggaatctattggtgctgctgcatgagtctgctgacaacctgactgcacaaggactgggtagcagactcctcagagtcctcttgacacaaatgtcagatttgtgtcactcttctgccttcgtgaaaagccaatagcactctcagatatcaggggattttagttccaagcagggaccctggtttccatactgccctcagctggagtttggatccaaaggctctggctaagtcattatgtcactttttcacaggaatgtaaatttgactgtcacctctgaatttgttcagtgtcccaccatggtctatgagaagtacactggaagcgtggggggaacacatgacatgatttgtgaatatcatcatctttgccagacaagtctccaggggatccctgtttcccaactgaaaggtgtgaacggacacacacacagcctggatgacgccttggctgttctaaggggctgtaaggtgggctctgggccttccagctaggctctcaagcacagcagaagcctcactgggctgctatgtctctgtatttgtggcttgtgtggtagcctcagaagcagagctgtttggcagactggctggagaaattccctctaggagacttgcctgtgctgtgcttccaggtcacagagccccccggaaactcacaggggccctcttcccagaaaagaatctattctatcacttcagaatcaggacactcaagctctggcagaggaaggccaagttactttcatggtcttaccctctgcttttcccctttttgcaaaaaaccactggccaaatccgaaccattgcccttgtttcccccacgttctctctcagatctttgtctcgaagggaaaacatagtggatgaaaaggtgtggcaggctttggcaccttgttaaaatttctagtcatctgtggatgttaccttgcttgtccacagcagccagtcaccctggccagtcccacttcctggataattctctaccctcaccccacagagccatctctctccagaccaaaagctggaaggagagttgctttgagagcttgtttttacaactgcatgtttattatgatactttctctccaaaggaaacttttaaatcaatgggaacaattagcaacagaaagagcacagtccctgcttttgactgggttcctattttaagcacaaatgagagctctggagccagaatgccagggttctaacttcagcattcacttactagctgtatgatcttggccaagtcacttcacctccctgagccccaattcccaagtttgtgaaatggcaacaatacctatgtgtcactggattattggttaaaacagaatgagattccttgtgtgaaaatagctattatacctgacacactcatcgtatgggctctgcaaagggatattccccaacctgtccttcctgacaggaagcatagggcactgcagatggggaagcatgtcaccttggcagtgactcggtggcttcccaagcaggagtgtcaggggaaccatgagagagagtctaggagcaaacacatcaccaccctgagcagatacaggagtggggagggggctgtaactcagtgagtggcttccaggggccccaggccctgctggatgtgggccaagccctacagcttccctaggcagtaagtaaaaacattctcctagcattaaaatggtttccataactacttttgtcctggcttcttaatactgggtacctggcatgcagccaagaactctgcttttccgtggtgcttatgtattaagtagattagctggggagggatattccttgtttaatggcagatccaggacactccggaagctctgcccaccaacttcaccttaccaggcgagagtagcactgcttggaaggctgctcctgccttttaaagcctgtctacgtattagctcctccaccaaggaaaagaatttgctgttagatggctagggcaggacacggacagtcatcaggggatctatgtttggcttatggcaagtggcttcactcccacggctcaggtgccattaggggatattaagcccgcttactaaccccactgaccaccactgcatcatttggaaaatggagagtctccctgccattctctgatagctgtcagtcaggagctgacctcacagacgggcaatttcccctcctattccggtcactggtgacactgggggatgggaggccattccttggcaacacttctgagactgaagtagttttctgaacttgtcctgggcccagaaggaagatactaatcccacctctgctacttggctgctgtgtggccctgggcaagtctcaatcactgggtgtctatatgctcaagtacaaaaaacactaataaagacttatagatgggcacagtg

SEQ ID NO: 162965 - DNA, 708 bp, Homo sapiens; identical to SEQ ID NO: 162963
  Payload ID: 12113
  Gene Symbol: OTUB2
  Gene Name: OTU deubiquitinase, ubiquitin aldehyde binding 2
  Uniprot ID: Q96DC9
  ENST ID: ENST00000628711
  CDS Start-End: 161-382

SEQ ID NO: 162966 - DNA, 3298 bp, Homo sapiens
  Payload ID: 12114
  Gene Symbol: OTUD6B
  Gene Name: OTU domain containing 6B
  ENST ID: ENST00000285420
  CDS Start-End: 100-1071
gcgcacgcgcagcaccccatttaagtttctcgtctttgcagtggctttgcttagatccggtgccgccttgaaggcggggctgggtcccagccgtagccaatggagccccgggtgagggttgaggggtggaaggtgcctactagccggtgcaggtttcttctagcgcgtgtgctggggtacctggtcgtcatggaggcggtattgaccgaagagcttgatgaggaagagcagctgctgagaaggcatcgcaaagagaagaaggagttgcaagccaaaattcagggcatgaagaatgctgttcccaagaatgacaagaagaggaggaagcaactcaccgaagatgtggccaagttggaaaaagaaatggaacagaaacatagagaggaactggagcaattgaagctgactactaaggagaataagatagattctgttgctgttaacatttcaaacttggtgcttgagaatcagccacctcggatatcaaaagcacaaaagagacgggaaaagaaagctgcattggaaaaggagcgagaagaacggatagctgaagctgaaattgaaaacttaacaggagccagacatatggaaagtgagaaacttgctcaaatattggcagctagacagttagaaattaaacagattccatctgatggccactgtatgtataaagccattgaagatcaactgaaagaaaaggattgtgctctgactgtggttgccttgagaagtcagaccgctgagtatatgcaaagccatgtggaagactttctgccatttttaacaaaccctaatacaggagatatgtatactccagaagaatttcagaagtactgtgaagatattgtaaacacagctgcatggggaggtcagcttgagctaagagctctgtctcacattttacaaacaccaatagagataatacaggcagattctcctcccattatagttggtgaagaatattcaaaaaaaccactaatacttgtatatatgagacatgcatatggcttaggagaacattataattcggttacacggttggtaaacatagttactgaaaattgcagctaatttatacaatgttgtacaattatgttttaatacagtgtgctgaactgagtatttctaccaagtgttgggttgttctaaatgctactgaaaaacacaactaccttatatcagttttatggcaaagctactaacaggtgtttttagaaatatgtcagagataaactttaaccagtgtcttcttagtggaattttaaaaatttgttaagttcattgtagagaacaccattcatagaccaagatggtcccctattagctgatattttcatttatgtaagatcctggacattctgttttgtgttggaacaaattttcaatgtttttaattctcccttttctgcctgttcctaaaaactttcaaaataaccatttcaatgtaatttgtcttgaagaagtttacccaatatctttgtcattgcaataatgtagtatggtgatggtcaatttaattattgcttataaaatgaacttgattgcagtaaccatggtatcgatgagactaatgcagtgaagctttattactaatatatatagccttatcaaagcaagctaagaagcttgctttaataattaataatttaaaaatatttatttagatgggattcagttgtttaaagaagtgagataaattcaaaggtaaataggtattctctgtcaaatttaaatctctaaagaattagagattagttttttatttgtgtataatttaaaaaagacctaataggttactgtctttttaatgcatttgttattctttcgtattttttaagcatcggactggagttagtaccatcatctcttgagtctttcataactacacatttttatatttccttttgtgttttctactttgctttccttgaaggaacaagcattttgtggcctttaccttgtgcaattttagggagtagcagtgtaaaaggtccaagaccacatttacttgaaattcttcctcttttctgatttgtcttaccagatatttcccttcttgcctcattctctaggatttgaataaaacctttgccacttattttattagccttattaatgtcacctttccttcaactcaaatatttgagaaattttatgttacatatatgaatgaagttgaaagctactgtttggaagctaagacttgtatagagtagttttgtatatgaatggttgttctagctcagatttcaggttactcacaacagtattctttctaagaggatatatacaaatgtctctcataatttatgtaaggaaatattatgaaaatgagacttttttagtttgatgtgtgtttcccaaactagagataaaactagtaagatttagtatcgtttataacatttgaatttttgctccatgagtacaactaatttttataagtaaatattgggtttatatgaaaaatggggtgtcagtcttttcacacgcccagcaggtaacaatgtgggaagctggcagggtcattgatagcaagtaagtacttcctgaaggctttccagttcaaaagattacaagccattctgcctgccaaacaaattatattctgaagatgcctgttttgtaacccttgatgtgaattttttggtgtctgaaatttacaaaagaatgaaattgaaattgtaaaacactaaatgctttgggtttattttgaagtaatctgttactttaaaatgtcaacattaggaagccataaaacaagatattatgaaacccagtattataaatgttatctacatctaaagtattttaaaataacttattggcagctttattctttttttccttacaagatttagaatctttttggttatatgtctatttttcaattttgttatatttttaatttaagtggccaatgtggttatgaacaagatttgtatggtcagcttctgttctttcctaaaacttcagataaatatcattttagctataacctaaaaaagtgtttaaataaaatgacagatgttaatttaaaagcagcatatgctaatttactttttcatatgatgatggtctaatggaagttacatatgctttcttttgtcctaactctgaaaagtatatgtcagagttctggaatatgtctttagccaagaattttattcacttaaatttgtttacaacttgtataaagcaaaaaagaatgtgtgtaactatagtgaacgcatagttttgcttatattatgtgatgtttgccaaaaaaagaataaaaaatgaatgaattaaatcaaca

SEQ ID NO: 162967 - DNA, 1089 bp, Homo sapiens
  Payload ID: 12114
  Gene Symbol: OTUD6B
  Gene Name: OTU domain containing 6B
  Uniprot ID: Q8N6M0
  ENST ID: ENST00000404789
  CDS Start-End: 22-903
gtgctggggtacctggtcgtcatggaggcggtattgaccgaagagcttgatgaggaagagcagctgctgagaaggcatcgcaaagagaagaaggagttgcaagccaaaattcagggcatgaagaatgctgttcccaagaatgacaagaagaggaggaagcaactcaccgaagatgtggccaagttggaaaaagaaatggaacagaaacatagagaggaactggagcaattgaagctgactactaaggagaataagatagattctgttgctgttaacatttcaaacttggtgcttgagaatcagccacctcggatatcaaaagcacaaaagagacgggaaaagaaagctgcattggaaaaggagcgagaagaacggatagctgaagctgaaattgaaaacttaacaggagccagacatatggaaagtgagaaacttgctcaaatattggcagctagacagttagaaattaaacagattccatctgatggccactgtatgtataaagccattgaagatcaactgaaagaaaaggattgtgctctgactgtggttgccttgagaagtcagaccgctgagtatatgcaaagccatgtggaagactttctgccatttttaacaaaccctaatacaggagatatgtatactccagaagaatttcagaagtactgtgaagatattgtaaacacagctgcatggggaggtcagcttgagctaagagctctgtctcacattttacaaacaccaatagagataatacaggcagattctcctcccattatagttggtgaagaatattcaaaaaaaccactaatacttgtatatatgagacatgcatatggcttaggagaacattataattcggttacacggttggtaaacatagttactgaaaattgcagctaatttatacaatgttgtacaattatgttttaatacagtgtgctgaactgagtatttctaccaagtgttgggttgttctaaatgctactgaaaaacacaactaccttatatcagttttatggcaaagctactaacaggtgtttttagaaatatgtcagagataaactttaaccagtgtcttcttagtgg

SEQ ID NO: 162968 - DNA, 1631 bp, Homo sapiens
  Payload ID: 12114
  Gene Symbol: OTUD6B
  Gene Name: OTU domain containing 6B
  ENST ID: ENST00000522894
  CDS Start-End: 61-387
aaggtgcctactagccggtgcaggtttcttctagcgcgtgtgctggggtacctggtcgtcatggaggcggtattgaccgaagagcttgatgaggaagagcagctgctgagaaggcatcgcaaagagaagaaggagttgcaagccaaaattcagggcatgaagaatgctgttcccaagaatgacaagaagaggaggaagcaactcaccgaagatgtggccaagttggaaaaagaaatggaacagaaacatagagaggaactggagcaattgaagctgactactaaggagaataagatagattctgttgctgttaacatttcaaacttggtgcttgagaatcagccacctcggatatcaaaagcacaaaagagacgggtgcctggatagaaggagctctctgtgttgtccttggtccctgctctgctcttaccagctgtatggcctttggaaatctttctgcgtgctgtttcctcagaagaggaaaatgaggggttttggattagatgatatctaaggaaaagaaagctgcattggaaaaggagcgagaagaacggatagctgaagctgaaattgaaaacttaacaggagccagacatatggaaagtgagaaacttgctcaaatattggcagctagacagttagaaattaaacagattccatctgatggccactgtatgtataaagccattgaagatcaactgaaagaaaaggattgtgctctgactgtggttgccttgagaagtcagaccgctgagtatatgcaaagccatgtggaagactttctgccatttttaacaaaccctaatacaggagatatgtatactccagaagaatttcagaagtactgtgaagatattgtaaacacagctgcatggggaggtcagcttgagctaagagctctgtctcacattttacaaacaccaatagagataatacaggcagattctcctcccattatagttggtgaagaatattcaaaaaaaccactaatacttgtatatatgagacatgcatatggcttaggagaacattataattcggttacacggttggtaaacatagttactgaaaattgcagctaatttatacaatgttgtacaattatgttttaatacagtgtgctgaactgagtatttctaccaagtgttgggttgttctaaatgctactgaaaaacacaactaccttatatcagttttatggcaaagctactaacaggtgtttttagaaatatgtcagagataaactttaaccagtgtcttcttagtggaattttaaaaatttgttaagttcattgtagagaacaccattcatagaccaagatggtcccctattagctgatattttcatttatgtaagatcctggacattctgttttgtgttggaacaaattttcaatgtttttaattctcccttttctgcctgttcctaaaaactttcaaaataaccatttcaatgtaatttgtcttgaagaagtttacccaatatctttgtcattgcaataatgtagtatggtgatggtcaatttaattattgcttataaaatgaacttgattgcagtaaccatggtatcgatgagactaatgcagtgaagctttattactaatatatatagccttatcaaagcaagcta

SEQ ID NO: 162969 - DNA, 3434 bp, Homo sapiens
  Payload ID: 12114
  Gene Symbol: OTUD6B
  Gene Name: OTU domain containing 6B
  Uniprot ID: Q8N6M0
  ENST ID: ENST00000615618
  CDS Start-End: 633-1211
gcgcacgcgcagcaccccatttaagtttctcgtctttgcagtggctttgcttagatccggtgccgccttgaaggcggggctgggtcccagccgtagccaatggagccccgggtgagggttgaggggtggaaggtgcctactagccggtgcaggtttcttctagcgcgtgtgctggggtacctggtcgtcatggaggcggtattgaccgaagagcttgatgaggaagagcagctgctgagaaggcatcgcaaagagaagaaggagttgcaagccaaaattcagggcatgaagaatgctgttcccaagaatgacaagaagaggaggaagcaactcaccgaagatgtggccaagttggaaaaagaaatggaacagaaacatagagaggaactggagcaattgaagctgactactaaggagaataagatagattctgttgctgttaacatttcaaacttggtgcttgagaatcagccacctcggatatcaaaagcacaaaagagacgggtgcctggatagaaggagctctctgtgttgtccttggtccctgctctgctcttaccagctgtatggcctttggaaatctttctgcgtgctgtttcctcagaagaggaaaatgaggggttttggattagatgatatctaaggaaaagaaagctgcattggaaaaggagcgagaagaacggatagctgaagctgaaattgaaaacttaacaggagccagacatatggaaagtgagaaacttgctcaaatattggcagctagacagttagaaattaaacagattccatctgatggccactgtatgtataaagccattgaagatcaactgaaagaaaaggattgtgctctgactgtggttgccttgagaagtcagaccgctgagtatatgcaaagccatgtggaagactttctgccatttttaacaaaccctaatacaggagatatgtatactccagaagaatttcagaagtactgtgaagatattgtaaacacagctgcatggggaggtcagcttgagctaagagctctgtctcacattttacaaacaccaatagagataatacaggcagattctcctcccattatagttggtgaagaatattcaaaaaaaccactaatacttgtatatatgagacatgcatatggcttaggagaacattataattcggttacacggttggtaaacatagttactgaaaattgcagctaatttatacaatgttgtacaattatgttttaatacagtgtgctgaactgagtatttctaccaagtgttgggttgttctaaatgctactgaaaaacacaactaccttatatcagttttatggcaaagctactaacaggtgtttttagaaatatgtcagagataaactttaaccagtgtcttcttagtggaattttaaaaatttgttaagttcattgtagagaacaccattcatagaccaagatggtcccctattagctgatattttcatttatgtaagatcctggacattctgttttgtgttggaacaaattttcaatgtttttaattctcccttttctgcctgttcctaaaaactttcaaaataaccatttcaatgtaatttgtcttgaagaagtttacccaatatctttgtcattgcaataatgtagtatggtgatggtcaatttaattattgcttataaaatgaacttgattgcagtaaccatggtatcgatgagactaatgcagtgaagctttattactaatatatatagccttatcaaagcaagctaagaagcttgctttaataattaataatttaaaaatatttatttagatgggattcagttgtttaaagaagtgagataaattcaaaggtaaataggtattctctgtcaaatttaaatctctaaagaattagagattagttttttatttgtgtataatttaaaaaagacctaataggttactgtctttttaatgcatttgttattctttcgtattttttaagcatcggactggagttagtaccatcatctcttgagtctttcataactacacatttttatatttccttttgtgttttctactttgctttccttgaaggaacaagcattttgtggcctttaccttgtgcaattttagggagtagcagtgtaaaaggtccaagaccacatttacttgaaattcttcctcttttctgatttgtcttaccagatatttcccttcttgcctcattctctaggatttgaataaaacctttgccacttattttattagccttattaatgtcacctttccttcaactcaaatatttgagaaattttatgttacatatatgaatgaagttgaaagctactgtttggaagctaagacttgtatagagtagttttgtatatgaatggttgttctagctcagatttcaggttactcacaacagtattctttctaagaggatatatacaaatgtctctcataatttatgtaaggaaatattatgaaaatgagacttttttagtttgatgtgtgtttcccaaactagagataaaactagtaagatttagtatcgtttataacatttgaatttttgctccatgagtacaactaatttttataagtaaatattgggtttatatgaaaaatggggtgtcagtcttttcacacgcccagcaggtaacaatgtgggaagctggcagggtcattgatagcaagtaagtacttcctgaaggctttccagttcaaaagattacaagccattctgcctgccaaacaaattatattctgaagatgcctgttttgtaacccttgatgtgaattttttggtgtctgaaatttacaaaagaatgaaattgaaattgtaaaacactaaatgctttgggtttattttgaagtaatctgttactttaaaatgtcaacattaggaagccataaaacaagatattatgaaacccagtattataaatgttatctacatctaaagtattttaaaataacttattggcagctttattctttttttccttacaagatttagaatctttttggttatatgtctatttttcaattttgttatatttttaatttaagtggccaatgtggttatgaacaagatttgtatggtcagcttctgttctttcctaaaacttcagataaatatcattttagctataacctaaaaaagtgtttaaataaaatgacagatgttaatttaaaagcagcatatgctaatttactttttcatatgatgatggtctaatggaagttacatatgctttcttttgtcctaactctgaaaagtatatgtcagagttctggaatatgtctttagccaagaattttattcacttaaatttgtttacaacttgtataaagcaaaaaagaatgtgtgtaactatagtgaacgcatagttttgcttatattatgtgatgtttgccaaaaaaagaataaaaaatgaatgaattaaatc

SEQ ID NO: 162970 - DNA, 3294 bp, Homo sapiens
  Payload ID: 12114
  Gene Symbol: OTUD6B
  Gene Name: OTU domain containing 6B
  ENST ID: ENST00000617869
  CDS Start-End: 100-1071
gcgcacgcgcagcaccccatttaagtttctcgtctttgcagtggctttgcttagatccggtgccgccttgaaggcggggctgggtcccagccgtagccaatggagccccgggtgagggttgaggggtggaaggtgcctactagccggtgcaggtttcttctagcgcgtgtgctggggtacctggtcgtcatggaggcggtattgaccgaagagcttgatgaggaagagcagctgctgagaaggcatcgcaaagagaagaaggagttgcaagccaaaattcagggcatgaagaatgctgttcccaagaatgacaagaagaggaggaagcaactcaccgaagatgtggccaagttggaaaaagaaatggaacagaaacatagagaggaactggagcaattgaagctgactactaaggagaataagatagattctgttgctgttaacatttcaaacttggtgcttgagaatcagccacctcggatatcaaaagcacaaaagagacgggaaaagaaagctgcattggaaaaggagcgagaagaacggatagctgaagctgaaattgaaaacttaacaggagccagacatatggaaagtgagaaacttgctcaaatattggcagctagacagttagaaattaaacagattccatctgatggccactgtatgtataaagccattgaagatcaactgaaagaaaaggattgtgctctgactgtggttgccttgagaagtcagaccgctgagtatatgcaaagccatgtggaagactttctgccatttttaacaaaccctaatacaggagatatgtatactccagaagaatttcagaagtactgtgaagatattgtaaacacagctgcatggggaggtcagcttgagctaagagctctgtctcacattttacaaacaccaatagagataatacaggcagattctcctcccattatagttggtgaagaatattcaaaaaaaccactaatacttgtatatatgagacatgcatatggcttaggagaacattataattcggttacacggttggtaaacatagttactgaaaattgcagctaatttatacaatgttgtacaattatgttttaatacagtgtgctgaactgagtatttctaccaagtgttgggttgttctaaatgctactgaaaaacacaactaccttatatcagttttatggcaaagctactaacaggtgtttttagaaatatgtcagagataaactttaaccagtgtcttcttagtggaattttaaaaatttgttaagttcattgtagagaacaccattcatagaccaagatggtcccctattagctgatattttcatttatgtaagatcctggacattctgttttgtgttggaacaaattttcaatgtttttaattctcccttttctgcctgttcctaaaaactttcaaaataaccatttcaatgtaatttgtcttgaagaagtttacccaatatctttgtcattgcaataatgtagtatggtgatggtcaatttaattattgcttataaaatgaacttgattgcagtaaccatggtatcgatgagactaatgcagtgaagctttattactaatatatatagccttatcaaagcaagctaagaagcttgctttaataattaataatttaaaaatatttatttagatgggattcagttgtttaaagaagtgagataaattcaaaggtaaataggtattctctgtcaaatttaaatctctaaagaattagagattagttttttatttgtgtataatttaaaaaagacctaataggttactgtctttttaatgcatttgttattctttcgtattttttaagcatcggactggagttagtaccatcatctcttgagtctttcataactacacatttttatatttccttttgtgttttctactttgctttccttgaaggaacaagcattttgtggcctttaccttgtgcaattttagggagtagcagtgtaaaaggtccaagaccacatttacttgaaattcttcctcttttctgatttgtcttaccagatatttcccttcttgcctcattctctaggatttgaataaaacctttgccacttattttattagccttattaatgtcacctttccttcaactcaaatatttgagaaattttatgttacatatatgaatgaagttgaaagctactgtttggaagctaagacttgtatagagtagttttgtatatgaatggttgttctagctcagatttcaggttactcacaacagtattctttctaagaggatatatacaaatgtctctcataatttatgtaaggaaatattatgaaaatgagacttttttagtttgatgtgtgtttcccaaactagagataaaactagtaagatttagtatcgtttataacatttgaatttttgctccatgagtacaactaatttttataagtaaatattgggtttatatgaaaaatggggtgtcagtcttttcacacgcccagcaggtaacaatgtgggaagctggcagggtcattgatagcaagtaagtacttcctgaaggctttccagttcaaaagattacaagccattctgcctgccaaacaaattatattctgaagatgcctgttttgtaacccttgatgtgaattttttggtgtctgaaatttacaaaagaatgaaattgaaattgtaaaacactaaatgctttgggtttattttgaagtaatctgttactttaaaatgtcaacattaggaagccataaaacaagatattatgaaacccagtattataaatgttatctacatctaaagtattttaaaataacttattggcagctttattctttttttccttacaagatttagaatctttttggttatatgtctatttttcaattttgttatatttttaatttaagtggccaatgtggttatgaacaagatttgtatggtcagcttctgttctttcctaaaacttcagataaatatcattttagctataacctaaaaaagtgtttaaataaaatgacagatgttaatttaaaagcagcatatgctaatttactttttcatatgatgatggtctaatggaagttacatatgctttcttttgtcctaactctgaaaagtatatgtcagagttctggaatatgtctttagccaagaattttattcacttaaatttgtttacaacttgtataaagcaaaaaagaatgtgtgtaactatagtgaacgcatagttttgcttatattatgtgatgtttgccaaaaaaagaataaaaaatgaatgaattaaatc

SEQ ID NO: 162971 - DNA, 2525 bp, Homo sapiens
  Payload ID: 12115
  Gene Symbol: OAF
  Gene Name: out at first homolog
  Uniprot ID: Q86UD1
  ENST ID: ENST00000328965
  CDS Start-End: 514-1335
aaacttctgactccgcctgggtcgctgactccgcgcggccgggcgggagggaggtcgaggaggccgctcgcacaaagccgcggagccgctgccccctctccccgccccctgcccggccaacgccgaagtgcggagagcagccgcgggccctttaagggccgcgaggtgcgcggtctctttaaggcgggtcctggtggtttctgttttctgaaggaagtgacggggggtgggattgaatgaaaagtgcaaaacacaggctcgcagcgctggagcccggggccgcggagccgggccggggcagcgccgtctccgcctcggggccgccgggggcgccctgctgagcgctacccacgtgcgtccgcgccacctcgcgggcgaccccgcggccaaggcccccggcggagcggctcccgggcgccccgaactagcccccaactttgggcgaagtttgcctgcgcctctccccgcccccacgcggcgcgccggggccgcggacggcagcggcccccggggatgcgccttcccggggtacccctggcgcgccctgcgctgctgctgctgctgccgctgctcgcgccgctgctgggaacgggtgcgccggccgagctgcgggtccgcgtgcggctgccggacggccaggtgaccgaggagagcctgcaggcggacagcgacgcggacagcatcagcctcgagctgcgcaagcccgacggcaccctcgtctccttcaccgccgacttcaagaaggatgtgaaggtcttccgggccctgatcctgggggagctggagaaggggcagagtcagttccaggccctctgctttgtcacccagctgcagcacaatgagatcatccccagtgaggccatggccaagctccggcagaaaaatccccgggcagtgcggcaggcggaggaggttcggggtctggagcatctgcacatggatgtcgctgtcaacttcagccagggggccctgctgagcccccatctccacaacgtgtgtgccgaggccgtggatgccatctacacccgccaggaggatgtccggttctggctggagcaaggtgtggacagttctgtgttcgaggctctgcccaaggcctcagagcaggcggagctgcctcgctgcaggcaggtgggggaccacgggaagccctgcgtctgccgctatggcctgagcctggcctggtacccctgcatgctcaagtactgccacagccgcgaccggcccacgccctacaagtgtggcatccgcagctgccagaagagctacagcttcgacttctacgtgccccagaggcagctgtgtctctgggatgaggatccctacccaggctagggtgggagcaacctggcgggtggctgctctgggcccactgctcttcaccagccactagagggggtggcaacccccacctgaggccttatttccctccctccccactcccctggccctagagcctgggcccctctggccccatctcacatgactgtgaagggggtgtggcatggcagggggtctcatgaaggcacccccattcccaccctgtgccttccttgcgggcagagagggagagaagggctccccagatctacacccctccctcctgcatctcccctggagtgttcacttgcaagctgccaaaacatgatggcctctggttgttctgttgaactccttgaacgtttagaccctaaaaggagtctatacctggacacccacctccccagacacaactcccttccccatgcacacatctggaaggagctggcccctcagtcccttcctactccccaacaaggggctcactatccccaaagaaggagctgttggggacccacgacgcagcccctgtactggattacagcatattctcatctctggccccgaggctgcctgtggggcgagtggagacctcccatcactgagacagatcacagaccacgagtgcctttcccggacctggacgttgcctccagagcaggcaccagctctttccctctctacacagaaatatttttgtaaggttctggggcagggagggagcatgaagtacgaggaaaacttgaattccagatttttagtgcaaagtatttatcatttctaccagaaataaacgttttaagtttttacttgactaatgagacccagagtttggagaaaacttttggccaatgctgccacctgatgtcagaaagtgtccccacaccctagcagtggcctatcttggaacaagaacttcgaaagcacctactgtgtgctcagccatttgaggaaggaaggaggagaaggaagatgttactagggaaggatgagataaaacttctgcacccaagacaatgagacagacatagctgcaaccgtagtaagccagtcagaaatagccagcgcgaaggcaagagatggggtggagattggaaccccgcttcagatctgggctcggctacttacctgctgtgcagccatgggtcaagttgcttgacctctctgtgcctccactcccttagctataaaatgagcttacttaa

SEQ ID NO: 162972 - DNA, 815 bp, Homo sapiens
  Payload ID: 12115
  Gene Symbol: OAF
  Gene Name: out at first homolog
  ENST ID: ENST00000531220
  CDS Start-End: 244-717
ctggcgcgccctgcgctgctgctgctgctgccgctgctcgcgccgctgctgggaacgggtgcgccggccgagctgcgggtccgcgtgcggctgccggacggccaggtgaccgaggagagcctgcaggcggacagcgacgcggacagcatcagcctcgagctgcgcaagcccgacggcaccctcgtctccttcaccgccgacttcaagaagctgcagcacaatgagatcatccccagtgaggccatggccaagctccggcagaaaaatccccgggcagtgcggcaggcggaggaggttcggggtctggagcatctgcacatggatgtcgctgtcaacttcagccagggggccctgctgagcccccatctccacaacgtgtgtgccgaggccgtggatgccatctacacccgccaggaggatgtccggttctggctggagcaaggtgtggacagttctgtgttcgaggctctgcccaaggcctcagagcaggcggagctgcctcgctgcaggcaggtgggggaccacgggaagccctgcgtctgccgctatggcctgagcctggcctggtacccctgcatgctcaagtactgccacagccgcgaccggcccacgccctacaagtgtggcatccgcagctgccagaagagctacagcttcgacttctacgtgccccagaggcagctgtgtctctgggatgaggatccctacccaggctagggtgggagcaacctggcgggtggctgctctgggcccactgctcttcaccagccactagagggggtggcaacccccacctgaggccttatttccctccc

SEQ ID NO: 162973 - DNA, 1013 bp, Homo sapiens
  Payload ID: 12116
  Gene Symbol: ODF1
  Gene Name: outer dense fiber of sperm tails 1
  Uniprot ID: Q14990
  ENST ID: ENST00000285402
  CDS Start-End: 157-909
gaaggtggtgaggtcatagaacacaagctttaaagtaagtgaatcatgtgtgcctcatttatttttaaaagcaacttctgagaagggcttagaacaaattttttcccggagtgccatttcccaaaggtactcacagaacaatcaggtgtgaccataatggctgcactgagttgtctcttggacagtgtcagaagggacataaagaaggtggacagagaactaaggcaactgagatgcatcgacgaatttagcacacggtgcctgtgcgacttgtatatgcacccctattgctgctgtgacttgcacccatatccgtactgcttgtgctattccaagcgatcacgctcttgcggcctgtgtgatctctacccatgttgcctgtgtgattataagctttactgtctgcgaccatctctcagaagtttggagaggaaagccatcagagccatagaagatgagaagcgagagcttgccaaactgagaagaacaacaaatagaattctggcttcctcctgctgtagcagtaacattttaggatcggtgaatgtatgcggttttgaacccgatcaagtcaaagttcgagtgaaggatggaaaggtatgtgtgtcggctgagcgggagaacaggtacgactgccttggatcgaaaaagtacagctacatgaacatctgcaaagagttcagcttgccgccctgtgtggatgagaaggatgtaacatactcctatgggctcggcagctgtgtcaagatcgagtctccttgctacccttgcacttctccttgcagcccctgcagcccctgcagcccctgcaacccctgcagcccctgcaacccgtgcagcccatatgatccttgcaacccgtgttatccctgtggaagccgattttcctgtaggaagatgattttgtaaagtgcgcataggaacccattacttaatagaagtcagttactccagccaggcagctctcccaatgtttctcctctccttcccatggcccctgttgttgaagtacg

SEQ ID NO: 162974 - DNA, 368 bp, Homo sapiens
  Payload ID: 12116
  Gene Symbol: ODF1
  Gene Name: outer dense fiber of sperm tails 1
  ENST ID: ENST00000518835
  CDS Start-End: 104-235
acaacaaatagaattctggcttcctcctgctgtagcagtaacattttaggatcggtgaatgtatgcggttttgaacccgatcaagtcaaagttcgagtgaaggatggaaagcccctgcagcccctgcagcccctgcaacccctgcagcccctgcaacccgtgcagcccatatgatccttgcaacccgtgttatccctgtggaagccgattttcctgtaggaagatgattttgtaaagtgcgcataggaacccattacttaatagaagtcagttactccagccaggcagctctcccaatgtttctcctctccttcccatggcccctgttgttgaagtacgtaggaaactgaatacataactgcaatctg

SEQ ID NO: 162975 - DNA, 3899 bp, Homo sapiens
  Payload ID: 12117
  Gene Symbol: ODF2
  Gene Name: outer dense fiber of sperm tails 2
  Uniprot ID: Q5BJF6
  ENST ID: ENST00000351030
  CDS Start-End: 388-2862
tggcggggcggggcatctctgtgacgctaggggctgggcctcgatggcgaaacccaagcggctcccgggggggtttgaactggccaatgggcgagctgccgaccgggtgtcggaaaaggaggcggaagcggggaggagccgctgccagagccagactgcatccgccgcggcgtctccatggcacgaccctggcctccgacttcaacgacttcataaggcggcgtttctgggcgcagccgtgtcgctcctggtttccatcgtgtgggaagaacggagtaacgagtctcacgcagaaaaaggtcttgagagcaccttgtggcgcacccagtgtaactgtgacgatcaaccatttttgtgttgtcctcccccacctgccagaagccaaccatgaaggaccgctcttcaactccccccttacatgttcacgtggatgagaacacccctgtccacgtccacataaaaaaactcccgaaaccatcagcgaccagcagccagaaatctcacaagcgaggaatgaaaggggacactgtgaatgtgcggcggagtgtccgggtgaaaaccaaggtaccttggatgccccctggaaaatcatctgcccggcctgtgggatgcaagtgggagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacagagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccggatcgaacaccagggggacaagctggagatggcgagagagaaacatcaggcttcccagaaggaaaataaacagctgagtctgaaggtggatgaactggagaggaaactggaggcgaccagtgcccagaatatcgagttcctacaggtgattgccaagagggaggaggcaatccaccagtcccagctgcggctggaggagaaaacacgggaatgtgggaccctggcaaggcagttggagagtgccattgaagatgcgaggaggcaggtggaacaaaccaaggagcacgcactctccaaggagcgagcagcccagaacaaaatcctggaccttgagacccagctgagcagaaccaaaacggaattgagccagctgcggcggagccgtgatgatgcggaccgccgctaccagagccggctgcaagacctgaaagatcgcctggagcagtccgagagcaccaaccgcagcatgcagaactacgtccagttcctcaaatcatcatacgccaacgtgtttggggatggtccctattccaccttcctgactagctctcccatccgctcccgatctcctcctgcctgaggccacttatcagggcctggagccctgatggaagccataggaactccagagttgccaagccatagctgagaagcctggtggttttcctctcccagtgaaaaaatgggttcagggtcttgtccttagctactagctctagaaaagtcccaaaagcagcagaaggtgaagcaggaagcacttggttttctccttcctgatatagtcacctgttggaagtgttaaaatttcctcgacaggccttaaatttactactacattagggtaccacattttaacttaccatgactttgctccttcctttcctgagaaaatatttccactggattttttccaccagtccccttacagccctcattgttttaggaatctctctcaggttttttctgacctaaaccagcaggaagtcgtcctgggctgtaagcaccatcacttgctttttttttttttctgatttcacaagtgtggtgttttcccaaggctcccttcccaagctcagtgcaaacctctcactcccaagtttctttgaggccacttgcccccaagcacttcacaatagaccctcgagggcttgtgtccatttggccttttacaagtgtaatgccaatttcattgatttttgtttcttttggcctgatttgtatctctggaatgcatttattcttgaaatatttgtgtgattttacaaaaagcttttgtaatcagttatttaaggctccatttgatgatttcctttacccaaccagtcctcatccctcctctaaaaaatgattaagtaaaatgctgcaggacagccagtagacatttttaaagtacttggtgcctgaaacatcaggcttctcatttcattttagctcaggttggtgctttcacattgtaatcaatgaactgtcaggagggaacaaactgtaagaaggattgcttggtgttttagggtagatcactttagctattaggaagaggatggggtagtgtacagtatatatttttaaaatgtgaattggtttctgaataagaatctgggccatttttgttcacca

SEQ ID NO: 162976 - DNA, 2375 bp, Homo sapiens
  Payload ID: 12117
  Gene Symbol: ODF2
  Gene Name: outer dense fiber of sperm tails 2
  Uniprot ID: Q5BJF6
  ENST ID: ENST00000372791
  CDS Start-End: 354-2270
cccttctcctaggagacagttgtccggccccgccccagcatccccgcggctccctgcgcggttctggccctctggggcccacttggggccgagcggttctcacccgccctctccgcacgtccgccggcgcctcaggtttcccccggacagttgctgtgcgacttggacagtagaggagcgcctcccaagttttcatccaactgccaaccccaaagcttccacccttctcccctcagagaggacgtttgatgccgggccccttgagaggctcattgacaagcctgcccctctgggtccccctgagcagagcctgctgacccaattgcccacctttgcggctttgatgcctagccatgtctgcctcatcctcaggcggctcccccaggtttccatcgtgtgggaagaacggagtaacgagtctcacgcagaaaaaggtcttgagagcaccttgtggcgcacccagtgtaactgtgacgaaatctcacaagcgaggaatgaaaggggacactgtgaatgtgcggcggagtgtccgggtgaaaaccaagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacagagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccgggtaagggactggcagaaagggtcccacgaactgacccgagcaggggcccgcataccaagatgagctgcacgccccccaagggaggactacttcctttttcttggctgctgctttttaaaaggagtgagctatcatcagtgctgtgaaataaaagtctggtgtgccaaa

SEQ ID NO: 162977 - DNA, 2475 bp, Homo sapiens
  Payload ID: 12117
  Gene Symbol: ODF2
  Gene Name: outer dense fiber of sperm tails 2
  Uniprot ID: Q5BJF6
  ENST ID: ENST00000372807
  CDS Start-End: 1-2475
atgaaggaccgctcttcaactccccccttacatgttcacgtggatgagaacacccctgtccacgtccacataaaaaaactcccgaaaccatcagcgaccagcagccagaaatctcacaagcgaggaatgaaaggggacactgtgaatgtgcggcggagtgtccgggtgaaaaccaaggtaccttggatgccccctggaaaatcatctgcccggcctgtgggatgcaagtgggagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacagagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccggatcgaacaccagggggacaagctggagatggcgagagagaaacatcaggcttcccagaaggaaaataaacagctgagtctgaaggtggatgaactggagaggaaactggaggcgaccagtgcccagaatatcgagttcctacaggtgattgccaagagggaggaggcaatccaccagtcccagctgcggctggaggagaaaacacgggaatgtgggaccctggcaaggcagttggagagtgccattgaagatgcgaggaggcaggtggaacaaaccaaggagcacgcactctccaaggagcgagcagcccagaacaaaatcctggaccttgagacccagctgagcagaaccaaaacggaattgagccagctgcggcggagccgtgatgatgcggaccgccgctaccagagccggctgcaagacctgaaagatcgcctggagcagtccgagagcaccaaccgcagcatgcagaactacgtccagttcctcaaatcatcatacgccaacgtgtttggggatggtccctattccaccttcctgactagctctcccatccgctcccgatctcctcctgcctga

SEQ ID NO: 162978 - DNA, 2249 bp, Homo sapiens
  Payload ID: 12117
  Gene Symbol: ODF2
  Gene Name: outer dense fiber of sperm tails 2
  Uniprot ID: Q5BJF6
  ENST ID: ENST00000372814
  CDS Start-End: 36-2141
acccaagcggctcccgggggggtttgaactggccaatgggcgagctgccgaccgggtgtcggaaaaggaggcggaagcggggaggagccgctgccagagccagactgcatccgccgcggcgtctccatggcacgaccctggcctccgacttcaacgacttcataaggcggcgtttctgggcgcagccgtgtcgctcctggtttccatcgtgtgggaagaacggagtaacgagtctcacgcagaaaaaggtcttgagagcaccttgtggcgcacccagtgtaactgtgacgaaatctcacaagcgaggaatgaaaggggacactgtgaatgtgcggcggagtgtccgggtgaaaaccaaggtaccttggatgccccctggaaaatcatctgcccggcctgtgggatgcaagtgggagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacagagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccgggtaagggactggcagaaagggtcccacgaactgacccgagcaggggcccgcataccaagatgagctgcacgccccccaagggaggactacttcctttttcttggctgctgctttttaaaaggagtgagctatcatcagtgctgtgaaataaaagtctggtgtgccaaatgc

SEQ ID NO: 162979 - DNA, 3653 bp, Homo sapiens
  Payload ID: 12117
  Gene Symbol: ODF2
  Gene Name: outer dense fiber of sperm tails 2
  Uniprot ID: Q5BJF6
  ENST ID: ENST00000393527
  CDS Start-End: 531-2948
caacgacttcataaggcggcgtttctgggcgcagccgtgtcgctcctggacagttgctgtgcgacttggacagtagaggagcgcctcccaagttttcatccaactgccaaccccaaagcttccacccttctcccctcagagaggacgtttgatgccgggccccttgagaggctcattgacaagcctgcccctctgggtccccctgagcagagcctgctgacccaattgcccacctttgcggctttgatgcctagccatgtctgcctcatcctcaggcggctcccccaggtttccatcgtgtgggaagaacggagtaacgagtctcacgcagaaaaaggtcttgagagcaccttgtggcgcacccagtgtaactgtgacgttgagatcactgtgtagaaggatccgcctgctttccgctgtgcttcactaaatccaaggaggagctgtgcattccagcaggtttagaggagatccagccctaagaaccctggggccggcgtctgggatctgttctggaacggaagccaaccatgaaggaccgctcttcaactccccccttacatgttcacgtggatgagaacacccctgtccacgtccacataaaaaaactcccgaaaccatcagcgaccagcagccagaaatctcacaagcgaggaatgaaaggggacactgtgaatgtgcggcggagtgtccgggtgaaaaccaagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacagagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccggatcgaacaccagggggacaagctggagatggcgagagagaaacatcaggcttcccagaaggaaaataaacagctgagtctgaaggtggatgaactggagaggaaactggaggcgaccagtgcccagaatatcgagttcctacaggtgattgccaagagggaggaggcaatccaccagtcccagctgcggctggaggagaaaacacgggaatgtgggaccctggcaaggcagttggagagtgccattgaagatgcgaggaggcaggtggaacaaaccaaggagcacgcactctccaaggagcgagcagcccagaacaaaatcctggaccttgagacccagctgagcagaaccaaaacggaattgagccagctgcggcggagccgtgatgatgcggaccgccgctaccagagccggctgcaagacctgaaagatcgcctggagcagtccgagagcaccaaccgcagcatgcagaactacgtccagttcctcaaatcatcatacgccaacgtgtttggggatggtccctattccaccttcctgactagctctcccatccgctcccgatctcctcctgcctgaggccacttatcagggcctggagccctgatggaagccataggaactccagagttgccaagccatagctgagaagcctggtggttttcctctcccagtgaaaaaatgggttcagggtcttgtccttagctactagctctagaaaagtcccaaaagcagcagaaggtgaagcaggaagcacttggttttctccttcctgatatagtcacctgttggaagtgttaaaatttcctcgacaggccttaaatttactactacattagggtaccacattttaacttaccatgactttgctccttcctttcctgagaaaatatttccactggattttttccaccagtccccttacagccctcattgttttaggaatctctctcaggttttttctgacctaaaccagcaggaagtcgtcctgggctgtaagcaccatcacttgctttttttttttttctgatttcacaagtgtggtgttttcccaaggctcccttcccaagctcagtgcaaacctctcactcccaagtttctttgaggccacttgcccccaagcacttcacaatagaccctcgagggcttgtgtccatttggccttttacaagtgtaatgccaatttcattgatttttgtttcttttggcctgatttgtatctctggaatgcatttattcttgaaatatttgtgtgattttacaaaaagcttttgtaatcagtta

SEQ ID NO: 162980 - DNA, 2086 bp, Homo sapiens
  Payload ID: 12117
  Gene Symbol: ODF2
  Gene Name: outer dense fiber of sperm tails 2
  Uniprot ID: Q5BJF6
  ENST ID: ENST00000393533
  CDS Start-End: 11-1984
aattgagaagatggcggaccagcaaggacctcatcagaataggtttccatcgtgtgggaagaacggagtaacgagtctcacgcagaaaaaggtcttgagagcaccttgtggcgcacccagtgtaactgtgacgaaatctcacaagcgaggaatgaaaggggacactgtgaatgtgcggcggagtgtccgggtgaaaaccaaggtaccttggatgccccctggaaaatcatctgcccggcctgtgggatgcaagtgggagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacagagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccgggtaagggactggcagaaagggtcccacgaactgacccgagcaggggcccgcataccaagatgagctgcacgccccccaagggaggactacttcctttttcttggctgctgctttttaaaaggagtgagctatcatcagtgctgtgaaataaaagtctggtgtgcc

SEQ ID NO: 162981 - DNA, 2418 bp, Homo sapiens
  Payload ID: 12117
  Gene Symbol: ODF2
  Gene Name: outer dense fiber of sperm tails 2
  Uniprot ID: Q5BJF6
  ENST ID: ENST00000444119
  CDS Start-End: 1-2418
atgaaggaccgctcttcaactccccccttacatgttcacgtggatgagaacacccctgtccacgtccacataaaaaaactcccgaaaccatcagcgaccagcagccagaaatctcacaagcgaggaatgaaaggggacactgtgaatgtgcggcggagtgtccgggtgaaaaccaagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacagagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccggatcgaacaccagggggacaagctggagatggcgagagagaaacatcaggcttcccagaaggaaaataaacagctgagtctgaaggtggatgaactggagaggaaactggaggcgaccagtgcccagaatatcgagttcctacaggtgattgccaagagggaggaggcaatccaccagtcccagctgcggctggaggagaaaacacgggaatgtgggaccctggcaaggcagttggagagtgccattgaagatgcgaggaggcaggtggaacaaaccaaggagcacgcactctccaaggagcgagcagcccagaacaaaatcctggaccttgagacccagctgagcagaaccaaaacggaattgagccagctgcggcggagccgtgatgatgcggaccgccgctaccagagccggctgcaagacctgaaagatcgcctggagcagtccgagagcaccaaccgcagcatgcagaactacgtccagttcctcaaatcatcatacgccaacgtgtttggggatggtccctattccaccttcctgactagctctcccatccgctcccgatctcctcctgcctga

SEQ ID NO: 162982 - DNA, 1254 bp, Homo sapiens
  Payload ID: 12117
  Gene Symbol: ODF2
  Gene Name: outer dense fiber of sperm tails 2
  ENST ID: ENST00000421776
  CDS Start-End: 96-1254
gctaacgggcggtcggccgcctccttcctctcttggctaccacggggctctgcccctcctctgccgcccgcgggcagggcttcacctttctctctatgggcagaaaccggtaccctcctgcctgctggtttccatcgtgtgggaagaacggagtaacgagtctcacgcagaaaaaggtcttgagagcaccttgtggcgcacccagtgtaactgtgacgaaatctcacaagcgaggaatgaaaggggacactgtgaatgtgcggcggagtgtccgggtgaaaaccaaggtaccttggatgccccctggaaaatcatctgcccggcctgtgggatgcaagtgggaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacagagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcct

SEQ ID NO: 162983 - DNA, 2059 bp, Homo sapiens
  Payload ID: 12117
  Gene Symbol: ODF2
  Gene Name: outer dense fiber of sperm tails 2
  Uniprot ID: Q5BJF6
  ENST ID: ENST00000448249
  CDS Start-End: 227-1957
ccgccgcggcgtctccatggcacgaccctggcctccgacttcaacgacttcataaggcggcgtttctgggcgcagccgtgtcgctcctggtttccatcgtgtgggaagaacggagtaacgagtctcacgcagaaaaaggtcttgagagcaccttgtggcgcacccagtgtaactgtgacgatcaaccatttttgtgttgtcctcccccacctgccagaagccaaccatgaaggaccgctcttcaactccccccttacatgttcacgtggatgagaacacccctgtccacgtccacataaaaaaactcccgaaaccatcagcgaccagcagccagaaatctcacaagcgaggaatgaaaggggacactgtgaatgtgcggcggagtgtccgggtgaaaaccaaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacagagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccgggtaagggactggcagaaagggtcccacgaactgacccgagcaggggcccgcataccaagatgagctgcacgccccccaagggaggactacttcctttttcttggctgctgctttttaaaaggagtgagctatcatcagtgctgtgaaataaaagtctggtgtgcc

SEQ ID NO: 162984 - DNA, 3890 bp, Homo sapiens
  Payload ID: 12117
  Gene Symbol: ODF2
  Gene Name: outer dense fiber of sperm tails 2
  Uniprot ID: Q5BJF6
  ENST ID: ENST00000434106
  CDS Start-End: 364-2853
ccaccggcgcggggcctctcctcctcccgctaacgggcggtcggccgcctccttcctctcttggctaccacggggctctgcccctcctctgccgcccgcgggcagggcttcacctttctctctatgggcagaaaccggtaccctcctgcctgctggacagttgctgtgcgacttggacagtagaggagcgcctcccaagttttcatccaactgccaaccccaaagcttccacccttctcccctcagagaggacgtttgatgccgggccccttgagaggctcattgacaagcctgcccctctgggtccccctgagcagagcctgctgacccaattgcccacctttgcggctttgatgcctagccatgtctgcctcatcctcaggcggctcccccaggtttccatcgtgtgggaagaacggagtaacgagtctcacgcagaaaaaggtcttgagagcaccttgtggcgcacccagtgtaactgtgacgaaatctcacaagcgaggaatgaaaggggacactgtgaatgtgcggcggagtgtccgggtgaaaaccaaggtaccttggatgccccctggaaaatcatctgcccggcctgtgggatgcaagtgggagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacagagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccggatcgaacaccagggggacaagctggagatggcgagagagaaacatcaggcttcccagaaggaaaataaacagctgagtctgaaggtggatgaactggagaggaaactggaggcgaccagtgcccagaatatcgagttcctacaggtgattgccaagagggaggaggcaatccaccagtcccagctgcggctggaggagaaaacacgggaatgtgggaccctggcaaggcagttggagagtgccattgaagatgcgaggaggcaggtggaacaaaccaaggagcacgcactctccaaggagcgagcagcccagaacaaaatcctggaccttgagacccagctgagcagaaccaaaacggaattgagccagctgcggcggagccgtgatgatgcggaccgccgctaccagagccggctgcaagacctgaaagatcgcctggagcagtccgagagcaccaaccgcagcatgcagaactacgtccagttcctcaaatcatcatacgccaacgtgtttggggatggtccctattccaccttcctgactagctctcccatccgctcccgatctcctcctgcctgaggccacttatcagggcctggagccctgatggaagccataggaactccagagttgccaagccatagctgagaagcctggtggttttcctctcccagtgaaaaaatgggttcagggtcttgtccttagctactagctctagaaaagtcccaaaagcagcagaaggtgaagcaggaagcacttggttttctccttcctgatatagtcacctgttggaagtgttaaaatttcctcgacaggccttaaatttactactacattagggtaccacattttaacttaccatgactttgctccttcctttcctgagaaaatatttccactggattttttccaccagtccccttacagccctcattgttttaggaatctctctcaggttttttctgacctaaaccagcaggaagtcgtcctgggctgtaagcaccatcacttgctttttttttttttctgatttcacaagtgtggtgttttcccaaggctcccttcccaagctcagtgcaaacctctcactcccaagtttctttgaggccacttgcccccaagcacttcacaatagaccctcgagggcttgtgtccatttggccttttacaagtgtaatgccaatttcattgatttttgtttcttttggcctgatttgtatctctggaatgcatttattcttgaaatatttgtgtgattttacaaaaagcttttgtaatcagttatttaaggctccatttgatgatttcctttacccaaccagtcctcatccctcctctaaaaaatgattaagtaaaatgctgcaggacagccagtagacatttttaaagtacttggtgcctgaaacatcaggcttctcatttcattttagctcaggttggtgctttcacattgtaatcaatgaactgtcaggagggaacaaactgtaagaaggattgcttggtgttttagggtagatcactttagctattaggaagaggatggggtagtgtacagtatatatttttaaaatgtgaattggtttctgaataagaatctgggccatttttgttcacca

SEQ ID NO: 162985 - DNA, 934 bp, Homo sapiens
  Payload ID: 12117
  Gene Symbol: ODF2
  Gene Name: outer dense fiber of sperm tails 2
  ENST ID: ENST00000432065
  CDS Start-End: 320-934
ccgcctccttcctctcttggctaccacggggctctgcccctcctctgccgcccgcgggcagggcttcacctttctctctatgggcagaaaccggtaccctcctgcctgctggacagttgctgtgcgacttggacagtagaggagcgcctcccaagttttcatccaactgccaaccccaaagcttccacccttctcccctcagagaggacgtttgatgccgggccccttgagaggctcattgacaagcctgcccctctgggtccccctgagcagagcctgctgacccaattgcccacctttgcggctttgatgcctagccatgtctgcctcatcctcaggcggctcccccaggtttccatcgtgtgggaagaacggagtaacgagtctcacgcagaaaaaggtcttgagagcaccttgtggcgcacccagtgtaactgtgacgaaatctcacaagcgaggaatgaaaggggacactgtgaatgtgcggcggagtgtccgggtgaaaaccaaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacagagaaacaaatgacctgcacggacatcaacaccctgacaaggcagaaggaacttctcctgcagaagctgagcacatttgaggagaccaaccgcaccctccgagacctcctgagggaacagcactgcaaagag

SEQ ID NO: 162986 - DNA, 822 bp, Homo sapiens
  Payload ID: 12117
  Gene Symbol: ODF2
  Gene Name: outer dense fiber of sperm tails 2
  ENST ID: ENST00000446274
  CDS Start-End: 353-822
gggcctctcctcctcccgctaacgggcggtcggccgcctccttcctctcttggctaccacggggctctgcccctcctctgccgcccgcgggcagggcttcacctttctctctatgggcagaaaccggtaccctcctgcctgctggacagttgctgtgcgacttggacagtagaggagcgcctcccaagttttcatccaactgccaaccccaaagcttccacccttctcccctcagagaggacgtttgatgccgggccccttgagaggctcattgacaagcctgcccctctgggtccccctgagcagagcctgctgacccaattgcccacctttgcggctttgatgcctagccatgtctgcctcatcctcaggcggctcccccaggtttccatcgtgtgggaagaacggagtaacgagtctcacgcagaaaaaggtcttgagagcaccttgtggcgcacccagtgtaactgtgacgaaatctcacaagcgaggaatgaaaggggacactgtgaatgtgcggcggagtgtccgggtgaaaaccaagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtcaagatgcaaaaaggtgagcgccagatggccaaaaggttcctggaggaacggaaggaagagctggaggaggtggcccacgaactggctgagactgagcacgagaa

SEQ ID NO: 162987 - DNA, 2140 bp, Homo sapiens
  Payload ID: 12117
  Gene Symbol: ODF2
  Gene Name: outer dense fiber of sperm tails 2
  Uniprot ID: Q5BJF6
  ENST ID: ENST00000546203
  CDS Start-End: 122-2038
accggcgcggggcctctcctcctcccgctaacgggcggtcggccgcctccttcctctcttggctaccacggggctctgcccctcctctgccgcccgcgggcagggcttcacctttctctctatgggcagaaaccggtaccctcctgcctgctggtttccatcgtgtgggaagaacggagtaacgagtctcacgcagaaaaaggtcttgagagcaccttgtggcgcacccagtgtaactgtgacgaaatctcacaagcgaggaatgaaaggggacactgtgaatgtgcggcggagtgtccgggtgaaaaccaagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacagagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccgggtaagggactggcagaaagggtcccacgaactgacccgagcaggggcccgcataccaagatgagctgcacgccccccaagggaggactacttcctttttcttggctgctgctttttaaaaggagtgagctatcatcagtgctgtgaaataaaagtctggtgtgcc

SEQ ID NO: 162988 - DNA, 3030 bp, Homo sapiens
  Payload ID: 12117
  Gene Symbol: ODF2
  Gene Name: outer dense fiber of sperm tails 2
  Uniprot ID: Q5BJF6
  ENST ID: ENST00000604420
  CDS Start-End: 313-2802
agagccagactgcatccgccgcggcgtctccatggcacgaccctggcctccgacttcaacgacttcataaggcggcgtttctgggcgcagccgtgtcgctcctggacagttgctgtgcgacttggacagtagaggagcgcctcccaagttttcatccaactgccaaccccaaagcttccacccttctcccctcagagaggacgtttgatgccgggccccttgagaggctcattgacaagcctgcccctctgggtccccctgagcagagcctgctgacccaattgcccacctttgcggctttgatgcctagccatgtctgcctcatcctcaggcggctcccccaggtttccatcgtgtgggaagaacggagtaacgagtctcacgcagaaaaaggtcttgagagcaccttgtggcgcacccagtgtaactgtgacgaaatctcacaagcgaggaatgaaaggggacactgtgaatgtgcggcggagtgtccgggtgaaaaccaaggtaccttggatgccccctggaaaatcatctgcccggcctgtgggatgcaagtgggagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacagagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccggatcgaacaccagggggacaagctggagatggcgagagagaaacatcaggcttcccagaaggaaaataaacagctgagtctgaaggtggatgaactggagaggaaactggaggcgaccagtgcccagaatatcgagttcctacaggtgattgccaagagggaggaggcaatccaccagtcccagctgcggctggaggagaaaacacgggaatgtgggaccctggcaaggcagttggagagtgccattgaagatgcgaggaggcaggtggaacaaaccaaggagcacgcactctccaaggagcgagcagcccagaacaaaatcctggaccttgagacccagctgagcagaaccaaaacggaattgagccagctgcggcggagccgtgatgatgcggaccgccgctaccagagccggctgcaagacctgaaagatcgcctggagcagtccgagagcaccaaccgcagcatgcagaactacgtccagttcctcaaatcatcatacgccaacgtgtttggggatggtccctattccaccttcctgactagctctcccatccgctcccgatctcctcctgcctgaggccacttatcagggcctggagccctgatggaagccataggaactccagagttgccaagccatagctgagaagcctggtggttttcctctcccagtgaaaaaatgggttcagggtcttgtccttagctactagctctagaaaagtcccaaaagcagcagaaggtgaagcaggaagcacttggttttctccttcctgatatagtcacctgttggaagtgttaaaatttc

SEQ ID NO: 162989 - DNA, 723 bp, Homo sapiens
  Payload ID: 12117
  Gene Symbol: ODF2
  Gene Name: outer dense fiber of sperm tails 2
  ENST ID: ENST00000483070
  CDS Start-End: 1-723
gagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccggatcgaacaccagggggacaagctggagatggcgagagagaaacatcaggcttcccagaaggaaaataaacagctgagtctgaaggtggatgaactggagaggttagaggcacttggtcccatctctgtcctcttcctaggacctgagactttcagccacttagctgttttttgcttagtgtgcggaagtgttgagggactcgaggccctggaaggtactaggcagacctcagaggaaaagctgcttccatttcagtggaaactggaggcgaccagtgcccagaatatcgagttcctacaggtgattgccaagagggaggaggcaatccaccagtcccagctgcggctggaggagaaaacacgggaatgtgggaccctggcaaggcagttggagagtgccattgaagatgcgaggaggcaggtggaacaaaccaaggagcacgcactctccaaggagcgagcagcccagaacaaaatcctggaccttgagacccagctgagcagaaccaaaacggaattgagccagctgcggcggagccgtgatgatgcggac

SEQ ID NO: 162990 - DNA, 578 bp, Homo sapiens
  Payload ID: 12117
  Gene Symbol: ODF2
  Gene Name: outer dense fiber of sperm tails 2
  ENST ID: ENST00000497812
  CDS Start-End: 147-578
taattgagaagatggcggaccagcaaggacctcatcagaataggtctgtacacagagcggcatagagagtgcaggagggtagtagaccgggcgcggaggctcaagcctgtaatacaagcactttggaaggccgaggcgggtggatcatgaggtttccatcgtgtgggaagaacggagtaacgagtctcacgcagaaaaaggtcttgagagcaccttgtggcgcacccagtgtaactgtgacgaaatctcacaagcgaggaatgaaaggggacactgtgaatgtgcggcggagtgtccgggtgaaaaccaaggtaccttggatgccccctggaaaatcatctgcccggcctgtgggatgcaagtgggagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtcaagatgcaaaaaggtgagcgccagatggccaaaagg

SEQ ID NO: 162991 - DNA, 588 bp, Homo sapiens
  Payload ID: 12117
  Gene Symbol: ODF2
  Gene Name: outer dense fiber of sperm tails 2
  ENST ID: ENST00000470061
  CDS Start-End: 288-588
gccctctggggcccacttggggccgagcggttctcacccgccctctccgcacgtccgccggcgcctcaggtttcccccggacagttgctgtgcgacttggacagtagaggagcgcctcccaagttttcatccaactgccaaccccaaagcttccacccttctcccctcagagaggacgtttgatgccgggccccttgagaggctcattgacaagcctgcccctctgggtccccctgagcagagcctgctgacccaattgcccacctttgcggctttgatgcctagccatgtctgcctcatcctcaggcggctcccccaggtttccatcgtgtgggaagaacggagtaacgagtctcacgcagaaaaaggtcttgagagcaccttgtggcgcacccagtgtaactgtgacgaaatctcacaagcgaggaatgaaaggggacactgtgaatgtgcggcggagtgtccgggtgaaaaccaaggtaccttggatgccccctggaaaatcatctgcccggcctgtgggatgcaagtgggagaatccacctcattgcctggagatcacgccaccatcttcagaaaagctggtct

SEQ ID NO: 162992 - DNA, 4267 bp, Homo sapiens
  Payload ID: 12118
  Gene Symbol: ODF2L
  Gene Name: outer dense fiber of sperm tails 2-like
  Uniprot ID: Q9ULJ1
  ENST ID: ENST00000294678
  CDS Start-End: 308-2170
tgagcgggcactcttctgcggcaagcaggtctaggaattcgcctggttcccacctcgcgtcccttgccttccttcctagtctacccactgtagtgccccctgcgtcccgctccctcctagccgactcagagcacaagaaggattgccacggtttccattgcagcagccgtggcgcctctgaccctttttttatatcgcggcgacggcgggctgtcgtcacgacgacgtgcggacgcagcggcgggggcctttcagcttatgtggagaagtcgctgtgaagccacctataaatccatttactgaatttatggagaaggctgtaaatgatggaagtcattcagaagaactcttttgccatcttaaaactatatcagagaaagaagatttaccacggtgtaccagtgaaagtcatctcagctgcctgaagcaggacattctaaatgaaaagactgaattggaagcaacacttaaggaagcggagttggtaactcattctgtagaattgcttttgccactatttaaggacaccattgaaaagattaattttgaaaatgcgaatctttctgcattgaatttgaagatttctgaacagaaggaaatattaataaaagaattagacaccttcaaaagtgtaaaactagctttagaacatcttcttagaaagagagactacaaacaaacaggagacaatttatccagcatgttgctagaaaatctaactgataatgaaagtgaaaatactaatcttaagaagaaggtatttgaaaaggaggcccatatccaagaactttcttgtttgtttcagagtgaaaaggcaaatactttgaaagcaaaccgtttttcccaatcagtaaaagtagtacatgaacgactacagatccaaattcataaaagggaagccgagaacgataagttgaaagaatatgtaaagagcttagaaaccaagatagccaagtggaacctgcaatcaagaatgaataagaatgaggctatagtgatgaaagaagcaagtaggcaaaaaactgtagctttaaaaaaggcatctaaagtttacaaacaaaggcttgaccattttacaggagctattgaaaagcttacttcccaaattagagatcaggaagccaagttgtctgaaacaatttcagcttccaatgcctggaaaagtcattatgagaaaattgtgatagaaaaaaccgaattggaagtacagattgaaacaatgaaaaagcaaatcattaatcttttggaagatctgaagaaaatggaagaccatggaaaaaattcatgtgaagaaattcttagaaaagttcactcaattgaatatgaaaatgaaactctgaatcttgagaatacaaaattaaagactacacttgctgctttgaaggatgaagttgtatctgttgaaaatgaactctcagaattgcaagaagtagaaaaaaaacagaaaacccttattgaaatgtataaaactcaggtacaaaagttgcaagaagcagctgaaatagtaaaaagcagatgtgaaaatttgctacataaaaataaccaaataacaaaaaccaaaaataaaaatgtagagaagatgagaggccagatggagtctcatctgaaggagttagagcgtgtctgcgattccttgacggcggcggaacggaggcttcacgagtgtcaggagagtctgcagtgctgcaaggggaagtgtgcagaccaggaacacaccattagggagcttcagggccagattttgaagcagtgggaagaatattctgtcttggcatgggttgatggaaatcacaatcttctgacaaagctttctctggaagaggaaaactgtcttattcagctgaagtgtgaaaaccttcaacaaaaattagaacagatggacgcagaaaataaagagcttgagaagaagctggcaaaccaagaagaatgtcttaagcacagcaatcttaagtttaaagagaaatctgcagagtatacagcattggccagacaactggaagctgctttagaagaaggaagacaaaaggttgctgaagaaatagagaaaatgtcatctagagagagtgctttacaaattaaaatattagatctggaaactgagcttagaaagaaaaatgaagaacaaaatcaacttgtttgcaaaatgaacagtgatccagagactccatgaaatctatttttttaattcccaagtgtctaaaaagttgaaaacctaaaagattcaagagttaaatgatttttggcatgcacaatttgattttattgccatcaaaagtttcatgacaacttagtcagaacaaaacgtcgatcacctttaatttagcacaggccttccatttatttctaaacttttttttaactcaccatttgactttctgatattgtaaaatgtgtgtgctgtttttttgtgtaattgaagcctctgaaaaaataaatgaggtgggttttgctgtaatgtccctagtacttggctaaagctagtaaaataaatagatcccattcacaattgccacaaagagaataaaatacctaggaatccaaattacaaggaatgtgaaggacctcttcaaggagaactacaaaccactgcttaaggaaataagagaggacacaaacaaatggaaaacattccatgcttatgaataagatgaaacaagatcatgaaaatggctatactccccaaagtaatttatagattcagtgctatccccatcaagctaccattgactttcttcacagaattagaaaaaactacttcaaatttcatatggaaccaaaaaagagctcacataaccaagacaatcctaagcaaaaagaacaaagctgtaggcatcacgctacctgacttcaaactatactacaaggctacagtaaccaaaatagcatggtactggtgccaaaacagatatatagaccaatggaacagaacagaggcctcagaaataactccacacatctacaaccatctgctgtttgacatacctgagaaaaacaagaaatggggaaaggattccctatttaataaatggtgttgggaaaactggctagccatatgcagaaaactgaaactggatcccttccttacaccttatacaaaaattaactcaagatggattaaagacttaagtgtaagacctaaaaccataaaaaccctagaggaaaacctaggcaataccattcaggacataggcatggacgaatacttcatgactaaaacaccaaaagtaatggcaataaaagccaagattgacaaatgggatctaattaaactaaagagcttctgcacagcaaaagaaactatcatcagagtgaacaggaaccgacagaatgggagaaaatttttgcaatctatccatctgacaaagggccaatatccagaatctacaaagaacttaaacaaatttacaagaaaaaaaaccccatcaaaaagtgtgcaaagaatatgaacagacacttctcaagagaagacatttagtcagccaaaaaacatatgaaaaaaagctcatcactggtcattcagagaaatgcaaatcaaaactacagtgagataccatgtcacaccaattagaatggtgatcattaaaaagacaggaaacaacagatgctggagaggatgtggagaaataggatgcttttacactgttggtgggagtgtaaattagttcaaccactgcggaagacagtgtggcgattcctcaaggatctagaaccagaaataccatttgacccagcaatcccattactgggtatatacccaaaggactataaatcatgctgctatagagacacatgcacacgtatatttattgtggcactattcacaatagcaaagacttggagccaacccaaatgcccatcaatgatagactgaataaagaaaatgtggcacatacaccatggaatactatgcagccataaaaaaggatgagttcatgtcctttgcagggacatggatgaagctggaaaccatcattctcagcaaactaacacaagaacagaaaaccaaacaccgcatgttctcactcataagtgggagttgaacaatgagaatacatggatacagggcagggaacatcacacaccagggcctgtcagggcgtggggggctaggggagggataacattagaaattcctaatgtagatgacgggttgatgagtgcagcaaaccaccatggcacgtgtatacctatgtaaccaacctgtacgttctgtacatgtatcccagaacttaaagtataataaaaattaaaaaaaataaagatctga

SEQ ID NO: 162993 - DNA, 4376 bp, Homo sapiens
  Payload ID: 12118
  Gene Symbol: ODF2L
  Gene Name: outer dense fiber of sperm tails 2-like
  Uniprot ID: Q9ULJ1
  ENST ID: ENST00000317336
  CDS Start-End: 370-2280
gggtggggccgccgttgccagagaagccactagccggttactagctgcgcttttgttccacttgagcgggcactcttctgcggcaagcaggtctaggaattcgcctggttcccacctcgcgtcccttgccttccttcctagtctacccactgtagtgccccctgcgtcccgctccctcctagccgactcagagcacaagaaggattgccacggtttccattgcagcagccgtggcgcctctgaccctttttttatatcgcggcgacggcgggctgtcgtcacgacgacgtgcggacgcagcggcgggggcctttcagcttatgtggagaagtcgctgtgaagccacctataaatccatttactgaatttatggagaaggctgtaaatgatggaagtcattcagaagaactcttttgccatcttaaaactatatcagagaaagaagatttaccacggtgtaccagtgaaagtcatctcagctgcctgaagcaggacattctaaatgaaaagactgaattggaagcaacacttaaggaagcggagttggtaactcattctgtagaattgcttttgccactatttaaggacaccattgaaaagattaattttgaaaatgcgaatctttctgcattgaatttgaagatttctgaacagaaggaaatattaataaaagaattagacaccttcaaaagtgtaaaactagctttagaacatcttcttagaaagagagactacaaacaaacaggagacaatttatccagcatgttgctagaaaatctaactgataatgaaagtgaaaatactaatcttaagaagaaggtatttgaaaaggaggcccatatccaagaactttcttgtttgtttcagagtgaaaaggcaaatactttgaaagcaaaccgtttttcccaatcagtaaaagtagtacatgaacgactacagatccaaattcataaaagggaagccgagaacgataagttgaaagaatatgtaaagagcttagaaaccaagatagccaagtggaacctgcaatcaagaatgaataagaatgaggctatagtgatgaaagaagcaagtaggcaaaaaactgtagctttaaaaaaggcatctaaagtttacaaacaaaggcttgaccattttacaggagctattgaaaagcttacttcccaaattagagatcaggaagccaagttgtctgaaacaatttcagcttccaatgcctggaaaagtcattatgagaaaattgtgatagaaaaaaccgaattggaagtacagattgaaacaatgaaaaagcaaatcattaatcttttggaagatctgaagaaaatggaagaccatggaaaaaattcatgtgaagaaattcttagaaaagttcactcaattgaatatgaaaatgaaactctgaatcttgagaatacaaaattaaagcttagattcccatgtagaattactgagtcaaagaatatgaacattttgattgttcttgatatgctttgctacatttcttctgaaaagactacacttgctgctttgaaggatgaagttgtatctgttgaaaatgaactctcagaattgcaagaagtagaaaaaaaacagaaaacccttattgaaatgtataaaactcaggtacaaaagttgcaagaagcagctgaaatagtaaaaagcagatgtgaaaatttgctacataaaaataaccaaataacaaaaaccaaaaataaaaatgtagagaagatgagaggccagatggagtctcatctgaaggagttagagcgtgtctgcgattccttgacggcggcggaacggaggcttcacgagtgtcaggagagtctgcagtgctgcaaggggaagtgtgcagaccaggaacacaccattagggagcttcagggccaggttgatggaaatcacaatcttctgacaaagctttctctggaagaggaaaactgtcttattcagctgaagtgtgaaaaccttcaacaaaaattagaacagatggacgcagaaaataaagagcttgagaagaagctggcaaaccaagaagaatgtcttaagcacagcaatcttaagtttaaagagaaatctgcagagtatacagcattggccagacaactggaagctgctttagaagaaggaagacaaaaggttgctgaagaaatagagaaaatgtcatctagagagagtgctttacaaattaaaatattagatctggaaactgagcttagaaagaaaaatgaagaacaaaatcaacttgtttgcaaaatgaacagtgatccagagactccatgaaatctatttttttaattcccaagtgtctaaaaagttgaaaacctaaaagattcaagagttaaatgatttttggcatgcacaatttgattttattgccatcaaaagtttcatgacaacttagtcagaacaaaacgtcgatcacctttaatttagcacaggccttccatttatttctaaacttttttttaactcaccatttgactttctgatattgtaaaatgtgtgtgctgtttttttgtgtaattgaagcctctgaaaaaataaatgaggtgggttttgctgtaatgtccctagtacttggctaaagctagtaaaataaatagatcccattcacaattgccacaaagagaataaaatacctaggaatccaaattacaaggaatgtgaaggacctcttcaaggagaactacaaaccactgcttaaggaaataagagaggacacaaacaaatggaaaacattccatgcttatgaataagatgaaacaagatcatgaaaatggctatactccccaaagtaatttatagattcagtgctatccccatcaagctaccattgactttcttcacagaattagaaaaaactacttcaaatttcatatggaaccaaaaaagagctcacataaccaagacaatcctaagcaaaaagaacaaagctgtaggcatcacgctacctgacttcaaactatactacaaggctacagtaaccaaaatagcatggtactggtgccaaaacagatatatagaccaatggaacagaacagaggcctcagaaataactccacacatctacaaccatctgctgtttgacatacctgagaaaaacaagaaatggggaaaggattccctatttaataaatggtgttgggaaaactggctagccatatgcagaaaactgaaactggatcccttccttacaccttatacaaaaattaactcaagatggattaaagacttaagtgtaagacctaaaaccataaaaaccctagaggaaaacctaggcaataccattcaggacataggcatggacgaatacttcatgactaaaacaccaaaagtaatggcaataaaagccaagattgacaaatgggatctaattaaactaaagagcttctgcacagcaaaagaaactatcatcagagtgaacaggaaccgacagaatgggagaaaatttttgcaatctatccatctgacaaagggccaatatccagaatctacaaagaacttaaacaaatttacaagaaaaaaaaccccatcaaaaagtgtgcaaagaatatgaacagacacttctcaagagaagacatttagtcagccaaaaaacatatgaaaaaaagctcatcactggtcattcagagaaatgcaaatcaaaactacagtgagataccatgtcacaccaattagaatggtgatcattaaaaagacaggaaacaacagatgctggagaggatgtggagaaataggatgcttttacactgttggtgggagtgtaaattagttcaaccactgcggaagacagtgtggcgattcctcaaggatctagaaccagaaataccatttgacccagcaatcccattactgggtatatacccaaaggactataaatcatgctgctatagagacacatgcacacgtatatttattgtggcactattcacaatagcaaagacttggagccaacccaaatgcccatcaatgatagactgaataaagaaaatgtggcacatacaccatggaatactatgcagccataaaaaaggatgagttcatgtcctttgcagggacatggatgaagctggaaaccatcattctcagcaaactaacacaagaacagaaaaccaaacaccgcatgttctcactcataagtgggagttgaacaatgagaatacatggatacagggcagggaacatcacacaccagggcctgtcagggcgtggggggctaggggagggataacattagaaattcctaatgtagatgacgggttgatgagtgcagcaaaccaccatggcacgtgtatacctatgtaaccaacctgtacgttctgtacatgtatcccagaacttaaagtataataaaaattaaaaaaaataaagatctg

SEQ ID NO: 162994 - DNA, 2155 bp, Homo sapiens
  Payload ID: 12118
  Gene Symbol: ODF2L
  Gene Name: outer dense fiber of sperm tails 2-like
  Uniprot ID: Q9ULJ1
  ENST ID: ENST00000370566
  CDS Start-End: 368-2143
gtggggccgccgttgccagagaagccactagccggttactagctgcgcttttgttccacttgagcgggcactcttctgcggcaagcaggtctaggaattcgcctggttcccacctcgcgtcccttgccttccttcctagtctacccactgtagtgccccctgcgtcccgctccctcctagccgactcagagcacaagaaggattgccacggtttccattgcagcagccgtggcgcctctgaccctttttttatatcgcggcgacggcgggctgtcgtcacgacgacgtgcggacgcagcggcgggggcctttcagcttatgtggagaagtcgctgtgaagccacctataaatccatttactgaatttatggagaaggctgtaaatgatggaagtcattcagaagaactcttttgccatcttaaaactatatcagagaaagaagatttaccacggtgtaccagtgaaagtcatctcagctgcctgaagcaggacattctaaatgaaaagactgaattggaagcaacacttaaggaagcggagttggtaactcattctgtagaattgcttttgccactatttaaggacaccattgaaaagattaattttgaaaatgcgaatctttctgcattgaatttgaagatttctgaacagaaggaaatattaataaaagaattagacaccttcaaaagtgtaaaactagctttagaacatcttcttagaaagagagactacaaacaaacaggagacaatttatccagcatgttgctagaaaatctaactgataatgaaagtgaaaatactaatcttaagaagaaggtatttgaaaaggaggcccatatccaagaactttcttgtttgtttcagagtgaaaaggcaaatactttgaaagcaaaccgtttttcccaatcagtaaaagtagtacatgaacgactacagatccaaattcataaaagggaagccgagaacgataagttgaaagaatatgtaaagagcttagaaaccaagatagccaagtggaacctgcaatcaagaatgaataagaatgaggctatagtgatgaaagaagcaagtaggcaaaaaactgtagctttaaaaaaggcatctaaagtttacaaacaaaggcttgaccattttacaggagctattgaaaagcttacttcccaaattagagatcaggaagccaagttgtctgaaacaatttcagcttccaatgcctggaaaagtcattatgagaaaattgtgatagaaaaaaccgaattggaagtacagattgaaacaatgaaaaagcaaatcattaatcttttggaagatctgaagaaaatggaagaccatggaaaaaattcatgtgaagaaattcttagaaaagttcactcaattgaatatgaaaatgaaactctgaatcttgagaatacaaaattaaagactacacttgctgctttgaaggatgaagttgtatctgttgaaaatgaactctcagaattgcaagaagtagaaaaaaaacagaaaacccttattgaaatgtataaaactcaggtacaaaagttgcaagaagcagctgaaatagtaaaaagcagatgtgaaaatttgctacataaaaataaccaaataacaaaaaccaaaaataaaaatgtagagaaggttgatggaaatcacaatcttctgacaaagctttctctggaagaggaaaactgtcttattcagctgaagtgtgaaaaccttcaacaaaaattagaacagatggacgcagaaaataaagagcttgagaagaagctggcaaaccaagaagaatgtcttaagcacagcaatcttaagtttaaagagaaatctgcagagtatacagcattggccagacaactggaagctgctttagaagaaggaagacaaaaggttgctgaagaaatagagaaaatgtcatctagagagagtgctttacaaattaaaatattagatctggaaactgagcttagaaagaaaaatgaagaacaaaatcaacttgtttgcaaaatgaacagtaaagcacaacatcaggaagtgtgtttgaaagaagtacaaaatagtcttgagaagtcggaaaatcaaaatgagagtattaagaattatttacagtttcttaaaacttcttatgtaacaatgtttgaataaattgtcaaattt

SEQ ID NO: 162995 - DNA, 7560 bp, Homo sapiens
  Payload ID: 12118
  Gene Symbol: ODF2L
  Gene Name: outer dense fiber of sperm tails 2-like
  Uniprot ID: Q9ULJ1
  ENST ID: ENST00000359242
  CDS Start-End: 283-2193
cggcaagcaggtctaggaattcgcctggttcccacctcgcgtcccttgccttccttcctagtctacccactgtagtgccccctgcgtcccgctccctcctagccgactcagagcacaagaaggattgccacggtttccattgcagcagccgtggcgcctctgaccctttttttatatcgcggcgacggcgggctgtcgtcacgacgacgtgcggacgcagcggcgggggccttatgtggagaagtcgctgtgaagccacctataaatccatttactgaatttatggagaaggctgtaaatgatggaagtcattcagaagaactcttttgccatcttaaaactatatcagagaaagaagatttaccacggtgtaccagtgaaagtcatctcagctgcctgaagcaggacattctaaatgaaaagactgaattggaagcaacacttaaggaagcggagttggtaactcattctgtagaattgcttttgccactatttaaggacaccattgaaaagattaattttgaaaatgcgaatctttctgcattgaatttgaagatttctgaacagaaggaaatattaataaaagaattagacaccttcaaaagtgtaaaactagctttagaacatcttcttagaaagagagactacaaacaaacaggagacaatttatccagcatgttgctagaaaatctaactgataatgaaagtgaaaatactaatcttaagaagaaggtatttgaaaaggaggcccatatccaagaactttcttgtttgtttcagagtgaaaaggcaaatactttgaaagcaaaccgtttttcccaatcagtaaaagtagtacatgaacgactacagatccaaattcataaaagggaagccgagaacgataagttgaaagaatatgtaaagagcttagaaaccaagatagccaagtggaacctgcaatcaagaatgaataagaatgaggctatagtgatgaaagaagcaagtaggcaaaaaactgtagctttaaaaaaggcatctaaagtttacaaacaaaggcttgaccattttacaggagctattgaaaagcttacttcccaaattagagatcaggaagccaagttgtctgaaacaatttcagcttccaatgcctggaaaagtcattatgagaaaattgtgatagaaaaaaccgaattggaagtacagattgaaacaatgaaaaagcaaatcattaatcttttggaagatctgaagaaaatggaagaccatggaaaaaattcatgtgaagaaattcttagaaaagttcactcaattgaatatgaaaatgaaactctgaatcttgagaatacaaaattaaagcttagattcccatgtagaattactgagtcaaagaatatgaacattttgattgttcttgatatgctttgctacatttcttctgaaaagactacacttgctgctttgaaggatgaagttgtatctgttgaaaatgaactctcagaattgcaagaagtagaaaaaaaacagaaaacccttattgaaatgtataaaactcaggtacaaaagttgcaagaagcagctgaaatagtaaaaagcagatgtgaaaatttgctacataaaaataaccaaataacaaaaaccaaaaataaaaatgtagagaagatgagaggccagatggagtctcatctgaaggagttagagcgtgtctgcgattccttgacggcggcggaacggaggcttcacgagtgtcaggagagtctgcagtgctgcaaggggaagtgtgcagaccaggaacacaccattagggagcttcagggccaggttgatggaaatcacaatcttctgacaaagctttctctggaagaggaaaactgtcttattcagctgaagtgtgaaaaccttcaacaaaaattagaacagatggacgcagaaaataaagagcttgagaagaagctggcaaaccaagaagaatgtcttaagcacagcaatcttaagtttaaagagaaatctgcagagtatacagcattggccagacaactggaagctgctttagaagaaggaagacaaaaggttgctgaagaaatagagaaaatgtcatctagagagagtgctttacaaattaaaatattagatctggaaactgagcttagaaagaaaaatgaagaacaaaatcaacttgtttgcaaaatgaacagtgatccagagactccatgaaatctatttttttaattcccaagtgtctaaaaagttgaaaacctaaaagattcaagagttaaatgatttttggcatgcacaatttgattttattgccatcaaaagtttcatgacaacttagtcagaacaaaacgtcgatcacctttaatttagcacaggccttccatttatttctaaacttttttttaactcaccatttgactttctgatattgtaaaatgtgtgtgctgtttttttgtgtaattgaagcctctgaaaaaataaatgaggtgggttttgctgtaatgtccctagtacttggctaaagctagtaaaataaatagatcccattcacaattgccacaaagagaataaaatacctaggaatccaaattacaaggaatgtgaaggacctcttcaaggagaactacaaaccactgcttaaggaaataagagaggacacaaacaaatggaaaacattccatgcttatgaataagatgaaacaagatcatgaaaatggctatactccccaaagtaatttatagattcagtgctatccccatcaagctaccattgactttcttcacagaattagaaaaaactacttcaaatttcatatggaaccaaaaaagagctcacataaccaagacaatcctaagcaaaaagaacaaagctgtaggcatcacgctacctgacttcaaactatactacaaggctacagtaaccaaaatagcatggtactggtgccaaaacagatatatagaccaatggaacagaacagaggcctcagaaataactccacacatctacaaccatctgctgtttgacatacctgagaaaaacaagaaatggggaaaggattccctatttaataaatggtgttgggaaaactggctagccatatgcagaaaactgaaactggatcccttccttacaccttatacaaaaattaactcaagatggattaaagacttaagtgtaagacctaaaaccataaaaaccctagaggaaaacctaggcaataccattcaggacataggcatggacgaatacttcatgactaaaacaccaaaagtaatggcaataaaagccaagattgacaaatgggatctaattaaactaaagagcttctgcacagcaaaagaaactatcatcagagtgaacaggaaccgacagaatgggagaaaatttttgcaatctatccatctgacaaagggccaatatccagaatctacaaagaacttaaacaaatttacaagaaaaaaaaccccatcaaaaagtgtgcaaagaatatgaacagacacttctcaagagaagacatttagtcagccaaaaaacatatgaaaaaaagctcatcactggtcattcagagaaatgcaaatcaaaactacagtgagataccatgtcacaccaattagaatggtgatcattaaaaagacaggaaacaacagatgctggagaggatgtggagaaataggatgcttttacactgttggtgggagtgtaaattagttcaaccactgcggaagacagtgtggcgattcctcaaggatctagaaccagaaataccatttgacccagcaatcccattactgggtatatacccaaaggactataaatcatgctgctatagagacacatgcacacgtatatttattgtggcactattcacaatagcaaagacttggagccaacccaaatgcccatcaatgatagactgaataaagaaaatgtggcacatacaccatggaatactatgcagccataaaaaaggatgagttcatgtcctttgcagggacatggatgaagctggaaaccatcattctcagcaaactaacacaagaacagaaaaccaaacaccgcatgttctcactcataagtgggagttgaacaatgagaatacatggatacagggcagggaacatcacacaccagggcctgtcagggcgtggggggctaggggagggataacattagaaattcctaatgtagatgacgggttgatgagtgcagcaaaccaccatggcacgtgtatacctatgtaaccaacctgtacgttctgtacatgtatcccagaacttaaagtataataaaaattaaaaaaaataaagatctgatgttttgttaaacctgataagttttgtactagtaaaattctagaattctaagcatagatttaaacattgctgaaaaatgagtttgtgtgttttatgccttccaggggacagttaagtgggcagtatttatttaatatacctgcttcagccccatttgaattgtaagcactctgaaagcatgtctcatagtcgtctgtatccctggtgtctcccacagtgccctgcttacctgcaggcctttttgtattttctgtccaagtaccctaatagggtggtgcagaatggatgtacagatctgtggatgacctcagcagcttaatccaaggcacccctcgggaagcctgaaatgtctttgaagtcttatgtattatcctaaaatccattgacattttatattctaccctacaaaataagtatgtgttactatttttctttccaaattgttgagtaaaactcattgtattcatcctgtgactttgtactgcccagcctagctcattgttttttacctgcctcatttcctgagctgggcattgctcagtttcagaaggtatcaggtgtcattgaacacctgatatgaaggatgtaaaagttctctcttttctatctaggtgtctatattttaattggaggctagatgatatttgcaacctgtctttatctaaagcattgtcagtgaactcacctacttaggaattcatatgcaccttagttaaaaaaaatgtattgtggttttaaattttttcctcaaccagtgtaatatgaagaattctttttattttttaagagattctaagaaaatgttcacattatcaaaactagaattctatcaacttttaagacatttaattattttggaataaaatgtgaatttttagacagaaaatggcaaaaactagtatgaaaatatatcatgttacatgtgaaattatgacagttgttaacctattaagttaatcatgttaaatatgtaataatttggggctaaatgaatgtatattataaattatatcagtgaagatcaaccatgtgtgtgctttaattattaattttaaagagtgagctctaagaatgaacacatcagatgtgagtattattttaaaaaatcaaaaagaattatctagttattgtatatatgtttttaatattatgactctggtcctttggaatgaatgctattattgcttatctgtatttttttccttttttctttagaaagcacaacatcaggaagtgtgtttgaaagaagtacaaaatagtcttgagaagtcggaaaatcaaaatgagagtattaagaattatttacagtttcttaaaacttcttatgtaacaatgtttgaataaattgtcaaatttattttctctaagtagtagatttttattatgagtctaaaatgtgattgggtaaaaaaataaatatactaccagttacattttatgatttatgagtggtagtattagaggtttttatgtaaagatttttgaaacataatttatctaactgaaactttaaaataggatagttgttactattcctgtttgctggataattcttatttatctttggtttaatttcttttaaaattaaattggttgttagaatatttttctcacacatagacatggaagtcagattcattctttgtgatgtttgtagccaccattcaagtgaatttgtagtaagtcttggtcaatatgattttaaataatatatataattgttttatattatgatatataaatgtaaaatattctgaattttaatttttaataatggtgtaattacatactttctaaagctactaaatgtctcaatatactacacttaatattgtttcaagtatatgctgagttgccattataatttctgttaggttttaagtatacaattttaaatcatcgctattaagtaccaactgctaatgacagatgaaaacgtggtcatgcattatttctttataaagaatagatattcaggctgtcttcaatttgtactctcttttattcgttttatactaatgattatctgatattattattattttagacattctagagccccttagttaaataaaagattaaaggggaacagcttatcccaccctttccatggccaactcatggggatgatcaaaataagcactcttaacatcaagaagctttaaaataaggtctttagtattgggataaagttgtccaagttgaaaaagaacttgtttgctataatctcccactgtgtgtgccaaggcaggatactctaaaaggggatgacgtggtttacaaaggatcaagtaatagtgactcctcttggacaatgacttgagagctgttaattcagaggaacactcaggtcttaaaagatcactaaaaaaggcaggttgtgaactacacagttccagcctatgaacagaaatatctctttaagatgttttatgctttttttctgatcagagatgggggcctggtcccctctgatcccctcacttttaagactgtcatatcattcacagatgcttactttctagtgatccagttggttcgtagtatttttcttaaaatagcaaaatacagagtgtcagaactggccacattttttacccaacaattgctaacaagattagtgtcattttaaaaaaaatcttagtactcatcatactaaaaacatgcttgacccttgcagccctttctttacctcctaatgcaaagggagccttaaatgcccacatgaaaggaaagcaaagctcttgagttttactcactaaactgtaagctccttaagggccgaaatgtatcttagtcatataaatatctgggcactcagttgatgtttgtggatagatggacagatgttgaaagaggcaggtattcgtactcctgttttagatatgaaaaatgtaagcaaaaaggattaattaccatggctgtggtatgaaacttgtttaaagttggcatttaaattcaagtctgcaacattaaagttctgtgtacagagccgttttcccactgtagcagcagcgcagcagcagcgctgctatgattgattaagcacttgctatgtgccagagttaataattgtgataatatattaactcatttaattttcaggaaactaagacatggaaaggttaggtaacttgcccaaggtcgcacagctagtaagtggcagacatccagagtctctgctctgctcttaactctcaccatactacctctgtatccatttcataaataaagatagtagtttcttataacagtaatgcatttgtctta

SEQ ID NO: 162996 - DNA, 648 bp, Homo sapiens
  Payload ID: 12118
  Gene Symbol: ODF2L
  Gene Name: outer dense fiber of sperm tails 2-like
  ENST ID: ENST00000394733
  CDS Start-End: 502-648
ggtctaggaattcgcctggttcccacctcgcgtcccttgccttccttcctagtctacccactgtagtgccccctgcgtcccgctccctcctagccgactcagagcacaagaaggattgccacggtttccattgcagcagccgtggcgcctctgaccctttttttatatcgcggcgacggcgggctgtcgtcacgacgacgtgcggacgcagcggcgggggccctgaagcaggacattctaaatgaaaagactgaattggaagcaacacttaaggaagcggagttggtaactcattctgtagaattgcttttgccactatttaaggacaccattgaaaagattaattttgaaaatgcgaatctttctgcattgaatttgaagatttctgaacagaaggaaatattaataaaagaattagacaccttcaaaagtgtaaaactagctttagaacatcttcttagaaagagagactacaaacaaacaggagacaatttatccagcatgttgctagaaaatctaactgataatgaaagtgaaaatactaatcttaagaagaaggtatttgaaaaggaggcccatatccaagaactttcttgtttgtttcagagtgaaaaggcaaatactttgaaagcaaaccgtttttcccaa

SEQ ID NO: 162997 - DNA, 534 bp, Homo sapiens
  Payload ID: 12118
  Gene Symbol: ODF2L
  Gene Name: outer dense fiber of sperm tails 2-like
  ENST ID: ENST00000531412
  CDS Start-End: 1-164
cggcggcggaacggaggcttcacgagtgtcaggagagtctgcagtgctgcaaggggaagtgtgcagaccaggaacacaccattagggagcttcagggccagaatatggatcatgtagcagattttgaagcagtgggaagaatattctgtcttggcatgggttgatggaaatcacaatcttctgacaaagctttctctggaagaggaaaactgtcttattcagctgaagtgtgaaaaccttcaacaaaaattagaacagatggacgcagaaaataaagagcttgagaagaagctggcaaaccaagaagaatgtcttaagcacagcaatcttaagtttaaagagaaatctgcagagtatacagcattggccagacaactggaagctgctttagaagaaggaagacaaaaggttgctgaagaaatagagaaaatgtcatctagagagagtgctttacaaattaaaatattagatctggaaactgagcttagaaagaaaaatgaagaacaaaatcaacttgtttgcaaaatgaacagt

SEQ ID NO: 162998 - DNA, 311 bp, Homo sapiens
  Payload ID: 12118
  Gene Symbol: ODF2L
  Gene Name: outer dense fiber of sperm tails 2-like
  ENST ID: ENST00000486215
  CDS Start-End: 93-275
gcgtttaccgcgggagcccttagcggtctggagctttcagcttatgtggagaagtcgctgtgaagccacctataaatccatttactgaatttatggagaaggctgtaaatgatggaagtcattcagaagaactcttttgccatcttaaaactatatcagagaaagaagatttaccacggtgtaccagtgaaagtcatctcagctggtattctcatcagtatcaggggaaatctaaatttccgattctaggatttcctgttttgtctataatataaattatttgaatcaaatacagcattcttttaagagta

SEQ ID NO: 162999 - DNA, 1002 bp, Homo sapiens
  Payload ID: 12118
  Gene Symbol: ODF2L
  Gene Name: outer dense fiber of sperm tails 2-like
  ENST ID: ENST00000479890
  CDS Start-End: 273-1002
acttgagcgggcactcttctgcggcaagcaggtctaggaattcgcctggttcccacctcgcgtcccttgccttccttcctagtctacccactgtagtgccccctgcgtcccgctccctcctagccgactcagagcacaagaaggattgccacggtttccattgcagcagccgtggcgcctctgaccctttttttatatcgcggcgacggcgggctgtcgtcacgacgacgtgcggacgcagcggcgggggcacaggagacaatttatccagcatgttgctagaaaatctaactgataatgaaagtgaaaatactaatcttaagaagaaggtatttgaaaaggaggcccatatccaagaactttcttgtttgtttcagagtgaaaagagcttagaaaccaagatagccaagtggaacctgcaatcaagaatgaataagaatgaggctatagtgatgaaagaagcaagtaggcaaaaaactgtagctttaaaaaaggcatctaaagtttacaaacaaaggcttgaccattttacaggagctattgaaaagcttacttcccaaattagagatcaggaagccaagttgtctgaaacaatttcagcttccaatgcctggaaaagtcattatgagaaaattgtgatagaaaaaaccgaattggaagtacagattgaaacaatgaaaaagcaaatcattaatcttttggaagatctgaagaaaatggaagaccatggaaaaaattcatgtgaagaaattcttagaaaagttcactcaattgaatatgaaaatgaaactctgaatcttgagaatacaaaattaaagactacacttgctgctttgaaggatgaagttgtatctgttgaaaatgaactctcagaattgcaagaagtagaaaaaaaacagaaaacccttattgaaatgtataaaactcaggtacaaaagttgcaagaagcagctgaaatagtaaaaagcagatgtgaaaatttgctacataaaaataaccaaa

SEQ ID NO: 163000 - DNA, 1576 bp, Homo sapiens
  Payload ID: 12118
  Gene Symbol: ODF2L
  Gene Name: outer dense fiber of sperm tails 2-like
  ENST ID: ENST00000460698
  CDS Start-End: 1-1563
acaggagacaatttatccagcatgttgctagaaaatctaactgataatgaaagtgaaaatactaatcttaagaagaaggtatttgaaaaggaggcccatatccaagaactttcttgtttgtttcagagtgaaaaggcaaatactttgaaagcaaaccgtttttcccaatcagtaaaagtagtacatgaacgactacagatccaaattcataaaagggaagccgagaacgataagttgaaagaatatgtaaagagcttagaaaccaagatagccaagtggaacctgcaatcaagaatgaataagaatgaggctatagtgatgaaagaagcaagtaggcaaaaaactgtagctttaaaaaaggcatctaaagtttacaaacaaaggcttgaccattttacaggagctattgaaaagcttacttcccaaattagagatcaggaagccaagttgtctgaaacaatttcagcttccaatgcctggaaaagtcattatgagaaaattgtgatagaaaaaaccgaattggaagtacagattgaaacaatgaaaaagcaaatcattaatcttttggaagatctgaagaaaatggaagaccatggaaaaaattcatgtgaagaaattcttagaaaagttcactcaattgaatatgaaaatgaaactctgaatcttgagaatacaaaattaaagactacacttgctgctttgaaggatgaagttgtatctgttgaaaatgaactctcagaattgcaagaagtagaaaaaaaacagaaaacccttattgaaatgtataaaactcaggtacaaaagttgcaagaagcagctgaaatagtaaaaagcagatgtgaaaatttgctacataaaaataaccaaataacaaaaaccaaaaataaaaatgtagagaagatgagaggccagatggagtctcatctgaaggagttagagcgtgtctgcgattccttgacggcggcggaacggaggcttcacgagtgtcaggagagtctgcagtgctgcaaggggaagtgtgcagaccaggaacacaccattagggagcttcagggccaggttgatggaaatcacaatcttctgacaaagctttctctggaagaggaaaactgtcttattcagctgaagtgtgaaaaccttcaacaaaaattagaacagatggacgcagaaaataaagagcttgagaagaagctggcaaaccaagaagaatgtcttaagcacagcaatcttaagtttaaagagaaatctgcagagtatacagcattggccagacaactggaagctgctttagaagaaggaagacaaaaggttgctgaagaaatagagaaaatgtcatctagagagagtgctttacaaattaaaatattagatctggaaactgagcttagaaagaaaaatgaagaacaaaatcaacttgtttgcaaaatgaacagtaaagcacaacatcaggaagtgtgtttgaaagaagtacaaaatagtcttgagaagtcggaaaatcaaaatgagagtattaagaattatttacagtttcttaaaacttcttatgtaacaatgtttgaataaattgtcaaattta

SEQ ID NO: 163001 - DNA, 1422 bp, Homo sapiens
  Payload ID: 12118
  Gene Symbol: ODF2L
  Gene Name: outer dense fiber of sperm tails 2-like
  ENST ID: ENST00000488879
  CDS Start-End: 314-445
tccacttgagcgggcactcttctgcggcaagcaggtctaggaattcgcctggttcccacctcgcgtcccttgccttccttcctagtctacccactgtagtgccccctgcgtcccgctccctcctagccgactcagagcacaagaaggattgccacggtttccattgcagcagccgtggcgcctctgaccctttttttatatcgcggcgacggcgggctgtcgtcacgacgacgtgcggacgcagcggcgggggcctttcagcttatgtggagaagtcgctgtgaagccacctataaatccatttactgaatttatggagaaggctgtaaatgatggaagtcattcagaagaactcttttgccatcttaaaactatatcagagaaagaagatttaccacggtgtaccagtgaaagtcatctcagctggcgaatctttctgcattgaatttgaagatttctgaacagaaggaaatattaataaaagaattagacaccttcaaaagtgtaaaactagctttagaacatcttcttagaaagagagactacaaacaaacaggagacaatttatccagcatgttgctagaaaatctaactgataatgaaagtgaaaatactaatcttaagaagaaggtatttgaaaaggaggcccatatccaagaactttcttgtttgtttcagagtgaaaaggcaaatactttgaaagcaaaccgtttttcccaatcagtaaaagtagtacatgaacgactacagatccaaattcataaaagggaagccgagaacgataagttgaaagaatatgtaaagagcttagaaaccaagatagccaagtggaacctgcaatcaagaatgaataagaatgaggctatagtgatgaaagaagcaagtaggcaaaaaactgtagctttaaaaaaggcatctaaagtttacaaacaaaggcttgaccattttacaggagctattgaaaagcttacttcccaaattagagatcaggaagccaagttgtctgaaacaatttcagcttccaatgcctggaaaagtcattatgagaaaattgtgatagaaaaaaccgaattggaagtacagattgaaacaatgaaaaagcaaatcattaatcttttggaagatctgaagaaaatggaagaccatggaaaaaattcatgtgaagaaattcttagaaaagttcactcaattgaatatgaaaatgaaactctgaatcttgagaatacaaaattaaagactacacttgctgctttgaaggatgaagttgtatctgttgaaaatgaactctcagaattgcaagaagtagaaaaaaaacagaaaacccttattgaaatgtataaaactcaggtacaaaagttgcaagaagcagctgaaatagtaaaaagcagatgtgaaaatttgctacataaaaataaccaaata

SEQ ID NO: 163002 - DNA, 461 bp, Homo sapiens
  Payload ID: 12118
  Gene Symbol: ODF2L
  Gene Name: outer dense fiber of sperm tails 2-like
  ENST ID: ENST00000462648
  CDS Start-End: 1-461
attttgaagcagtgggaagaatattctgtcttggcatgggttgatggaaatcacaatcttctgacaaagctttctctggaagaggaaaactgtcttattcagctgaagtgtgaaaaccttcaacaaaaattagaacagatggacgcagaaaataaagagcttgagaagaagctggcaaaccaagaagaatgtcttaagcacagcaatcttaagtttaaagagaaatctgcagagtatacagcattggccagacaactggaagctgctttagaagaaggaagacaaaaggttgctgaagaaatagagaaaatgtcatctagagagagtgctttacaaattaaaatattagatctggaaactgagcttagaaagaaaaatgaagaacaaaatcaacttgtttgcaaaatgaacagtaaagcacaacatcaggaagtgtgtttgaaagaagtacaaaatagtct

SEQ ID NO: 163003 - DNA, 1650 bp, Homo sapiens
  Payload ID: 12118
  Gene Symbol: ODF2L
  Gene Name: outer dense fiber of sperm tails 2-like
  ENST ID: ENST00000478286
  CDS Start-End: 351-533
agagaagccactagccggttactagctgcgcttttgttccacttgagcgggcactcttctgcggcaagcaggtctaggaattcgcctggttcccacctcgcgtcccttgccttccttcctagtctacccactgtagtgccccctgcgtcccgctccctcctagccgactcagagcacaagaaggattgccacggtttccattgcagcagccgtggcgcctctgaccctttttttatatcgcggcgacggcgggctgtcgtcacgacgacgtgcggacgcagcggcgggggcctttcagcttatgtggagaagtcgctgtgaagccacctataaatccatttactgaatttatggagaaggctgtaaatgatggaagtcattcagaagaactcttttgccatcttaaaactatatcagagaaagaagatttaccacggtgtaccagtgaaagtcatctcagctggtattctcatcagtatcaggggaaatctaaatttccgattctaggatttcctgttttgtctataatataaattatttgaatcaaatacagcattcttttaagagtatcttttccaaatctagtatttatttattaaaatatatttaatctgattacaagtgtactcatctagcagaattcaactagtttttttgaatcttaatgaaagcaattaaaaatgaaaacctggccgggcgcaatggatcatgcctgtaatcccagcactttgggaggatgaggcaggtggatcacttgaggtcaggagttcaagatcagcctggccaacatggtgaaaccccatctctactgaaaaaatgcaaaaattagccagatgtggtagcgtgtgcctgttgtcccagctacttggaaggctgtggtagaagaatcacttgaacctgggaggcgaaggtcacagtgagccgagataatgccactgcactcctgggtgacagagcctgggtgacagagcgagactccatctcaaaaaagaaaaagacaaaaaaaatgaaaacctcatctgttaagaatttgtaaaataaagctatttaagataaatgaaaatataatatgtgatatcagaaatgtagttaatgaatgtgaaatcactgtcatttggtatattactatatagcaaatacttgtcatacttctttagagtggggaatacacttgttatttacatgaaatattgccccccgtcaaatggcaatcttagtatataccattactgtcagtatggatagcttagtccagcttctggttgaatttgttatgaatgaaaataatattttatcatctataatcacacttgactttctgcccatggtttttaataagggacaggtgtcgtttatagatagaatgttcttaggctcattactttaagccagttgtgcttaagaacacacagatttttgacatagcctctaagatgccatcagttgttaatgagccgttatgttttacaaagaaagagaaaagctgccaattaaagagtttccatatcacttggaattttatttataaatattgaaaatgctccttcaaacttaactatacgtacatctttaatccaaataacttttgtgattacgtacaagtaaaatataagtaaaataaagtattcttaaaatttgcttacactcaaa

SEQ ID NO: 163004 - DNA, 1307 bp, Homo sapiens
  Payload ID: 12119
  Gene Symbol: ODF3
  Gene Name: outer dense fiber of sperm tails 3
  Uniprot ID: Q96PU9
  ENST ID: ENST00000325113
  CDS Start-End: 318-1082
attctagagtttagagtgggggacctctccccaattctgtaagcccatgaggagagaggaaggcctttctctccatgctccttttgcgggaactccctggcaccaaggccaggggggaaaggacagtctctgatgaggatgggtctctaggctgctctgagtgctgtccctgcactgaagaagttatagttccctcccaggcggccccctccctgcccctcagctcagcctcaatcaagaagttccccatctttgaccactccaagtaggagaaaccggcccagggctcccttagagccgagaacagtgagctggccatgacggaggaggtatggatgggtacctggaggccccatcgcccccggggacccatcatggccctctacagcagccctggacccaagtacctgattccaccaacaacaggcttcatgaagcacacgcccaccaagctgcgtgcaccggcctacagcttccgtggggcccccatgctcctggcagagaactgctccccagggccccgttacaatgtaaaccccaagatactgaggactggcaaggaccttggccctgcctactccatcctggggcgctaccaaaccaagaccatgctgactcctggtccaggtgactactttccagagaaatccaccaagtacgtgttcgactcagcacccagccactccatctctgcccggacaaaggcattccgagtggacagcaccccaggccccgctgcgtacatgctgcccatggtaatggggcccaataccgtcggcaaggcctcccagccctccttttccatcaagggccgcagcaagctgggcggcttcagcgacgacctacacaagaccccaggtcccgcagcctaccgccaaactgatgtgcgggtgaccaagttcaaggctccgcagtacaccatggctgcccgtgtggagcccccaggggacaagaccctcaagccaggaccaggcgcccacagccctgagaaggtgaccctgaccaagccctgcgccccagttgtcaccttcggcatcaaacactctgattacatgactcccctgctggttgatgtggaataacgccagccctgctgtgccccatcacacccggcatctacacaagatccgccgggccacagagctcgaggctgtcttcaccagctgggctgggccagcctggccctgcagggcagagcacgcttgtttgggcaattgtaatcagttactttttttctatgctattttaccattttttaatcttgttttctgctgtgcccaaattattaataaatcagattgcattaa

SEQ ID NO: 163005 - DNA, 386 bp, Homo sapiens
  Payload ID: 12119
  Gene Symbol: ODF3
  Gene Name: outer dense fiber of sperm tails 3
  ENST ID: ENST00000342593
  CDS Start-End: 3-386
ccatgacggaggaggtatggatgggtacctggaggccccatcgcccccggggacccatcatggccctctacagcagccctggacccaagtacctgattccaccaacaacaggcttcatgaagcacacgcccaccaagctgcgtgcaccggcctacagcttccgtggggcccccatgctcctggcagagaactgctccccagggccccgttacaataccgtcggcaaggcctcccagccctccttttccatcaagggccgcagcaagctgggcggcttcagcgacgacctacacaaggtgaccctgaccaagccctgcgccccagttgtcaccttcggcatcaaacactctgattacatgactcccctgctggttgatgtggaataa

SEQ ID NO: 163006 - DNA, 764 bp, Homo sapiens
  Payload ID: 12119
  Gene Symbol: ODF3
  Gene Name: outer dense fiber of sperm tails 3
  Uniprot ID: Q96PU9
  ENST ID: ENST00000525282
  CDS Start-End: 103-726
cccctcagctcagcctcaatcaagaagttccccatctttgaccactccaagtaggagaaaccggcccagggctcccttagagccgagaacagtgagctggccatgacggaggaggtatggatgggtacctggaggccccatcgcccccggggacccatcatggccctctacagcagccctggacccaagtacctgattccaccaacaacaggcttcatgaagcacacgcccaccaagctgcgtgcaccggcctacagcttccgtggggcccccatgctcctggcagagaactgctccccagggccccgttacaatgtaaaccccaagatactgaggactggcaaggaccttggccctgcctactccatcctggggcgctaccaaaccaagaccatgctgactcctggtccaggtgactactttccagagaaatccaccaagtacgtgttcgactcagcacccagccactccatctctgcccggacaaaggcattccgagtggacagcaccccaggccccgctgcgtacatgctgcccatggtaatggggcccaataccgtcggcaaggcctcccagccctccttttccatcaagggccgcagcaagctgggcggcttcagcgacgacctacacaaggtgaccctgaccaagccctgcgccccagttgtcaccttcggcatcaaacactctgattacatgactcccctgctggttgatgtggaataacgccagccctgctgtgccccatcacacccggcatctac

SEQ ID NO: 163007 - DNA, 970 bp, Homo sapiens
  Payload ID: 12120
  Gene Symbol: ODF3B
  Gene Name: outer dense fiber of sperm tails 3B
  Uniprot ID: A8MYP8
  ENST ID: ENST00000329363
  CDS Start-End: 138-899
gaagcgggaaagggccacaatggggtctgggaggtgggcggggcggagcggggatgtccagccacgtcgctttgttttcccacgctaggagctaccacaacaggtgctgcgagccgtaagcgccccccacccgcgctatgggctcggacgcctgggtgggcctttggcggccacaccggccccgcggccccatcgcggcgcactacggaggccccgggcccaaatacaagctgccgcccaacaccggctacgccctgcatgacccgtcgcggccgcgcgcccccgccttcaccttcggcgcgcgcttccccacgcagcagacgacgtgcggccccgggccaggccacctggtgcccgctcgcatgaccgtgcgcggcaccgacggcgcccccgcctactccatctacggccgcccacgccgctcagcgcccttcctcactccgggacctggcaggtacttcccggagcgagcggggaacgcgacgtaccccagtgcgcctcggcacaccattgctccccgaaactggggtgtccaggcggaacagcagagcccaggtcccgcggcctatacggtgccctcgctcttgggtccgcgcgtcatcggcaaagtctccgccccaacttgctccatctacggccgcagagcggctggcagtttcttcgaggacctcagcaagaccccgggcccctgcgcctatcaggtcgtgagtccaggggtctacaagtcccgggccccccagttcacgattctggcgcggacttcgctcccccaagacaacactcggaagccagggcccgcggcctacaacgtggatcagcaccggaagccccgcggctggagtttcgggatccggcactcggactacctggccccgctggtgaccgacgcggacaactgacccgccaggcgggagcggccccacacgtgtttgcttaaagtctgcgagtccgcatcgtgtccgcctctctc

SEQ ID NO: 163008 - DNA, 917 bp, Homo sapiens
  Payload ID: 12120
  Gene Symbol: ODF3B
  Gene Name: outer dense fiber of sperm tails 3B
  ENST ID: ENST00000405135
  CDS Start-End: 71-916
ggtgcaggggccgcggccaccgccttctgtccgcaggtgctgcgagccgtaagcgccccccacccgcgctatgggctcggacgcctgggtgggcctttggcggccacaccggccccgcggccccatcgcggcgcactacggaggccccgggcccaaatacaagctgccgcccaacaccggctacgccctgcatgacccgtcgcggccgcgcgcccccgccttcaccttcggcgcgcgcttccccacgcagcagacgacgtgcggccccgggccaggccacctggtgcccgctcgcatgaccgtgcgcggcaccgacggcgcccccgcctactccatctacggccgcccacgccgctcagcgcccttcctcactccgggacctggctcccacgcagttctagccccccacacccttgatccgccccgcaggcaggtacttcccggagcgagcggggaacgcgacgtaccccagtgcgcctcggcacaccattgctccccgaaactggggtgtccaggcggaacagcagagcccaggtcccgcggcctatacggtgccctcgctcttgggtccgcgcgtcatcggcaaagtctccgccccaacttgctccatctacggccgcagagcggctggcagtttcttcgaggacctcagcaagaccccgggcccctgcgcctatcaggtcgtgagtccaggggtctacaagtcccgggccccccagttcacgattctggcgcggacttcgctcccccaagacaacactcggaagccagggcccgcggcctacaacgtggatcagcaccggaagccccgcggctggagtttcgggatccggcactcggactacctggccccgctggtgaccgacgcggacaactgacccgccaggcgggagcggccccacacgtgtttgcttaaa

SEQ ID NO: 163009 - DNA, 869 bp, Homo sapiens
  Payload ID: 12120
  Gene Symbol: ODF3B
  Gene Name: outer dense fiber of sperm tails 3B
  ENST ID: ENST00000401779
  CDS Start-End: 108-836
ccagggtagtgggaaagtgcgctccccaagaatttgcggtgcaggggccgcggccaccgccttctgtccgcaggtgctgcgagccgtaagcgccccccacccgcgctatgggctcggacgcctgggtgggcctttggcggccacaccggccccgcggccccatcgcggcgcactacggaggccccgggcccaaatacaagctgccgcccaacaccgcagacgacgtgcggccccgggccaggccacctggtgcccgctcgcatgaccgtgcgcggcaccgacggcgcccccgcctactccatctacggccgcccacgccgctcagcgcccttcctcactccgggacctggcaggtacttcccggagcgagcggggaacgcgacgtaccccagtgcgcctcggcacaccattgctccccgaaactggggtgtccaggcggaacagcagagcccaggtcccgcggcctatacggtgccctcgctcttgggtccgcgcgtcatcggcaaagtctccgccccaacttgctccatctacggccgcagagcggctggcagtttcttcgaggacctcagcaagaccccgggcccctgcgcctatcaggtcgtgagtccaggggtctacaagtcccgggccccccagttcacgattctggcgcggacttcgctcccccaagacaacactcggaagccagggcccgcggcctacaacgtggatcagcaccggaagccccgcggctggagtttcgggatccggcactcggactacctggccccgctggtgaccgacgcggacaactgacccgccaggcgggagcggccccacacgtgtttgcttaaagtctgcgagtccgcatcgtgtccgcctctctc

SEQ ID NO: 163010 - DNA, 643 bp, Homo sapiens
  Payload ID: 12120
  Gene Symbol: ODF3B
  Gene Name: outer dense fiber of sperm tails 3B
  ENST ID: ENST00000403326
  CDS Start-End: 32-589
ctgcgagccgtaagcgccccccacccgcgctatgggctcggacgcctgggtgggcctttggcggccacaccggccccgcggccccatcgcggcgcactacggaggccccgggcccaaatacaagctgccgcccaacaccggcaggtacttcccggagcgagcggggaacgcgacgtaccccagtgcgcctcggcacaccattgctccccgaaactggggtgtccaggcggaacagcagagcccaggtcccgcggcctatacggtgccctcgctcttgggtccgcgcgtcatcggcaaagtctccgccccaacttgctccatctacggccgcagagcggctggcagtttcttcgaggacctcagcaagaccccgggcccctgcgcctatcaggtcgtgagtccaggggtctacaagtcccgggccccccagttcacgattctggcgcggacttcgctcccccaagacaacactcggaagccagggcccgcggcctacaacgtggatcagcaccggaagccccgcggctggagtttcgggatccggcactcggactacctggccccgctggtgaccgacgcggacaactgacccgccaggcgggagcggccccacacgtgtttgcttaaagtctgcgagtccgca

SEQ ID NO: 163011 - DNA, 762 bp, Homo sapiens
  Payload ID: 12120
  Gene Symbol: ODF3B
  Gene Name: outer dense fiber of sperm tails 3B
  Uniprot ID: A8MYP8
  ENST ID: ENST00000428989
  CDS Start-End: 1-762
atgggctcggacgcctgggtgggcctttggcggccacaccggccccgcggccccatcgcggcgcactacggaggccccgggcccaaatacaagctgccgcccaacaccggctacgccctgcatgacccgtcgcggccgcgcgcccccgccttcaccttcggcgcgcgcttccccacgcagcagacgacgtgcggccccgggccaggccacctggtgcccgctcgcatgaccgtgcgcggcaccgacggcgcccccgcctactccatctacggccgcccacgccgctcagcgcccttcctcactccgggacctggcaggtacttcccggagcgagcggggaacgcgacgtaccccagtgcgcctcggcacaccattgctccccgaaactggggtgtccaggcggaacagcagagcccaggtcccgcggcctatacggtgccctcgctcttgggtccgcgcgtcatcggcaaagtctccgccccaacttgctccatctacggccgcagagcggctggcagtttcttcgaggacctcagcaagaccccgggcccctgcgcctatcaggtcgtgagtccaggggtctacaagtcccgggccccccagttcacgattctggcgcggacttcgctcccccaagacaacactcggaagccagggcccgcggcctacaacgtggatcagcaccggaagccccgcggctggagtttcgggatccggcactcggactacctggccccgctggtgaccgacgcggacaactga

SEQ ID NO: 163012 - DNA, 276 bp, Homo sapiens
  Payload ID: 12120
  Gene Symbol: ODF3B
  Gene Name: outer dense fiber of sperm tails 3B
  ENST ID: ENST00000437588
  CDS Start-End: 139-276
ggaagcgggaaagggccacaatggggtctgggaggtgggcggggcggagcggggatgtccagccacgtcgctttgttttcccacgctaggagctaccacaacaggtgctgcgagccgtaagcgccccccacccgcgctatgggctcggacgcctgggtgggcctttggcggccacaccggccccgcggccccatcgcggcgcactacggaggccccgggcccaaatacaagctgccgcccaacaccggctacgccctgcatgacccgtcgcggccg

SEQ ID NO: 163013 - DNA, 1196 bp, Homo sapiens
  Payload ID: 12121
  Gene Symbol: ODF3L1
  Gene Name: outer dense fiber of sperm tails 3-like 1
  Uniprot ID: Q8IXM7
  ENST ID: ENST00000332145
  CDS Start-End: 224-1048
tccaagctctgccgtgacgtcatctccagctccagcctgctggggcctgtgctgactgtgccccagacagccttagctgctcaagctggagaactgtcttccttcccagcttcctccgtgtctggggtgggggatgggggggtctcaggcagggatactctagccccttgactgctgtttagaccctgctgtagctgctgctgctccctgcccagccccagccatgaaactgcccaaggggaccaggagctctgtgtactttgcacagcacccagaaaaggagccattgccctcaaggcaggaggtcaagcagacccctgtcatcatggccaagatcaaaggtccggggcccgccaagtacctccggccatcctgcacgggctacatagatcatgacatctccatgttcaaggcaccagcttataccctgcatagccggcactcagagaagcggatggtgtgccacagcagccctgggccttgctatctcttggatcccaaaataactcggtttggaatgtccagctgcccgcaggtccccatggaggagcgcatctccaacctgcgcctgaaccccaccctcgcatcctgccagtactactttgagaagatccacccaccgggggaacgcagggctccccagtacacgtttggctaccggcgcccatacagagtgatggacctcaacccggctcccaaccagtaccagatgccactcttgctggggcccaacacccctgtcagccgagctgctccctgctacagtctggcctccagggacaagaactggttctacaaggaggatgtggcaggaggccctggacctaccacgtacgcccgacctgagccatccatctatcagaaccgcagccctacttacagcatggccaagcgcttcgcctaccctctggacctcacgccacggcctggccccggctcccacgaggtccagcaggtcactgtgcacaagccccacatccctgctttcaccatgggcatcaagcactcactccacctgtgcccactggtcatcgacattcgtgactgaggcccctcttggggcactcactgcccctcatccccagaaattatttttctacaccaaattgagcaatttgaccaagatttctagtagcagagccggtacctgctgagtgtccggcacacagaagacattagagatacattttcatgta

SEQ ID NO: 163014 - DNA, 1604 bp, Homo sapiens
  Payload ID: 12122
  Gene Symbol: ODF3L2
  Gene Name: outer dense fiber of sperm tails 3-like 2
  Uniprot ID: Q3SX64
  ENST ID: ENST00000315489
  CDS Start-End: 237-1106
actcgatcccggccccacttccaggccagtgtccggccgaccagcctgccttgggccagggccccacgactccctgctgcgggacaagaggccgtctgtgcggctgtggtcgtgggagggtgtggtgaggccgtgaaggtggggacggtgcctgggcctgtggccgccagagctgctgcggctcagaaggtagcaccaggccccgtgggtgctgtgggggccatcgcctgcccaccatggggaccctcagctgcgactccaccccacggctggccacagccccccttggccggcgagtgacggagggccagattccggagaccggcctgaggaagtcctgtgggacggccaccctggagaacggctcggggccaggcttgtatgtcctgccgtccaccgtgggcttcatcaaccacgactgcaccagggtggccagtcccgcctactcgctcgtccggaggcccagtgaggcaccacctcaggacaccagcccgggccccatctacttcttggaccccaaagtcacacgctttggccgcagctgcacccctgcctactccatgcagggccgggccaagtctcggggtccggaggtgacgccaggccctggggcctacagcccagagaaggtgccccctgtgcgccatcggacaccgccggctttcaccctgggctgccgcctccccctgaagcccctggacacctcagcccctgcccctaatgcctacaccatgccccctctgtggggctcacagatcttcaccaagcccagcagccccagctacacggtggtgggccgcaccccccccgcccgccccccgcaggatcctgctgagataccaggcccgggccagtacgacagcccggacgcaaacacctaccgccagcgcctgcctgccttcaccatgctggggcggccccgggccccgcgacccctggaggagacccccggccctggcgcccactgcccagagcaggtcaccgtgaacaaagccagggctccagcgttctctatgggcatccgccactcgaaacgggccagcaccatggccgccaccacgccctcccggcctgcggggcacaggctgcccggccgctgctgctaggccaggcctgtttcccacacagtgaacggggggctggcgggcctctcctggggcctggctttggctggaggggctagaaggcgagaggggctgggaaaggagtcttccctcccctttcctgaactgtccaggtccttctaggacacctgatccttccagtccctgggggctgtgacccatggccctgtgcagggtgcagggtgagtctccttccagtgccccagtttcttccaggtcacgccaggccaggccaggccaggtggggaaagggacaccttccggccctccccagtagctggctggagatggagcttcctgtgtcccagaactcggcgtccagctccactagggcctggatccccatcacagcttgggttagccccggtcccagcccaaactcaggctggaggcagccccgaggcctgtgcctttcccactccaccttctacagttgcttagccaataaacctttcctgggctggagagctgtcagcatca

SEQ ID NO: 163015 - DNA, 1393 bp, Homo sapiens
  Payload ID: 12122
  Gene Symbol: ODF3L2
  Gene Name: outer dense fiber of sperm tails 3-like 2
  Uniprot ID: Q3SX64
  ENST ID: ENST00000382696
  CDS Start-End: 134-895
ctgtggtcgtgggagggtgtggtgaggccgtgaaggtggggacggtgcctgggcctgtggccgccagagctgctgcggctcagaaggtagcaccaggccccgtgggtgctgtgggggccatcgcctgcccaccatggggaccctcagctgcgactccaccccacggctggccacagccccccttggccggcgagtgacggagggccagattccggagaccggcctgaggaagtcctgtgggacggccaccctggagaacgcaccacctcaggacaccagcccgggccccatctacttcttggaccccaaagtcacacgctttggccgcagctgcacccctgcctactccatgcagggccgggccaagtctcggggtccggaggtgacgccaggccctggggcctacagcccagagaaggtgccccctgtgcgccatcggacaccgccggctttcaccctgggctgccgcctccccctgaagcccctggacacctcagcccctgcccctaatgcctacaccatgccccctctgtggggctcacagatcttcaccaagcccagcagccccagctacacggtggtgggccgcaccccccccgcccgccccccgcaggatcctgctgagataccaggcccgggccagtacgacagcccggacgcaaacacctaccgccagcgcctgcctgccttcaccatgctggggcggccccgggccccgcgacccctggaggagacccccggccctggcgcccactgcccagagcaggtcaccgtgaacaaagccagggctccagcgttctctatgggcatccgccactcgaaacgggccagcaccatggccgccaccacgccctcccggcctgcggggcacaggctgcccggccgctgctgctaggccaggcctgtttcccacacagtgaacggggggctggcgggcctctcctggggcctggctttggctggaggggctagaaggcgagaggggctgggaaaggagtcttccctcccctttcctgaactgtccaggtccttctaggacacctgatccttccagtccctgggggctgtgacccatggccctgtgcagggtgcagggtgagtctccttccagtgccccagtttcttccaggtcacgccaggccaggccaggccaggtggggaaagggacaccttccggccctccccagtagctggctggagatggagcttcctgtgtcccagaactcggcgtccagctccactagggcctggatccccatcacagcttgggttagccccggtcccagcccaaactcaggctggaggcagccccgaggcctgtgcctttcccactccaccttctacagttgcttagccaataaacctttcctgggctggagagctgtcagcatca

SEQ ID NO: 163016 - DNA, 1156 bp, Homo sapiens
  Payload ID: 12123
  Gene Symbol: ODF4
  Gene Name: outer dense fiber of sperm tails 4
  Uniprot ID: Q2M2E3
  ENST ID: ENST00000328248
  CDS Start-End: 189-962
ctgaatgggttggggccttctcttggatcaagagtctcttatttgatcgaggtctgttattagacttcctcattctttctcagacctcaggctgcatggtggcagctgatgaaaatatccaaaagatgagaagagacaattgagtctggtgagggaaaggggagacagagggtgaagtggtgctcaagatggatgcagagtactctgggaatgagttccccaggtcagaaggagaaagagaccaacatcagagacctggaaaggaaaggaagagtggggaggcaggatggggcacaggtgagctgggacaagatgggagactgctgtcctccaccctctccctcagtagtaacaggtccttgggccagcgccagaactctccgctgccctttcaatggagaatcacacacagcttccgctggatggcccaggtgttggcctctgagctcagcctggttgcctttatcctactattggtcgtggccttctccaagaaatggctggacctctctaggagcctcttctaccagcgctggcccgtggatgtcagcaacagaatccacacatcagcccacgttatgtccatggggctcctgcacttttacaaatccaggagctgttctgacttagagaatgggaaagtcaccttcatcttctccaccctcatgctattccccattaacatctggatcttcgagttggaaaggaatgtatccatccccataggctggagctatttcattggttggctggtgcttatcctatacttcacctgcgcgatcctttgctacttcaaccataaaagtttctggagtctgattctgagccaccccagtggtgccgtgtcctgcagcagcagtttcggctcagtagaagaatctccaagggcacagacgatcacagacacccccatcacccaggagggagtcctggatcctgagcagaaggatacacatgtgtaatcttttctgaactcctggcaccaagttctgtccattcatctgaccccatctcctcatcctcccccagcccttgaataggttggtcctcatcattgcaaggaatgagaaagggaggattttgcactcctctgctttctccctgccttgattgagcttgagtgatgtggaataaattgtccgtctcttctttctca

SEQ ID NO: 163017 - DNA, 804 bp, Homo sapiens
  Payload ID: 12123
  Gene Symbol: ODF4
  Gene Name: outer dense fiber of sperm tails 4
  ENST ID: ENST00000584943
  CDS Start-End: 183-611
gggttggggccttctcttggatcaagagtctcttatttgatcgaggtctgttattagacttcctcattctttctcagacctcaggctgcatggtggcagctgatgaaaatatccaaaagatgagaagagacaattgagtctggtgagggaaaggggagacagagggtgaagtggtgctcaagatggatgcagagtactctgggaatgagttccccaggtcagaaggagaaagagaccaacatcagagacctggaaaggaaaggaagagtggggaggcaggatggggcacagtcaccttcatcttctccaccctcatgctattccccattaacatctggatcttcgagttggaaaggaatgtatccatccccataggctggagctatttcattggttggctggtgcttatcctatacttcacctgcgcgatcctttgctacttcaaccataaaagtttctggagtctgattctgagccaccccagtggtgccgtgtcctgcagcagcagtttcggctcagtagaagaatctccaagggcacagacgatcacagacacccccatcacccaggagggagtcctggatcctgagcagaaggatacacatgtgtaatcttttctgaactcctggcaccaagttctgtccattcatctgaccccatctcctcatcctcccccagcccttgaataggttggtcctcatcattgcaaggaatgagaaagggaggattttgcactcctctgctttctccctgccttgattgagcttgagtgatgtggaataaattgtccgtctcttctttctc

SEQ ID NO: 163018 - DNA, 1122 bp, Homo sapiens
  Payload ID: 12124
  Gene Symbol: OVCA2
  Gene Name: ovarian tumor suppressor candidate 2
  Uniprot ID: Q8WZ82
  ENST ID: ENST00000572195
  CDS Start-End: 113-796
gctccgaggcccgccctcggggcggtgctgacgttcggttccgccccgtgcattgtgcttccgctcggggaaagaccgcttccggtgcttccgtcgctccttgccgggcataatggccgcgcagcgacccctgcgggtcctgtgcctggcgggcttccggcagagcgagcggggcttccgtgagaagaccggggcgctgaggaaggcgctgcggggtcgcgccgagctcgtgtgcctcagcggcccgcacccggtccccgaccccccgggccccgagggcgccagatcagacttcgggtcctgccctccggaggagcagcctcgaggctggtggttttcagagcaggaggccgacgttttctccgcattggaagagcccgccgtctgcaggggcctggaggaatcactggggatggtggcacaggcactgaacaggctggggccttttgacggccttcttggtttcagccaaggggctgcgctagcagcccttgtgtgtgccctgggccaggcaggcgatccccgcttccccttgccacggtttatcctcttggtgtctggtttctgtccccggggcattgggttcaaggaatccatcctgcaaaggcccttgtcattgccttcgctccatgtttttggggacactgacaaagtcatcccctctcaggagagtgtgcaactggccagccaatttcccggagccatcaccctcacccactctggtggccacttcattccagcagctgcaccccagcgtcaggcctacctcaagttcttggaccagtttgcagagtgaaagatcaagaaatgtctctgctcctacatccagctcctctaggggcagcctccgtcatccatgccctcccaggaccctccactcactgctgtgagtgcgcctcaccagaaccagttaagagacaactatcaattcttgagacccaaattataagggccctgccctgtactgaagaaaaggggagcacaaggccttaatggacattgacttgtgaaaacgcaaacatgaatatggttggagagccctggattaggagggtgacatggggaaggcagaggctggcaccatggtgactgccacataataaagtggtgatttggattttg

SEQ ID NO: 163019 - DNA, 2243 bp, Homo sapiens
  Payload ID: 12125
  Gene Symbol: OVGP1
  Gene Name: oviductal glycoprotein 1, 120kDa
  Uniprot ID: Q12889
  ENST ID: ENST00000369732
  CDS Start-End: 57-2093
agggaagctcctataaagggctgcatctctggactcacagctatcagaccattgagatgtggaagctgttgctgtgggttgggctggttcttgtgctgaaacaccacgatggtgctgcccataaactcgtgtgttatttcaccaactgggcacacagtcggccaggccctgcctcgatcttgccccatgacctggacccctttctctgcacccacctgatatttgcctttgcctcaatgaacaacaatcagattgttgctaaggatctccaggatgagaaaattctctacccagagttcaacaaactaaaggagaggaacagagagctgaaaacactactgtccatcggcgggtggaactttggcacctcaagattcaccactatgttgtccacatttgccaaccgtgaaaagtttattgcttcagttatatcccttctgaggacacatgactttgatggtcttgaccttttcttcttatatcctggactaagaggcagccccatgcatgaccggtggacttttctcttcttaattgaagagctcctgtttgccttccggaaggaggcactgctcaccatgcgcccgaggctgctgctgtctgctgctgtttctggggtcccacacatcgtccaaacatcctatgatgtgcgctttctaggaagactcctggatttcatcaatgtcttgtcttatgacttacatggaagttgggaaaggttcacaggacataatagccccctcttctctctgcctgaagaccccaaatcttcggcatatgctatgaattattggagaaagcttggggcaccctcagagaagctcatcatggggatccccacctatggacgtacctttcgcctcctcaaagcctctaagaatgggttgcaggccagagcgatcggaccagcatctccagggaagtacaccaagcaagaaggcttcttggcttattttgagatttgttcctttgtctggggagcgaagaagcactggattgattaccagtatgtcccgtatgccaacaaggggaaagagtgggttggctatgacaatgccatcagcttcagttacaaggcatggtttataaggcgagagcattttgggggggccatggtgtggacattggacatggatgacgtcaggggcacgttctgtggcactggccctttcccccttgtctacgtattgaatgatatcctggtgcgggctgagttcagttcaacttctttaccacaattttggctgtcatctgctgtgaattcttcaagcactgaccctgaaaggctggctgtgaccacggcatggaccactgatagtaagattttgcccccaggaggagaggctggggtcactgagatccacggaaagtgtgaaaatatgactataacccctagaggtacaactgtgacccctacaaaggaaactgtatcccttggaaagcacactgtagctctaggagagaagactgagatcactggggcaatgaccatgacttctgtgggtcatcagtccatgacccctggagagaaggccctgacccctgtgggtcatcaatctgtgaccactggacagaagaccctgacctctgtgggttatcagtctgtgacccctggggaaaagaccctgacccctgtgggtcatcagtctgtgacccctgtgagtcatcagtctgtgagccctggaggaacgactatgacccctgtccattttcagactgagacccttagacagaatacagtggcccctagaaggaaggctgtggcccgtgaaaaggtgactgtcccctccagaaacatatcagtcacccctgaagggcagactatgcctttaagaggggagaatttgacttctgaggtgggcactcaccccaggatgggtaacttgggtcttcagatggaagctgaaaacaggatgatgctgtcctccagccccgtcatccagctcccggaacaaactcctctagcttttgacaaccgctttgttcccatctatggaaaccattcctctgtcaactcagtaacccctcaaacaagtcctctttctctaaaaaaagaaatcccagaaaactctgctgtggatgaagaagcctaagcccctctggtgtcagaaaccagggaaaacccttgtcttttcttctaagtgacatgttggaagccttctcatcccggggcaaagcaggcatcaaaaccagaataggccaatctcttttccattaaataaactgtaaacacaagaacccac

SEQ ID NO: 163020 - DNA, 3405 bp, Homo sapiens
  Payload ID: 12126
  Gene Symbol: OVCH1
  Gene Name: ovochymase 1
  Uniprot ID: Q7RTY7
  ENST ID: ENST00000318184
  CDS Start-End: 1-3405
atgggcctgctggccagtgctggtttgttgctgttgctggtcatcggccaccccagaagcctaggactgaagtgtggaattcgcatggtcaacatgaaaagtaaggaacctgccgtgggatctagattcttctctagaattagtagttggagaaattcaacagtgactggacatccatggcaggtctccctaaaatcagatgagcaccacttctgtggaggaagcttgattcaagaagatcgggttgttacagcagcacactgcctggacagcctcagtgagaagcagctgaagaatataactgtgacttctggggagtacagcctctttcagaaggataagcaagaacagaatattcctgtctcaaaaattattacccatcctgaatacaacagccgtgaatatatgagtcctgatattgcactgctgtatctaaaacacaaagtcaagtttggaaatgctgttcagccaatctgtcttcctgacagcgatgataaagttgaaccaggaattctttgcttatccagtggatggggcaagatttccaaaacatcagaatattcaaatgtcctacaagaaatggaacttcccatcatggatgacagagcgtgtaatactgtgctcaagagcatgaacctccctcccctgggaaggaccatgctgtgtgctggcttccctgattggggaatggacgcctgccagggggactctggaggaccactggtttgtagaagaggtggtggaatctggattcttgctgggataacttcctgggtagctggttgtgctggaggttcagttcccgtaagaaacaaccatgtgaaggcatcacttggcattttctccaaagtgtctgagttgatggattttatcactcaaaacctgttcacaggtttggatcggggccaacccctctcaaaagtgggctcaaggtatataacaaaggccctgagttctgtccaagaagtgaatggaagccagagaggaaagggtattttagacatggaaaagcaagttggatgtgatcatgactatgtatctttacgatcaagcagtggagtgctttttaatcagagatctctcatggaagacgatggaaaacaaaacaaacgtgtctgtggaaaaatattgccttcaccattgctggcagagaccagtgaggccatggttccatttgtttctgatacagaagacagtggcagtggctttgagcttaccgttactgctgtacagaagtcagaagcagggtcaggttgtgggagtctggctatattggtagaagaagggacaaatcactctgccaagtatcctgatttgtatcccagtaacacaaggtgtcattggttcatttgtgctccagagaagcacattataaagttgacatttgaggactttgctgtcaaatttagtccaaactgtatttatgatgctgttgtgatttacggtgattctgaagaaaagcacaagttagctaaactttgtggaatgttgaccatcacttcaatattcagttctagtaacatgacggtgatatactttaaaagtgatggtaaaaatcgtttacaaggcttcaaggccagatttaccattttgccctcagagtctttaaacaaatttgaaccaaagttacctccccaaaacaatcctgtatctaccgtaaaagctattctgcatgatgtctgtggcatccctccatttagtccccagtggctttccagaagaatcgcaggaggggaagaagcctgcccccactgttggccatggcaggtgggtctgaggtttctaggcgattaccaatgtggaggtgccatcatcaacccagtgtggattctgaccgcagcccactgtgtgcaattgaagaataatccactctcctggactattattgctggggaccatgacagaaacctgaaggaatcaacagagcaggtgagaagggccaaacacataatagtgcatgaagactttaacacactaagttatgactctgacattgccctaatacaactaagctctcctctggagtacaactcggtggtgaggccagtatgtctcccacacagcgcagagcctctattttcctcggagatctgtgctgtgaccggatggggaagcatcagtgcagatggtggcctagcaagtcgcctacagcagattcaagtgcatgtgttagaaagagaggtctgtgaacacacttactattctgcccatccaggagggatcacagagaagatgatctgtgctggctttgcagcatctggagagaaagatttctgccagggagactctggtgggccactagtatgtagacatgaaaatggtccctttgtcctctatggcattgtcagctggggagctggctgtgtccagccatggaagccgggtgtatttgccagagtgatgatcttcttggactggatccaatcaaaaatcaatggtcctgcttcacttcagacaaataataaatgcaaaaccttaaaacaacaattgccaccacccacaccttcaccagacagtgcatcttggccaggttgttgctctgaagcagagctagaaaagcctagaggcttttttcccacaccacggtatctactggattatagaggaagactggaatgttcttgggtgctcagagtttcagcaagcagtatggcaaaatttaccattgagtatctgtcactcctggggtctcctgtgtgtcaagactcagttctaattatttatgaagaaagacacagtaagagaaagacggcaggtggattacatggaagaagactttactcaatgactttcatgagtcctggaccgctggtgagggtgacattccatgcccttgtacgaggtgcatttggtataagctatattgtcttgaaagtcctaggtccaaaggacagtaaaataaccagactttcccaaagttcaaacagagagcacttggtcccttgtgaggatgttcttctgaccaagccagaagggatcatgcagatcccaagaaattctcacagaactactatgggttgccaatggagattagtagcccctttaaatcacatcattcagcttaatattattaacttcccgatgaagccaacaacttttgtctgtcatggtcatctgcgtgtttacgaaggatttggaccaggaaaaaaattaatagcttcattcgctggaactctggcaatgatactgacaaaagacatattaaaaagagaaaaactgaattttattaacacatatatcatgcatatatgggaaaattcagtgtatgataatgtaagaagtgttggaaaaagaaaacagaagaaatttgcatcaaatttaagttatagtatggaggctgagaagtccaggatccaggtgccagcagatttggtgcctgctaagggctcactttctggttcttag

SEQ ID NO: 163021 - DNA, 603 bp, Homo sapiens
  Payload ID: 12126
  Gene Symbol: OVCH1
  Gene Name: ovochymase 1
  ENST ID: ENST00000539117
  CDS Start-End: 1-365
gtaaaataaccagactttcccaaagttcaaacagagagcacttggtcccttgtgaggatgttcttctgaccaagccagaagggatcatgcagatcccaagaaattctcacagaactactatgggttgccaatggagattagtagcccctttaaatcacatcattcagcttaatattattaacttcccgatgaagccaacaacttttgtctgtcatggtcatctgcgtgtttacgaaggatttggaccaggaaaaaaattaatagctcatttacatggctccaagaaagagtttatcttgatatccagtgctgcttacctgactgtgcattttaagactgatgagtctgagagaaagaggttttaagcttattttagaagagatgattcaggagcaatcacagaagagcaatattgagacccaatttcctatcagtggagagttttcactactaatctggtgccagaggaagatgataaaataaattgactttacatgtatgactgctggatggggaacaactgaacttcacatttttctctatttttaatacgaataatggtgggaaaagtcttttaaaataatggatctaaaggtgacttcc

SEQ ID NO: 163022 - DNA, 446 bp, Homo sapiens
  Payload ID: 12126
  Gene Symbol: OVCH1
  Gene Name: ovochymase 1
  ENST ID: ENST00000537054
  CDS Start-End: 1-243
agagagcacttggtcccttgtgaggatgttcttctgaccaagccagaagggatcatgcagatcccaagaaattctcacagaactactatgggttgccaatggagattagtagcccctttaaatcacatcattcagcttaatattattaacttcccgatgaagccaacaacttttgtctgtcatggtcatctgcgtgtttacgaaggatttggaccaggaaaaaaattaataggagaatgttgatgagcactgagctttcttggttcctaagccaattcagcaccaagaagaccacagcttcttgtggggagactgcagtatctatgaaaatgatgtatacttctatctttcttgccctacagaacacctgttaccatgcactgcctcatgaggttgttttgagaattaaataagagaaggcatgttaatcaatactaagaaaccaa

SEQ ID NO: 163023 - DNA, 1921 bp, Homo sapiens
  Payload ID: 12127
  Gene Symbol: OVCH2
  Gene Name: ovochymase 2 (gene/pseudogene)
  ENST ID: ENST00000533663
  CDS Start-End: 28-1725
tttcagggaaaaactatgagtctcaaaatgcttataagcaggaacaagctgattttactactaggaatagtcttttttgaacgaggtaaatctgcaactctttcgctccccaaagctcccagttgtgggcagagtctggttaaggtacagccttggaattattttaacattttcagtcgcattcttggaggaagccaagtggagaagggttcctatccctggcaggtatctctgaaacaaaggcagaagcatatttgtggaggaagcatcgtctcaccacagtgggtgatcacggcggctcactgcattgcaaacagaaacattgtgtctactttgaatgttactgctggagagtatgacttaagccagacagacccaggagagcaaactctcactattgaaactgtcatcatacatccacatttctccaccaagaaaccaatggactatgatattgcccttttgaagatggctggagccttccaatttggccactttgtggggcccatatgtcttccagagctgcgggagcaatttgaggctggttttatttgtacaactgcaggctggggccgcttaactgaaggtggcgtcctctcacaagtcttgcaggaagtgaatctgcctattttgacctgggaagagtgtgtggcagctctgttaacactaaagaggcccatcagtgggaagacctttctttgcacaggttttcctgatggagggagagacgcatgtcagggagattcaggaggttcactcatgtgccggaataagaaaggggcctggactctggctggtgtgacttcctggggtttgggctgtggtcgaggctggagaaacaatgtgaggaaaagtgatcaaggatcccctgggatcttcacagacattagtaaagtgcttccctggatccacgaacacatccaaactggtaatcggagaaagagctccagagcctggtgcagtgagcaggatgtcatagtcagcggggctgaggggaagctgcacttcccagaaagcctccacctatattatgagagcaagcaacggtgtgtctggaccctgctggtaccagaggaaatgcatgtgttgctcagtttttcccacctagatgttgagtcttgtcaccacagttacctgtcaatgtattctttagaagacagacccattggaaaattttgtggagaaagcctcccttcatccattcttattggctctaattctctaaggctgaaattcgtctctgatgccacagataatgcagctgggtttaatcttacctataaagctcttaaaccaaactacattcctgattcaggttgcagttacttaactgtcctttttgaagaaggtctcatacagagtctaaactatcctgaaaactacagtgacaaggctaactgtgactggatttttcaagcctccaaacatcacctaattaagctttcatttcagagtctggaaatagaagaaagtggagactgcacttccgactatgtgacagtgcacagcgatgtagaaaggaagaaggaaatagctcggctgtgtggctatgatgtccccacccctgtgctgagcccctccagcatcatgctcatcagcttccaatcagatgaaaacgggacctgcaggggctttcaggctacagtctccttcattcctaaagcagtatacccagatttaaacatctccatatcagaggatgaatcaatgtttctggagacatgagatgtgccaaatggagaaaccaatgtttctggccaaggggcaccagtgactgtcagtaaaccaccagaagctagaggagaggcttggggcagactcctcgtcacagccctcagacagagccatccctgctgacacgttgatcttggacttctagcctccagaactatgagacaataaatttctgttgttctaagcc

SEQ ID NO: 163024 - DNA, 1730 bp, Homo sapiens
  Payload ID: 12127
  Gene Symbol: OVCH2
  Gene Name: ovochymase 2 (gene/pseudogene)
  ENST ID: ENST00000612000
  CDS Start-End: 1-1698
atgcttataagcaggaacaagctgattttactactaggaatagtcttttttgaacgaggtaaatctgcaactctttcgctccccaaagctcccagttgtgggcagagtctggttaaggtacagccttggaattattttaacattttcagtcgcattcttggaggaagccaagtggagaagggttcctatccctggcaggtatctctgaaacaaaggcagaagcatatttgtggaggaagcatcgtctcaccacagtgggtgatcacggcggctcactgcattgcaaacagaaacattgtgtctactttgaatgttactgctggagagtatgacttaagccagacagacccaggagagcaaactctcactattgaaactgtcatcatacatccacatttctccaccaagaaaccaatggactatgatattgcccttttgaagatggctggagccttccaatttggccactttgtggggcccatatgtcttccagagctgcgggagcaatttgaggctggttttatttgtacaactgcaggctggggccgcttaactgaaggtggcgtcctctcacaagtcttgcaggaagtgaatctgcctattttgacctgggaagagtgtgtggcagctctgttaacactaaagaggcccatcagtgggaagacctttctttgcacaggttttcctgatggagggagagacgcatgtcagggagattcaggaggttcactcatgtgccggaataagaaaggggcctggactctggctggtgtgacttcctggggtttgggctgtggtcgaggctggagaaacaatgtgaggaaaagtgatcaaggatcccctgggatcttcacagacattagtaaagtgcttccctggatccacgaacacatccaaactggtaatcggagaaagagctccagagcctggtgcagtgagcaggatgtcatagtcagcggggctgaggggaagctgcacttcccagaaagcctccacctatattatgagagcaagcaacggtgtgtctggaccctgctggtaccagaggaaatgcatgtgttgctcagtttttcccacctagatgttgagtcttgtcaccacagttacctgtcaatgtattctttagaagacagacccattggaaaattttgtggagaaagcctcccttcatccattcttattggctctaattctctaaggctgaaattcgtctctgatgccacagataatgcagctgggtttaatcttacctataaagctcttaaaccaaactacattcctgattcaggttgcagttacttaactgtcctttttgaagaaggtctcatacagagtctaaactatcctgaaaactacagtgacaaggctaactgtgactggatttttcaagcctccaaacatcacctaattaagctttcatttcagagtctggaaatagaagaaagtggagactgcacttccgactatgtgacagtgcacagcgatgtagaaaggaagaaggaaatagctcggctgtgtggctatgatgtccccacccctgtgctgagcccctccagcatcatgctcatcagcttccaatcagatgaaaacgggacctgcaggggctttcaggctacagtctccttcattcctaaagcagtatacccagatttaaacatctccatatcagaggatgaatcaatgtttctggagacatgagatgtgccaaatggagaaaccaatgtttctgg

SEQ ID NO: 163025 - DNA, 3034 bp, Homo sapiens
  Payload ID: 12128
  Gene Symbol: OVOL1
  Gene Name: ovo-like zinc finger 1
  Uniprot ID: O14753
  ENST ID: ENST00000335987
  CDS Start-End: 353-1156
ccgccgcgagccaataaagcgtgaacccgtccgtccggctcgcactttaagacttcccgagcggcggcggggacgccagtcgagccgggagacgcttacctgccgcttccccgcgccgcccggtgcacctggccgcaagggacctcgttctcagggaagacggcgacattccgcggaggtggaaccgccgcgcgccgtccgggctcggaccttccccggaacgtgggggcgccttagcgactccttccctgttgtgcccccgttcccggcgttcagcccggccccgcaaaggtgggacggctcccggcttcagttacggaagcggcccgtgtccagcgacgagggttcgaaaatgccccgcgcgttcctggtgaagaagccgtgcgtctccacgtgcaagaggaactggagcgagctccccgacgaggagcgcggcgagatctacgtgccagtcagcctgggcttctgcccaccacagccctaccgggagccggaaccctctgtggccgaacccccttcctgcccgctggctttgaacatgagccttcgagactctagctacagcatggcccccgggccctgtgtggtggcccagctgccctctgaagacatgggccacttgacagacccccagagcagagaccatggcttcctgcgcaccaagatgaaggtgacccttggggacagtcccagtggagacctgttcacctgccgtgtctgccagaaggccttcacctaccagcgcatgctgaaccgccacatgaagtgtcacaacgacgtcaagaggcacctctgcacgtactgcgggaagggcttcaatgacaccttcgacctcaagagacacgtccgaactcacactggcgtgcggccctacaagtgcagcctgtgtgacaaggccttcacgcagcgctgctctctggagtctcacctcaagaagatccatggtgtgcagcagaagtacgcgtacaaggagcggcgggccaagctgtacgtgtgtgaggagtgcggctgcacatctgagagccaggagggccacgtcctgcacctgaaggagcaccaccctgacagcccgctgctgcgcaagacctccaagaaggtggccgtggcactacagaacactgtcacttccctgctgcagggcagcccccacctgtgagtggctcgagccctgggggtgctcctggaagccccaagagcatccaggattgcctcccagctgcctggccagcccaccctcctgcaacctctcacccgaacaccagtgatcaggactggagcccccgtgccttggtctcccccctgggcacacgtgctcactcaggcccagcaatgacctctgctcatttttgcatttttgacttatgggccgaggctgttctgagcctgggaagatgtacctatgtcaagagaagggatgaggccaaggctgccttcaattagaagcagccgcccacagagacaggcactgtgtgcctggcagcaggacttcctacccagaggaggttcgagctaggatcccactgcccccgcctctcagcacagggcaggggctgcaggtccccagtggacatcagagtcaaaagcactggcaaagggtacccctgcaaacaactgtggtgggggctggcagcagaccccccacctggcagggcttctaatgctcagggttctggagggctctgtccttccggcaaggagaggcacacatgtgtgcccagccgtgtgtgtgcgtgtgcttgtgtgtgtgcactgctgtgtgtgtgtgcacgcacaggaagcctttccacatatcacctcatttctaagaaataaactacaaggtgccaagaaggttttatttccttttattttttaaagatgacaaatgtacagatgttaatatatttttggtgccaatggcgatgtttttaagagtgggatggagctggcttttctccattcccgtgcgcttctatttatcctggacatttcaaacctcctctgtgccttggctctgggcgggggctgccccaacccacccccgttctttgtacgtgctgagacagccactagaagatcttcctccagcggcgccctggacggctgctcctgcgaacagcccatggcatcttctgctcttccctcccggctctgccctgcacatcctgttgagccaagccccagtgacccggagagctggcctgatgctgagagtgtgtcctcctggggctttagggggcaggaaggtgggacgaatgacgatgcccatccactacctgaagcactaggacactcttgcagggccaggctggaagaccggcccttttcttggttgagtcaaaagccttagcacagtggcaaaaaatgggacagaatgatgaccagcacctcagaaacttccagagggaggagaggatttgatggctaccaaattgtatctgttgccttttttctgactttttcacctgaccaggctggggtttggagtggctgtggggagacccgtcctggctggctggctggctcccttgctcccttgctgcagctgggaaaggggttctgggtgtaaagaggtgtgcgtcttgtgggccaaagggaaaaacaggcaggggtcagagccagcctgccagaggcaaatgcaaaagaggtccccagaacacagccagctgggcagccccttaaagccaaaccccacctgaagcagaaccactttggcctcccctgcccaaaatgggtagtgtctacacgtccccgggctcaggctcaggcccagccctgggctgacctgagaggaaggctccttcctggactgccctctgaaatgtgtatagattgattctaaaatctcttgtttcacttgactttagagtgtctgggacgctgctgtattctgaaagtcacatagcacacagtaatgttatctggaagctctgtttttgtttacatttctgtatccctgggttgactgccaatccgaggccgtcatgaagctctgtgttgtctgttttattttataaccttcctctcaactattaaaattagagatctaatgttt

SEQ ID NO: 163026 - DNA, 1774 bp, Homo sapiens
  Payload ID: 12128
  Gene Symbol: OVOL1
  Gene Name: ovo-like zinc finger 1
  ENST ID: ENST00000532448
  CDS Start-End: 409-1026
gaattcagagggaccagcccaggtggggcaggcagaaaactccggagggataattggcagggcagttcggtcctcccagttccgctaagacacaaattactcagcgggcagtggcgcttggctggcatcacctgcaattaccttaatagggcgggaaggcggtgcagcagtggtggtcggggcagccccgctctgctgcatgcctgcgatgggagggacggagtctccaggttccagccgtctcatggctagggaagtttccagaaacccgctggaccctctcttctccaccaagcctctcacctgtctgttctctccccagtcagcctgggcttctgcccaccacagccctaccgggagccggaaccctctgtggccgaacccccttcctgcccgctggctttgaacatgagccttcgagactctagctacagcatggcccccgggccctgtgtggtggcccagctgccctctgaagacatgggccacttgacagacccccagagcagagaccatggcttcctgcgcaccaagatgaaggtgacccttggggacagtcccagtggagacctgttcacctgccgtgtctgccagaaggccttcacctaccagcgcatgctgaaccgccacatgaagtgtcacaacgacgtcaagaggcacctctgcacgtactgcgggaagggcttcaatgacaccttcgacctcaagagacacgtccgaactcacactggcgtgcggccctacaagtgcagcctgtgtgacaaggccttcacgcagcgctgctctctggagtctcacctcaagaagatccatggtgtgcagcagaagtacgcgtacaaggagcggcgggccaagctgtacgtgtgtgaggagtgcggctgcacatctgagagccaggagggccacgtcctgcacctgaaggagcaccaccctgacagcccgctgctgcgcaagacctccaagaaggtggccgtggcactacagaacactgtcacttccctgctgcagggcagcccccacctgtgagtggctcgagccctgggggtgctcctggaagccccaagagcatccaggattgcctcccagctgcctggccagcccaccctcctgcaacctctcacccgaacaccagtgatcaggactggagcccccgtgccttggtctcccccctgggcacacgtgctcactcaggcccagcaatgacctctgctcatttttgcatttttgacttatgggccgaggctgttctgagcctgggaagatgtacctatgtcaagagaagggatgaggccaaggctgccttcaattagaagcagccgcccacagagacaggcactgtgtgcctggcagcaggacttcctacccagaggaggttcgagctaggatcccactgcccccgcctctcagcacagggcaggggctgcaggtccccagtggacatcagagtcaaaagcactggcaaagggtacccctgcaaacaactgtggtgggggctggcagcagaccccccacctggcagggcttctaatgctcagggttctggagggctctgtccttccggcaaggagaggcacacatgtgtgcccagccgtgtgtgtgcgtgtgcttgtgtgtgtgcactgctgtgtgtgtgtgcacgcacaggaagcctttccacatatcacctcatttctaagaaataaactacaaggtgccaagaaggttttatttccttttattttttaaagatgacaaatgtacagatgttaatatatttttggtgccaatggcgatg

SEQ ID NO: 163027 - DNA, 1555 bp, Homo sapiens
  Payload ID: 12129
  Gene Symbol: OVOL2
  Gene Name: ovo-like zinc finger 2
  Uniprot ID: Q9BRP0
  ENST ID: ENST00000278780
  CDS Start-End: 244-1071
ttttccccggcgtggtctcactcgcgatttaaggcataggtgtcgccgagccgggaggctgggagtcgccaggcgtgcgggggagaggcctgggccgcgccgcggcggggggtggaggaagagggcaggcgaggcgggaaggtgggctctggccgccgggagccggggacggagccgccgccgttgcccctagcggggagcagccgggaggagggggccgcagtcgggagaggggaccccaccatgcccaaagtcttcctggtgaagaggaggagcctgggggtctcggtccgcagctgggatgagctcccggatgagaaaagggcagacacctacatcccagtgggcctaggccgcctgctccacgacccccccgaggactgccgcagcgacggcggcagcagcagcggcagcggcagcagcagcgcgggggagcctggaggagcagagagcagctcgtccccgcacgcccccgagagcgaaacccccgagcccggcgacgccgagggccccgatggacacctggcgaccaagcagcgcccggtcgccagatcgaaaatcaagttcaccacaggcacgtgcagcgactcggtggttcacagctgtgacctgtgtggcaagggcttccgtctgcagcgcatgctgaaccgtcacctcaagtgccacaaccaggtgaaaagacacctgtgcaccttctgcggcaagggcttcaacgacaccttcgacctgaagaggcacgtccgcacacacacaggcattcgtccctacaaatgcaacgtctgcaataaagccttcacccagcgctgctctctggagtcccacctgaagaaaatccatggggtgcagcagcagtatgcctataagcagcggcgggacaagctctacgtctgcgaggattgcggctacacgggccccacccaggaggacctgtacctgcacgtgaacagtgcccatccgggcagctcgtttctcaaaaagacatctaaaaaactggcagcccttctgcagggcaagctgacatccgcacaccaggagaataccagcctgagtgaggaggaggagaggaagtgaggagaaggaaggggaggacagacgttcacactgccacgtatgtctacgtggatttttggttttcagcttcccccaccccactggctcttcttaattagaagtgaccagttcacctctgtgtccttttgaaacatcagcagtagggtccattccaagattgtcagttgccgttagtgacgtcaggccctgtaacctgtgtcctgtctggcgcagttgctcacattcaccaaagtttgttttcatgatcctgatggccaagaacaccgtgtgggatttttttttcccccaaggattttcacacacggaaggagaggtatttcttagagagatcatcattttatggtgccttgaaataaaaatacttctacttgaaatgctgtttaagcaaggcaagtgaattttgttattctgaaagagtttacagaaactattttaataaatgaaatgttcttgtgaagcttttaaaagcaaaatggaacattga

SEQ ID NO: 163028 - DNA, 695 bp, Homo sapiens
  Payload ID: 12130
  Gene Symbol: OVOL3
  Gene Name: ovo-like zinc finger 3
  Uniprot ID: O00110
  ENST ID: ENST00000585332
  CDS Start-End: 1-645
atgccccgcgccttcctggtcaggagtcggcgtccacagccccccaactggggccatctgcctgaccagctccggggagatgcctatatcccaggtgggcccctcactgtgcctggaggtaaggggcaggagagacgcagtgtcaccatctggcttttctcctcagactgcagcagcctgggggggccaccggcacaacagtcgtccagtgtcagggatccgtggacagcgcagcccacacagggcaacctgacctctgctcccaggggccctgggacgctgggctgcccgctctgccctaaggccttccctctgcagcgcatgctgacaaggcacctcaagtgccacagccccgtgcgccgccacctgtgccgctgttgtggcaagggctttcatgacgccttcgatctcaagcgccacatgaggactcacactgggatccggcccttccgctgcagtgcttgcgggaaagcgtttacgcagcgctgctccctggaagctcaccttgctaaggtgcatggacagccggccagctacgcttaccgtgagcgccgcgagaagctgcacgtgtgcgaggactgcggcttcaccagctcccggcccgacacctacgcacagcaccgcgccctgcaccgcgcagcctgatacggtgtgccagcgtcctccccacgaggcaaataaacacagaaaactca

SEQ ID NO: 163029 - DNA, 675 bp, Homo sapiens
  Payload ID: 12130
  Gene Symbol: OVOL3
  Gene Name: ovo-like zinc finger 3
  ENST ID: ENST00000633214
  CDS Start-End: 53-625
gtctgacagcaggtggaagcagcccctgtgtgtggagagccttccggagggcatgccccgcgccttcctggtcaggagtcggcgtccacagccccccaactggggccatctgcctgaccagctccggggagatgcctatatcccagactgcagcagcctgggggggccaccggcacaacagtcgtccagtgtcagggatccgtggacagcgcagcccacacagggcaacctgacctctgctcccaggggccctgggacgctgggctgcccgctctgccctaaggccttccctctgcagcgcatgctgacaaggcacctcaagtgccacagccccgtgcgccgccacctgtgccgctgttgtggcaagggctttcatgacgccttcgatctcaagcgccacatgaggactcacactgggatccggcccttccgctgcagtgcttgcgggaaagcgtttacgcagcgctgctccctggaagctcaccttgctaaggtgcatggacagccggccagctacgcttaccgtgagcgccgcgagaagctgcacgtgtgcgaggactgcggcttcaccagctcccggcccgacacctacgcacagcaccgcgccctgcaccgcgcagcctgatacggtgtgccagcgtcctccccacgaggcaaataaacacagaaaactca

SEQ ID NO: 163030 - DNA, 4426 bp, Homo sapiens
  Payload ID: 12131
  Gene Symbol:
  Gene Name: OVOS2
  ENST ID: ENST00000621609
  CDS Start-End: 1-4302
atgacgggttcccatttgtcccatgactcatggcagtatgttctgctgattccttctgttctacaagaaggctctttggataaagcttgtgcccagctttttaatctcactgaatctgttgttttgacggtctccctcaactatggtgaggtccagaccaaaatatttgaagaaaatgttactggagaaaatttcttcaaatgcatcagctttgaggttcctcaggccagatctgacccactggcatttattacattttctgctaaaggagccactctcaacctggaagagaggagatctgtggcaatcagatccagagagaatgtggtctttgtacagactgataaacccacctacaagcctggacagaaagatgtaaatggcatcgctcagtttttcttggacacatatacgtttacatacccaaatatcactttgaaagatcctcaaaacaatcggatttttcaatggcaaaatgtgacttctttccgaaatattacccaactctcgttccaactgatttcagaaccaatgtttggagattactggattgttgtgaaaagaaactcaaggaagacagtgacacaccaatttgctgttaaaagatatgtgctgcccaagtttgaagttacggtcaatgcaccacaaacagtaactatttcagatgatgaattccaagtggatgtatgtgctaagtacacctttggccaacctgtgcaagggaaaacccaaatccgggtgtgcagagagtatttttcttcaagcaattgtgagaaaaatgacaatgaaatatgtgagcaatttattgcacagttggaaaatggttgtgtttctcaaattgtaaatacaaaagtcttccaactctaccgttcgggattgttcatgacatttcatgtcgctgtaattgttacagaatttgggacaggaaattactgtatgcagatcagtgagaagacctcagtttttatcactcaattgcttggaactgtaaactttgagaacatggatactttctacagaagagggatttcttattttggaactcttaaattttcggatcccaataatgtacctatggtgaacaagttgttgcaactggagctcaatgatgaatttataggaaattatactacggacgagaatggcgaagctcaattttccattgacacttcagacatatttgatccagagttcaacctaaaagccacatatgttcgacctaagagctgctatcttcccagctggttgacgcctcagtacttggatgctcacttcttagtctcacgcttttactcccgaacgaacagcttcctgaagattgttccagaaccaaagcagcttgaatgtaatcaccagaaggttgttactgtgcattactccctaaacagtgaagcatatgaggatgattccaatgtaaagttcttctatttggtaagtctcagtcatgattcaggaaactttcagcatcgtatctcttcgtctcctatttacacagcctggaatggaaacttctcgttcccactcagcatcagtgctgatctggctcctgcagccgtcctgtttgtctacacccttcaccccagtggggaaattgtggctgacagtgtcagattccaggttgacaagtgctttaaacacaaggttaacataaagttctctaacgagcagggcttacctggttccaatgctagtctctatcttcaagcggcgcctgtcttattctgtgccctcggggctgtggatgggaacgtccttctactgaaatctgaacaacagctgtcagctgaaagtgtgtataacatggttccaagtatagagccgtatggttatttctaccatggcctcaatcttgatgatggcaaggaagacccttgcattcctcagagggatatgttctacaatggtttatattacacacctgtaagcaactatggggatggagatatctataatattgtcaggaacatgggtctcaaagtctttaccaatctccattaccgaaaaccagaagtatgtgtgatggagagaaggctgccactccctaagccgctttatctagaaacagaaaattatggtccaatgcatagtgttccgtctagaattgcatgtagaggggagaatgctgactatgtagaacaggctataattcaaacagtaagaacaaacttcccagagacatggatgtgggacctcgtcagtgtcgattcctcaggctctgccaatctttcgttcctcattcctgatacgataacccaatgggaggcaagtggcttttgtgtgaatggcgacgttggatttggcatttcctctacaaccactctagaagtctcccaacctttctttattgaaattgcctcacccttttcggttgttcaaaatgaacaatttgatttgattgtcaatgccttcagctacctgaatacatgtgtagagatttctgttcaagtggaggagtctcagaattatgaagcaaatattaatacctggaaaatcaatggcagtgaggttattcaagctggagggaggaaaacaaacatctggactattatacctaagaaattgggtaaagtgaatatcactgtagttgctgagtccaaacaaagcagtgcttgcccaaatgaaggaatggagcagcaaaagctaaactggaaagacactgtggtcaaaagcttcttagtagagcctgaaggtattgaaaaggaaaggacccagagtttccttatctgtacagaaggtgccaaagcctccaagcagggagttttggacttgccaaatgatgtagtagaagggtcagccagaggctttttcactgttgtgggggatattctaggacttgccatgcagaatctggttgttctccaaatgccctatggaggtggagagcagaatgctgccctactagcatctgatacttatgttctggactatctgaaatctactgagcaactgacagaggaagttcaatctaaggctttctttctcttatctaatggttatcaaaggcaattatctttcaaaaactctgatggttcctatagtgtgttttggcagcagaatcagaaaggaagcatatggctcagtgctcttacttttaagacattggagagaatgaaaaaatttgtattcattgatgaaaatgttcaaaaacagaccttaatctggctttcaagccaacagaaaacaagcggctgctttaagaatgatggccagcttttcaaccacgcctgggagggtggagatgaagaggacatttcactcactgcatatgttgttgggatgttctttgaagctgggctcaattccacttttcctgctctacgaaacgcactcttttgccttgaagcggcattggacagtggtgtcactaatggctacaatcatgcaattctagcttatgcttttgccttagctggaaaagagaagcaagtggaatctttactccaaaccctggatcaatctgccacaaaactaaataatgtcatctactgggaaagagaaaggaaacccaagacagaagaatttccatcctttattccctgggcaccttctgctcagactgagaagagttgctatgtgctgttggctgtcatttcccggaaaattcctgacctcacctatgctagtaagattgtgcagtggcttgcccaacagatgaattcccatggaggcttttcttccaaccaggtgattaatgtaggcctgatattaatagcaatattgggggaagaggggctcttctctaagaatcaaaacactgtcacctttagcagtgaaggatccagtgagattttccaggttaacggtcataaccgcctactggtccaacgttcagaagtaacacaggcacctggacaatacacagtagatgtggaaggacgcggttgtacatttatccaggccacccttaagtacaatgttctcctacctaagaaggcatctggattttctctttccttggaaatagtaaagaactactctttgactgtttttgacctcacagtgaacctcaaatacactggaattcgcaataaatccagtatggtggttatagatgtaaaaatgctatcaggatttactccaaccatgtcatccattgaagagcttgaaaacaagggccaagtgatgaagactgaagtcaagaatgaccatgttcttttctacttggaaaatgtttttggtcgagcagacagtttcactttttctgttgagcagagcaaccttgtgttcaacattcagccagccccaggcatggtctacgattactacgaaaaagatggagaagcatttcttttaacaaactgattcttctgtatcaaacctggaaaaaaatcatgaaccatctgacatcgtgaacagtctgcagtgggctatggtttcttgacaagtcttatttccttatcatcccattaaatgttgtcattttgca

SEQ ID NO: 163031 - DNA, 4299 bp, Homo sapiens
  Payload ID: 12131
  Gene Symbol:
  Gene Name: OVOS2
  ENST ID: ENST00000632817
  CDS Start-End: 1-4299
atgacgggttcccatttgtcccatgactcatggcagtatgttctgctgattccttctgttctacaagaaggctctttggataaagcttgtgcccagctttttaatctcactgaatctgttgttttgacggtctccctcaactatggtgaggtccagaccaaaatatttgaagaaaatgttactggagaaaatttcttcaaatgcatcagctttgaggttcctcaggccagatctgacccactggcatttattacattttctgctaaaggagccactctcaacctggaagagaggagatctgtggcaatcagatccagagagaatgtggtctttgtacagactgataaacccacctacaagcctggacagaaagatgtaaatggcatcgctcagtttttcttggacacatatacgtttacatacccaaatatcactttgaaagatcctcaaaacaatcggatttttcaatggcaaaatgtgacttctttccgaaatattacccaactctcgttccaactgatttcagaaccaatgtttggagattactggattgttgtgaaaagaaactcaaggaagacagtgacacaccaatttgctgttaaaagatatgtgctgcccaagtttgaagttacggtcaatgcaccacaaacagtaactatttcagatgatgaattccaagtggatgtatgtgctaagtacacctttggccaacctgtgcaagggaaaacccaaatccgggtgtgcagagagtatttttcttcaagcaattgtgagaaaaatgacaatgaaatatgtgagcaatttattgcacagttggaaaatggttgtgtttctcaaattgtaaatacaaaagtcttccaactctaccgttcgggattgttcatgacatttcatgtcgctgtaattgttacagaatttgggacaggaaattactgtatgcagatcagtgagaagacctcagtttttatcactcaattgcttggaactgtaaactttgagaacatggatactttctacagaagagggatttcttattttggaactcttaaattttcggatcccaataatgtacctatggtgaacaagttgttgcaactggagctcaatgatgaatttataggaaattatactacggacgagaatggcgaagctcaattttccattgacacttcagacatatttgatccagagttcaacctaaaagccacatatgttcgacctaagagctgctatcttcccagctggttgacgcctcagtacttggatgctcacttcttagtctcacgcttttactcccgaacgaacagcttcctgaagattgttccagaaccaaagcagcttgaatgtaatcaccagaaggttgttactgtgcattactccctaaacagtgaagcatatgaggatgattccaatgtaaagttcttctatttggtaagtctcagtcatgattcaggaaactttcagcatcgtatctcttcgtctcctatttacacagcctggaatggaaacttctcgttcccactcagcatcagtgctgatctggctcctgcagccgtcctgtttgtctacacccttcaccccagtggggaaattgtggctgacagtgtcagattccaggttgacaagtgctttaaacacaaggttaacataaagttctctaacgagcagggcttacctggttccaatgctagtctctatcttcaagcggcgcctgtcttattctgtgccctcggggctgtggatgggaacgtccttctactgaaatctgaacaacagctgtcagctgaaagtgtgtataacatggttccaagtatagagccgtatggttatttctaccatggcctcaatcttgatgatggcaaggaagacccttgcattcctcagagggatatgttctacaatggtttatattacacacctgtaagcaactatggggatggagatatctataatattgtcaggaacatgggtctcaaagtctttaccaatctccattaccgaaaaccagaagtatgtgtgatggagagaaggctgccactccctaagccgctttatctagaaacagaaaattatggtccaatgcatagtgttccgtctagaattgcatgtagaggggagaatgctgactatgtagaacaggctataattcaaacagtaagaacaaacttcccagagacatggatgtgggacctcgtcagtgtcgattcctcaggctctgccaatctttcgttcctcattcctgatacgataacccaatgggaggcaagtggcttttgtgtgaatggcgacgttggatttggcatttcctctacaaccactctagaagtctcccaacctttctttattgaaattgcctcacccttttcggttgttcaaaatgaacaatttgatttgattgtcaatgccttcagctacctgaatacatgtgtagagatttctgttcaagtggaggagtctcagaattatgaagcaaatattaatacctggaaaatcaatggcagtgaggttattcaagctggagggaggaaaacaaacatctggactattatacctaagaaattgggtaaagtgaatatcactgtagttgctgagtccaaacaaagcagtgcttgcccaaatgaaggaatggagcagcaaaagctaaactggaaagacactgtggtcaaaagcttcttagtagagcctgaaggtattgaaaaggaaaggacccagagtttccttatctgtacagaaggtgccaaagcctccaagcagggagttttggacttgccaaatgatgtagtagaagggtcagccagaggctttttcactgttgtgggggatattctaggacttgccatgcagaatctggttgttctccaaatgccctatggaggtggagagcagaatgctgccctactagcatctgatacttatgttctggactatctgaaatctactgagcaactgacagaggaagttcaatctaaggctttctttctcttatctaatggttatcaaaggcaattatctttcaaaaactctgatggttcctatagtgtgttttggcagcagaatcagaaaggaagcatatggctcagtgctcttacttttaagacattggagagaatgaaaaaatttgtattcattgatgaaaatgttcaaaaacagaccttaatctggctttcaagccaacagaaaacaagcggctgctttaagaatgatggccagcttttcaaccacgcctgggagggtggagatgaagaggacatttcactcactgcatatgttgttgggatgttctttgaagctgggctcaattccacttttcctgctctacgaaacgcactcttttgccttgaagcggcattggacagtggtgtcactaatggctacaatcatgcaattctagcttatgcttttgccttagctggaaaagagaagcaagtggaatctttactccaaaccctggatcaatctgccacaaaactaaataatgtcatctactgggaaagagaaaggaaacccaagacagaagaatttccatcctttattccctgggcaccttctgctcagactgagaagagttgctatgtgctgttggctgtcatttcccggaaaattcctgacctcacctatgctagtaagattgtgcagtggcttgcccaacagatgaattcccatggaggcttttcttccaaccaggtgattaatgtaggcctgatattaatagcaatatgcggggaagaggggctcttctctaagaatcaaaacactgtcacctttagcagtgaaggatccagtgagatccagtttaacggtcataaccgcctactggtccaacgttcagaagtaacacaggcacctggacaatacacagtagatgtggaaggacgcggttgtacatttatccaggccacccttaagtacaatgttctcctacctaagaaggcatctggattttctctttccttggaaatagtaaagaactactctttgactgtttttgacctcacagtgaacctcaaatacactggaattcgcaataaatccagtatggtggttatagatgtaaaaatgctatcaggatttactccaaccatgtcatccattgaagagcttgaaaacaagggccaagtgatgaagactgaagtcaagaatgaccatgttcttttctacttggaaaatgtttttggtcgagcagacagtttcactttttctgctgagcagagcaaccttgtgttcaacattcagccagccccaggcatggtctacgattattattggaagggtggagaagcatttcttttaacaaactga

SEQ ID NO: 163032 - DNA, 4423 bp, Homo sapiens
  Payload ID: 12131
  Gene Symbol:
  Gene Name: OVOS2
  ENST ID: ENST00000398963
  CDS Start-End: 1-4260
atgacgggttcccatttgtcccatgactcatggcagtatgttctgctgattccttctgttctacaagaaggctctttggataaagcttgtgcccagctttttaatctcactgaatctgttgttttgacggtctccctcaactatggtgaggtccagaccaaaatatttgaagaaaatgttactggagaaaatttcttcaaatgcatcagctttgaggttcctcaggccagatctgacccactggcatttattacattttctgctaaaggagccactctcaacctggaagagaggagatctgtggcaatcagatccagagagaatgtggtctttgtacagactgataaacccacctacaagcctggacagaaagatgtaaatggcatcgctcagtttttcttggacacatatacgtttacatacccaaatatcactttgaaagatcctcaaaacaatcggatttttcaatggcaaaatgtgacttctttccgaaatattacccaactctcgttccaactgatttcagaaccaatgtttggagattactggattgttgtgaaaagaaactcaaggaagacagtgacacaccaatttgctgttaaaagatatgtgctgcccaagtttgaagttacggtcaatgcaccacaaacagtaactatttcagatgatgaattccaagtggatgtatgtgctaagtacacctttggccaacctgtgcaagggaaaacccaaatccgggtgtgcagagagtatttttcttcaagcaattgtgagaaaaatgacaatgaaatatgtgagcaatttattgcacagttggaaaatggttgtgtttctcaaattgtaaatacaaaagtcttccaactctaccgttcgggattgttcatgacatttcatgtcgctgtaattgttacagaatttgggacaggaaattactgtatgcagatcagtgagaagacctcagtttttatcactcaattgcttggaactgtaaactttgagaacatggatactttctacagaagagggatttcttattttggaactcttaaattttcggatcccaataatgtacctatggtgaacaagttgttgcaactggagctcaatgatgaatttataggaaattatactacggacgagaatggcgaagctcaattttccattgacacttcagacatatttgatccagagttcaacctaaaagccacatatgttcgacctaagagctgctatcttcccagctggttgacgcctcagtacttggatgctcacttcttagtctcacgcttttactcccgaacgaacagcttcctgaagattgttccagaaccaaagcagcttgaatgtaatcaccagaaggttgttactgtgcattactccctaaacagtgaagcatatgaggatgattccaatgtaaagttcttctatttggtaagtctcagtcatgattcaggaaactttcagcatcgtatctcttcgtctcctatttacacagcctggaatggaaacttctcgttcccactcagcatcagtgctgatctggctcctgcagccgtcctgtttgtctacacccttcaccccagtggggaaattgtggctgacagtgtcagattccaggttgacaagtgctttaaacacaaggttaacataaagttctctaacgagcagggcttacctggttccaatgctagtctctatcttcaagcggcgcctgtcttattctgtgccctcggggctgtggatgggaacgtccttctactgaaatctgaacaacagctgtcagctgaaagtgtgtataacatggttccaagtatagagccgtatggttatttctaccatggcctcaatcttgatgatggcaaggaagacccttgcattcctcagagggatatgttctacaatggtttatattacacacctgtaagcaactatggggatggagatatctataatattgtcaggaacatgggtctcaaagtctttaccaatctccattaccgaaaaccagaagtatgtgtgatggagagaaggctgccactccctaagccgctttatctagaaacagaaaattatggtccaatgcatagtgttccgtctagaattgcatgtagaggggagaatgctgactatgtagaacaggctataattcaaacagtaagaacaaacttcccagagacatggatgtgggacctcgtcagtgtcgattcctcaggctctgccaatctttcgttcctcattcctgatacgataacccaatgggaggcaagtggcttttgtgtgaatggcgacgttggatttggcatttcctctacaaccactctagaagtctcccaacctttctttattgaaattgcctcacccttttcggttgttcaaaatgaacaatttgatttgattgtcaatgccttcagctacctgaatacatgtgtagagatttctgttcaagtggaggagtctcagaattatgaagcaaatattaatacctggaaaatcaatggcagtgaggttattcaagctggagggaggaaaacaaacatctggactattatacctaagaaattgggtaaagtgaatatcactgtagttgctgagtccaaacaaagcagtgcttgcccaaatgaaggaatggagcagcaaaagctaaactggaaagacactgtggtcaaaagcttcttagtagagcctgaaggtattgaaaaggaaaggacccagagtttccttatctgtacagaaggtgccaaagcctccaagcagggagttttggacttgccaaatgatgtagtagaagggtcagccagaggctttttcactgttgtgggggatattctaggacttgccatgcagaatctggttgttctccaaatgccctatggaggtggagagcagaatgctgccctactagcatctgatacttatgttctggactatctgaaatctactgagcaactgacagaggaagttcaatctaaggctttctttctcttatctaatggttatcaaaggcaattatctttcaaaaactctgatggttcctatagtgtgttttggcagcagaatcagaaaggaagcatatggctcagtgctcttacttttaagacattggagagaatgaaaaaatttgtattcattgatgaaaatgttcaaaaacagaccttaatctggctttcaagccaacagaaaacaagcggctgctttaagaatgatggccagcttttcaaccacgcctgggagggtggagatgaagaggacatttcactcactgcatatgttgttgggatgttctttgaagctgggctcaattccacttttcctgctctacgaaacgcactcttttgccttgaagcggcattggacagtggtgtcactaatggctacaatcatgcaattctagcttatgcttttgccttagctggaaaagagaagcaagtggaatctttactccaaaccctggatcaatctgccacaaaactaaataatgtcatctactgggaaagagaaaggaaacccaagacagaagaatttccatcctttattccctgggcaccttctgctcagactgagaagagttgctatgtgctgttggctgtcatttcccggaaaattcctgacctcacctatgctagtaagattgtgcagtggcttgcccaacagatgaattcccatggaggcttttcttccaaccaggtgattaatgtaggcctgatattaatagcaatatgcggggaagaggggctcttctctaagaatcaaaacactgtcacctttagcagtgaaggatccagtgagatccagtttaacggtcataaccgcctactggtccaacgttcagaagtaacacaggcacctggacaatacacagtagatgtggaaggacgcggttgtacatttatccaggccacccttaagtacaatgttctcctacctaagaaggcatctggattttctctttccttggaaatagtaaagaactactctttgactgtttttgacctcacagtgaacctcaaatacactggaattcgcaataaatccagtatggtggttatagatgtaaaaatgctatcaggatttactccaaccatgtcatccattgaagagcttgaaaacaagggccaagtgatgaagactgaagtcaagaatgaccatgttcttttctacttggaaaatgtttttggtcgagcagacagtttcactttttctgctgagcagagcaaccttgtgttcaacattcagccagccccaggcatggtctacgattagtacgaaaaaggtggagaagcatttcttttaacaaactgattcttctgtatcaaacctggaaaaaaatcatgaaccatctgacatcgtgaacagtctgcagtgggctatggtttcttgacaagtcttatttccttatcatcccattaaatgttgtcattttgca

SEQ ID NO: 163033 - DNA, 1719 bp, Homo sapiens
  Payload ID: 12132
  Gene Symbol: OXA1L
  Gene Name: oxidase (cytochrome c) assembly 1-like
  ENST ID: ENST00000285848
  CDS Start-End: 1-1488
atggtaacgtggctttacagatttttacccacttcaaatatggccgccaagctccgttctcttttaccgcctgatctgcggctacaattctggcttcatgcccgcctccaaaagtgcttcctctcgaggggttgtggttcttactgcgcaggcgcaaaagcaagtcctcttccgggcaaaatggcgatgggactaatgtgcggacgccgggagcttctgcgcttgctacagtccgggcgtcgggtccacagcgtcgcagggccctcgcaatggcttgggaaaccgctgaccacacggctcctattcccagcagccccgtgctgctgtcgcccacactacctcttccttgcggcttccggcccccgcagcctcagtacctctgctatctcttttgcagaagtccaggttcaggcccctcctgttgttgctgcaactccctcacccacagcagtacctgaggtggcttctggagagactgcagatgtagtccaaactgctgcagagcagagcttcgctgaactggggctggggtcatacaccccagtgggactgatccagaatttactggaatttatgcatgttgatctgggcctaccttggtggggggccattgctgcatgtacagtctttgcccgctgcctgatttttcctctcatcgtgacgggccagcgagaggcagccaggatccacaatcacttgccagagatccagaagttttccagtcgaatcagagaggccaagttagcaggagaccatattgagtattacaaggcttcctcggagatggcactttaccagaaaaaacatggtattaaactctataaacctctcattctccctgtgactcaggccccaatcttcatctccttcttcattgctttgagagagatggccaaccttcctgtgcccagcctgcagacaggtggcctctggtggttccaggatctcacggtatccgatcccatctacatattaccactggcagtcactgctacaatgtgggctgttcttgagctaggtgctgagacaggtgtgcaaagttctgaccttcagtggatgagaaatgtcatcagaatgatgcccctgataaccttgcccataaccatgcatttccccacggcagtgtttatgtactggctctcctccaatttgttttccctggtccaagtatcctgtctccggattccagcagtacgcactgtacttaaaatcccccagcgtgttgtacatgacctggacaaattacctccacgggaaggcttcctagagagcttcaaaaaaggctggaaaaatgctgaaatgacgcgtcagctgcgagagcgtgaacaacgcatgcggaatcagttggagctagcagccaggggtcctttacgacagacctttacccacaaccctctcctacaacctggaaaggataaccctcccaatatccctagcagcagcagcaaaccaaagtcaaagtatccctggcacgacacacttggctgacttatgttctgtgcgcattctggcaggaattctgtctcttcagagactcatcctcaaaacaagacttgacactgtgtccttgccccagtcctaggaactgtggcacacagagatgttcattttaaaaacggatttcatgaaacactcttgtacttatgtttataagagagcactgggtagccaagtgatcttcccattcacagagttagtaaacctctgtactacatgctg

SEQ ID NO: 163034 - DNA, 1750 bp, Homo sapiens
  Payload ID: 12132
  Gene Symbol: OXA1L
  Gene Name: oxidase (cytochrome c) assembly 1-like
  Uniprot ID: Q15070
  ENST ID: ENST00000358043
  CDS Start-End: 319-1578
gtgcggacgccgggagcttctgcgcttgctacagtccgggcgtcgggtaaggatgccccggggcagagcaccgggatgctgccctgacccagtgaaccaggccccaggacagctcgtgctaggggtatcagcagacgctgacctgctcaccgggacctgaatgtcatgacctcgggtcatgtgaggacgcgctagggttagtccccgacactatgggcccagcagcccggtgtcagcttctggaattggcttggctcctggcgagagcacctcggcctcgttctcagggccctccgatgtgggtctgcgataactgagatgcggggaacccaggtccacagcgtcgcagggccctcgcaatggcttgggaaaccgctgaccacacggctcctattcccagcagccccgtgctgctgtcgcccacactacctcttccttgcggcttccggcccccgcagcctcagtacctctgctatctcttttgcagaagtccaggttcaggcccctcctgttgttgctgcaactccctcacccacagcagtacctgaggtggcttctggagagactgcagatgtagtccaaactgctgcagagcagagcttcgctgaactggggctggggtcatacaccccagtgggactgatccagaatttactggaatttatgcatgttgatctgggcctaccttggtggggggccattgctgcatgtacagtctttgcccgctgcctgatttttcctctcatcgtgacgggccagcgagaggcagccaggatccacaatcacttgccagagatccagaagttttccagtcgaatcagagaggccaagttagcaggagaccatattgagtattacaaggcttcctcggagatggcactttaccagaaaaaacatggtattaaactctataaacctctcattctccctgtgactcaggccccaatcttcatctccttcttcattgctttgagagagatggccaaccttcctgtgcccagcctgcagacaggtggcctctggtggttccaggatctcacggtatccgatcccatctacatattaccactggcagtcactgctacaatgtgggctgttcttgagctaggtgctgagacaggtgtgcaaagttctgaccttcagtggatgagaaatgtcatcagaatgatgcccctgataaccttgcccataaccatgcatttccccacggcagtgtttatgtactggctctcctccaatttgttttccctggtccaagtatcctgtctccggattccagcagtacgcactgtacttaaaatcccccagcgtgttgtacatgacctggacaaattacctccacgggaaggcttcctagagagcttcaaaaaaggctggaaaaatgctgaaatgacgcgtcagctgcgagagcgtgaacaacgcatgcggaatcagttggagctagcagccaggggtcctttacgacagacctttacccacaaccctctcctacaacctggaaaggataaccctcccaatatccctagcagcagcagcaaaccaaagtcaaagtatccctggcacgacacacttggctgacttatgttctgtgcgcattctggcaggaattctgtctcttcagagactcatcctcaaaacaagacttgacactgtgtccttgccccagtcctaggaactgtggcacacagagatgttcattttaaaaacggatttcatgaaacactcttgtacttatgtttataagagagca

SEQ ID NO: 163035 - DNA, 1440 bp, Homo sapiens
  Payload ID: 12132
  Gene Symbol: OXA1L
  Gene Name: oxidase (cytochrome c) assembly 1-like
  ENST ID: ENST00000412791
  CDS Start-End: 1-1227
atggcgatgggactaatgtgcggacgccgggagcttctgcgcttgctacagtccgggcgtcgggtccacagcgtcgcagggccctcgcaatggcttgggaaaccgctgaccacacggctcctattcccagcagccccgtgctgctgtcgcccacactacctcttccttgcggcttccggcccccgcagcctcagtacctctgctatctcttttgcagaagtccaggttcaggcccctcctgttgttgctgcaactccctcacccacagcagtacctgaggtggcttctggagagactgcagatgtagtccaaactgctgcagagcagagcttcgctgaactggggctggggtcatacaccccagtgggactgatccagaatttactggaatttatgcatgttgatctgggcctaccttggtggggggccattgctgcatgtacagtctttgcccgctgcctgatttttcctctcatcgtgacgggccagcgagaggcagccaggatccacaatcacttgccagagatccagaagttttccagtcgaatcagagaggccaagttagcaggagaccatattgagtattacaaggcttcctcggagatggcactttaccagaaaaaacatggtattaaactctataaacctctcattctccctgtgactcaggccccaatcttcatctccttcttcattgctttgagagagatggccaaccttcctgtgcccagcctgcagacaggtggcctctggtggttccaggatctcacggtatccgatcccatctacatattaccactggcagtcactgctacaatgtgggctgttcttgagctaggtgctgagacaggtgtgcaaagttctgaccttcagtggatgagaaatgtcatcagaatgatgcccctgataaccttgcccataaccatgcatttccccacggcagtgtttatgtactggctctcctccaatttgttttccctggtccaagtatcctgtctccggattccagcagtacgcactgtacttaaaatcccccagcgtgttgtacatgacctggacaaattacctccacgggaaggcttcctagagagcttcaaaaaaggtcctttacgacagacctttacccacaaccctctcctacaacctggaaaggataaccctcccaatatccctagcagcagcagcaaaccaaagtcaaagtatccctggcacgacacacttggctgacttatgttctgtgcgcattctggcaggaattctgtctcttcagagactcatcctcaaaacaagacttgacactgtgtccttgccccagtcctaggaactgtggcacacagagatgttcattttaaaaacggatttcatgaaacactcttgtacttatgtttataagagagcactgggtagccaagtgatcttcccattcacagagttagtaaa

SEQ ID NO: 163036 - DNA, 691 bp, Homo sapiens
  Payload ID: 12132
  Gene Symbol: OXA1L
  Gene Name: oxidase (cytochrome c) assembly 1-like
  ENST ID: ENST00000442110
  CDS Start-End: 1-249
cttccgggcaaaatggcgatgggactaatgtgcggacgccgggagcttctgcgcttgctacagtccgggcgtcggccccgtgctgctgtcgcccacactacctcttccttgcggcttccggcccccgcagcctcagtacctctgctatctcttttgcagaagtccaggttcaggcccctcctgttgttgctgcaactccctcacccacagcagtacctgaggtggcttctggagagactgcagatgtagtccaaactgctgcagagcagagcttcgctgaactggggctggggtcatacaccccagtgggactgatccagaatttactggaatttatgcatgttgatctgggcctaccttggtggggggccattgctgcatgtacagtctttgcccgctgcctgatttttcctctcatcgtgacgggccagcgagaggcagccaggatccacaatcacttgccagagatccagaagttttccagtcgaatcagagaggccaagttagcaggagaccatattgagtattacaaggcttcctcggagatggcactttaccagaaaaaacatggtattaaactctataaacctctcattctccctgtgactcaggccccaatcttcatctccttcttcattgctttgagagagatggccaaccttcctgtgcccagcctgcagacaggtggcct

SEQ ID NO: 163037 - DNA, 889 bp, Homo sapiens
  Payload ID: 12132
  Gene Symbol: OXA1L
  Gene Name: oxidase (cytochrome c) assembly 1-like
  ENST ID: ENST00000431881
  CDS Start-End: 554-889
tccgggcaaaatggcgatgggactaatgtgcggacgccgggagcttctgcgcttgctacagtccgggcgtcgggtaaggatgccccggggcagagcaccgggatgctgccctgacccagtgaaccaggccccaggacagctcgtgctaggggtatcagcagacgctgacctgctcaccgggacctgaatgtcatgacctcgggtcatgtgaggacgcgctagggtccacagcgtcgcagggccctcgcaatggcttgggaaaccgctgaccacacggctcctattcccagcagccccgtgctgctgtcgcccacactacctcttccttgcggcttccggcccccgcagcctcagtacctctgctatctcttttgcagaagtccaggttcaggcccctcctgttgttgctgcaactccctcacccacagcagtacctgaggtggcttctggagagactgcagatgtagtccaaactgctgcagagcagagcttcgctgaactggggctggggtcatacaccccagtgggactgatccagaatttactggaatttatgcatgttgatctgggcctaccttggtggggggccattgctgcatgtacagtctttgcccgctgcctgatttttcctctcatcgtgacgggccagcgagaggcagccaggatccacaatcacttgccagagatccagaagttttccagtcgaatcagagaggccaagttagcaggagaccatattgagtattacaaggcttcctcggagatggcactttaccagaaaaaacatggtattaaactctataaacctctcattctccctgtgactcaggccccaatcttcatctccttcttcattgctttgagagagatggccaaccttcctgtgccc

SEQ ID NO: 163038 - DNA, 1571 bp, Homo sapiens
  Payload ID: 12132
  Gene Symbol: OXA1L
  Gene Name: oxidase (cytochrome c) assembly 1-like
  ENST ID: ENST00000604262
  CDS Start-End: 24-1331
aagcaagtcctcttccgggcaaaatggcgatgggactaatgtgcggacgccgggagcttctgcgcttgctacagtccgggcgtcgggtccacagcgtcgcagggccctcgcaatggcttgggaaaccgctgaccacacggctcctattcccagcagccccgtgctgctgtcgcccacactacctcttccttgcggcttccggcccccgcagcctcagtacctctgctatctcttttgcagaagtccaggttcaggcccctcctgttgttgctgcaactccctcacccacagcagtacctgaggtggcttctggagagactgcagatgtagtccaaactgctgcagagcagagcttcgctgaactggggctggggtcatacaccccagtgggactgatccagaatttactggaatttatgcatgttgatctgggcctaccttggtggggggccattgctgcatgtacagtctttgcccgctgcctgatttttcctctcatcgtgacgggccagcgagaggcagccaggatccacaatcacttgccagagatccagaagttttccagtcgaatcagagaggccaagttagcaggagaccatattgagtattacaaggcttcctcggagatggcactttaccagaaaaaacatggtattaaactctataaacctctcattctccctgtgactcaggccccaatcttcatctccttcttcattgctttgagagagatggccaaccttcctgtgcccagcctgcagacaggtggcctctggtggttccaggatctcacggtatccgatcccatctacatattaccactggcagtcactgctacaatgtgggctgttcttgagctaggtgctgagacaggtgtgcaaagttctgaccttcagtggatgagaaatgtcatcagaatgatgcccctgataaccttgcccataaccatgcatttccccacggcagtgtttatgtactggctctcctccaatttgttttccctggtccaagtatcctgtctccggattccagcagtacgcactgtacttaaaatcccccagcgtgttgtacatgacctggacaaattacctccacgggaaggcttcctagagagcttcaaaaaaggctggaaaaatgctgaaatgacgcgtcagctgcgagagcgtgaacaacgcatgcggaatcagttggagctagcagccaggggtcctttacgacagacctttacccacaaccctctcctacaacctggaaaggataaccctcccaatatccctagcagcagcagcaaaccaaagtcaaagtatccctggcacgacacacttggctgacttatgttctgtgcgcattctggcaggaattctgtctcttcagagactcatcctcaaaacaagacttgacactgtgtccttgccccagtcctaggaactgtggcacacagagatgttcattttaaaaacggatttcatgaaacactcttgtacttatgtttataagagagcactgggtagccaagtgatcttcccattcacagagttagtaaacctctgtactacatgctgcttcctgat

SEQ ID NO: 163039 - DNA, 2971 bp, Homo sapiens
  Payload ID: 12132
  Gene Symbol: OXA1L
  Gene Name: oxidase (cytochrome c) assembly 1-like
  ENST ID: ENST00000612549
  CDS Start-End: 1-1488
atggtaacgtggctttacagatttttacccacttcaaatatggccgccaagctccgttctcttttaccgcctgatctgcggctacaattctggcttcatgcccgcctccaaaagtgcttcctctcgaggggttgtggttcttactgcgcaggcgcaaaagcaagtcctcttccgggcaaaatggcgatgggactaatgtgcggacgccgggagcttctgcgcttgctacagtccgggcgtcgggtccacagcgtcgcagggccctcgcaatggcttgggaaaccgctgaccacacggctcctattcccagcagccccgtgctgctgtcgcccacactacctcttccttgcggcttccggcccccgcagcctcagtacctctgctatctcttttgcagaagtccaggttcaggcccctcctgttgttgctgcaactccctcacccacagcagtacctgaggtggcttctggagagactgcagatgtagtccaaactgctgcagagcagagcttcgctgaactggggctggggtcatacaccccagtgggactgatccagaatttactggaatttatgcatgttgatctgggcctaccttggtggggggccattgctgcatgtacagtctttgcccgctgcctgatttttcctctcatcgtgacgggccagcgagaggcagccaggatccacaatcacttgccagagatccagaagttttccagtcgaatcagagaggccaagttagcaggagaccatattgagtattacaaggcttcctcggagatggcactttaccagaaaaaacatggtattaaactctataaacctctcattctccctgtgactcaggccccaatcttcatctccttcttcattgctttgagagagatggccaaccttcctgtgcccagcctgcagacaggtggcctctggtggttccaggatctcacggtatccgatcccatctacatattaccactggcagtcactgctacaatgtgggctgttcttgagctaggtgctgagacaggtgtgcaaagttctgaccttcagtggatgagaaatgtcatcagaatgatgcccctgataaccttgcccataaccatgcatttccccacggcagtgtttatgtactggctctcctccaatttgttttccctggtccaagtatcctgtctccggattccagcagtacgcactgtacttaaaatcccccagcgtgttgtacatgacctggacaaattacctccacgggaaggcttcctagagagcttcaaaaaaggctggaaaaatgctgaaatgacgcgtcagctgcgagagcgtgaacaacgcatgcggaatcagttggagctagcagccaggggtcctttacgacagacctttacccacaaccctctcctacaacctggaaaggataaccctcccaatatccctagcagcagcagcaaaccaaagtcaaagtatccctggcacgacacacttggctgacttatgttctgtgcgcattctggcaggaattctgtctcttcagagactcatcctcaaaacaagacttgacactgtgtccttgccccagtcctaggaactgtggcacacagagatgttcattttaaaaacggatttcatgaaacactcttgtacttatgtttataagagagcactgggtagccaagtgatcttcccattcacagagttagtaaacctctgtactacatgctgcttcctgatacttattgaacagggaaatcagtgtgcacttcagaaaactgaagaatacccagcattttgggaggccgaggtgggtggatcacctgagatcaggagtttgagaccagcctggccaacatggggaaacgccatctctgctgttttacaaaaatagccacacgtggtggtgcacacctgtagtcccagctactcgggaggctgaggcaggagaattgcttgaatccgagaggcggaggttgcagtgagccaagatcgcaccaccgcactccagcctgggcaatagagggagactgtctcaaaaaaaaaagaaaactgaagaatagagtgagtcatgattgcttttgctggcccatggccttggaaaatataatgttttaacctggcattaagggtttaaacttccacccaggcgcagtggctcacgccagtaatcccagcacttttgggaggccaaggcgggcggatcacgaagtcagcagatcgagaccatcctggccaacatggtgaaaccccgtctctactaaaaaaaaaaaaaaaaaaattagccgggcatggcggcgggtgcctgtattcccagctacttgggaggctgaggcaggagaatggcgtgaacccaggaggcagagcttgcagtgagccgagattgcgccactgcactccagcctgggcaagagagtgagactccttctcaaaaaaaaaaaaaaaaaaaaaaaaaaaaaaacagtttaaacttccaacccatgcatgtgttgttctatgcacatttggattgcagtctagaggtgtggctgataagttgaatgttgagattgtatctaaatatagtaaccgcacttcttgatcccaagattactttaaaaatttcaagaagtagatgtgtgcaaattcttagtgataattaagaatgaaagttccaggctgggcaaagtggctcacacctataatctcagcactttgggaggctgaggtgggtagatcacttgagtccaggaatttgagaccagcctgggcaacatggcgagaccttgtctctgctaaaaagttagctgagcatggtggtgcttgtccatagtcccagctacctgggaggctgaggtgggaggatagcttaagcccaggaggttgaggctgcagtgatccaagatcatgctgctatactccagccttggctacagagcaagatcctgtctcaaaaaggaagttcatgtcatttttatgtaacaatccaacatttgactagagc

SEQ ID NO: 163040 - DNA, 1944 bp, Homo sapiens
  Payload ID: 12133
  Gene Symbol: OXR1
  Gene Name: oxidation resistance 1
  Uniprot ID: Q8N573
  ENST ID: ENST00000297447
  CDS Start-End: 138-869
aaatctttgtctctagcaaactgttttgtcactgtagtaaggctctagtgctggaaatttatctttgacagaggaagaatgcttttgaaaacagttcttacgtgattttatgtaacttaatttgccctggaaaggaaatgtctcgtctctggtatgggaaaaaagggagaagacatcaaccaattaatcataaatacactctggtagtgtcagtggctgagtatcaccgcaggatcgatgctctaaatactgaagaactgcgcacactctgcagacgcctccagattactacaagggaagacataaattcaaagcaggttgctacagtgaaagcagacctggagtctgaatcttttcgaccaaacctaagtgatcccagtgaacttttactgccagatcaaattgaaaagcttaccaagcatcttccaccaagaacaattggctatccatggactcttgtttatggtactggaaaacatggcacaagcttgaaaactctttatcgaacaatgacaggtttagacaccccagtgctgatggtgattaaagacagtgatggacaggtttttggtgcgttagcatctgagccactgaaagtgagtgatggcttttatggtactggagagacctttgtttttacattctgtccggagtttgaggtctttaagtggacaggagataatatgttttttatcaaaggagacatggattcactagctttcggtggtggaggaggagaatttgcgctttggcttgatggagatctctaccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtatcaccatttattacagttataattttggagtttatttttcaaatcatgttcttgtcccagagttctttaggttaacactagggactgcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggatacttctgtatctgtgaagttggcacaggtaacatttggacatgttcatcttattcttaggaaggaaaaaatcacttgccaaaataatacatacttcatagaccactgagttctagtttttattcacactacaacattctctttaacgatgttgcaggtattctcaatttccttttaagaaaaatgaaatgtgaggagaattctggttgtaatagatgacagtacatatgatctgcaggtttgggcatatgctttcatcattaaattatctgataaagttacaagtcacaaaggagaatgagaacttaatgattctattggatttaatatattagcaagaaaacatactatttacatatgtgtagcttagtaaggcattaacataagtacaaaaactatgaaacagatgcatatttcctcaacatactgtgtcaggtatactgttttataatttggttgttttagccttattgcacaccaactcccaaaatataggttactcttgttcaaaaggaaaaaaaaaattgtgattttctttgagtggtatatgttattaattaccattagcatttgctcttataaagggcaatgattatagtagacaatattgtaactcagtagacttgttgaatatgcaaacttactgtcaagtgacctcaaaaa

SEQ ID NO: 163041 - DNA, 4406 bp, Homo sapiens
  Payload ID: 12133
  Gene Symbol: OXR1
  Gene Name: oxidation resistance 1
  Uniprot ID: Q8N573
  ENST ID: ENST00000312046
  CDS Start-End: 134-2653
gcctcttgtgaggcgcgcggagccgcctcccctgggtcaggtctgatgggccggtgggcgcgctagtggtggccgccaccgccgaaaccgtcgacctcctgggccccagttccgcgtccagccccgcggcagcatggactacctgacgacgttcaccgagaagagtgggcgccttctgcggggcacggccaaccgcctgttggggttcgggggcggcggcgaagcccggcaggtgcgcttcgaagattacctgagggagccagcccagggggacctcgggtgcgggtccccgccccaccggcccccggcgccgtccagcccggagggacctgacactggccaaaagaagaccctagacaagaaagatggaagacgaatgtcttttcagaaacctaaagggactattgagtatactgttgaatcaagggattctttgaatagcatagccctgaagtttgatacaacacctaacgaacttgttcaattaaataagttattctcccgagcagttgttactggacaggttctgtatgttcctgatcctgaatatgtctccagtgttgagagctctccatctctaagccccgtaagtcctctgtcaccaacatcatctgaggctgaatttgataagaccactaatcctgatgtccatccaacagaagcaactccctcatctactttcactggtattcgacctgcacgagttgtatcttcaacttctgaggaggaggaagcatttactgagaaatttcttaaaattaattgcaaatatattaccagtggcaagggcacagtcagtggtgtgctgctagttacaccaaataatataatgtttgatccacataaaaatgaccctttggttcaagagaatggctgtgaggaatatggcatcatgtgtccaatggaagaggtgatgtcagctgcaatgtacaaagaaattttggatagcaaaataaaggaatctttacccatagatatagatcagctatcaggaagggacttctgccattcaaagaaaatgacaggaagtaacactgaggaaatagactcaagaatccgagatgcaggtaatgatagtgccagcactgctcctaggagcactgaggagtctctttctgaagatgtgttcacagaatcagaactttcccctatacgagaggagcttgtatcttcagatgaactgcgacaagataaatcttctggtgcgtcatcagaatctgtgcaaactgtcaatcaggctgaagtagaaagtctgacagtcaaatcagaatctactggtactcctggtcacttaagatctgatactgaacattctacaaatgaagttgggactttatgtcataaaactgatttaaataatcttgaaatggccattaaggaagatcagattgcagataactttcaaggaatatcaggtcctaaagaagacagcacaagtataaaaggtaattcagaccaggattcttttcttcatgagaattcgttacaccaagaagagagtcaaaaagaaaatatgccttgtggggaaacagcagaatttaaacaaaagcaaagtgttaacaaaggaaaacaaggaaaggagcaaaatcaggactcacagacagaggcagaagagctacgcaaactttggaaaacccatactatgcaacaaactaaacagcaaagggaaaatattcaacaagtgtcacaaaaagaagctaagcataaaattacatctgctgatggacacatagaaagttctgcacttttaaaagaaaagcaaaggcatcgattacataagttcttgtgtctcagagttggaaaaccaatgaggaaaacgtttgtatctcaagcaagtgctacaatgcaacagtatgcacagagagataagaaacatgaatattggtttgctgtgccacaagaaaggacagatcacttgtatgccttcttcattcagtggagtccagaaatatatgcagaagatactggcgaatataccagagaacctggatttatagtagtaaaaaagattgaggagtctgaaacaattgaggattctagtaatcaagcagcagccagagaatgggagattactacaagggaagacataaattcaaagcaggttgctacagtgaaagcagacctggagtctgaatcttttcgaccaaacctaagtgatcccagtgaacttttactgccagatcaaattgaaaagcttaccaagcatcttccaccaagaacaattggctatccatggactcttgtttatggtactggaaaacatggcacaagcttgaaaactctttatcgaacaatgacaggtttagacaccccagtgctgatggtgattaaagacagtgatggacaggtttttggtgcgttagcatctgagccactgaaagtgagtgatggcttttatggtactggagagacctttgtttttacattctgtccggagtttgaggtctttaagtggacaggagataatatgttttttatcaaaggagacatggattcactagctttcggtggtggaggaggagaatttgcgctttggcttgatggagatctctaccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtatcaccatttattacagttataattttggagtttatttttcaaatcatgttcttgtcccagagttctttaggttaacactagggactgcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggatacttctgtatctgtgaagttggcacaggtaacatttggacatgttcatcttattcttaggaaggaaaaaatcacttgccaaaataatacatacttcatagaccactgagttctagtttttattcacactacaacattctctttaacgatgttgcaggtattctcaatttccttttaagaaaaatgaaatgtgaggagaattctggttgtaatagatgacagtacatatgatctgcaggtttgggcatatgctttcatcattaaattatctgataaagttacaagtcacaaaggagaatgagaacttaatgattctattggatttaatatattagcaagaaaacatactatttacatatgtgtagcttagtaaggcattaacataagtacaaaaactatgaaacagatgcatatttcctcaacatactgtgtcaggtatactgttttataatttggttgttttagccttattgcacaccaactcccaaaatataggttactcttgttcaaaaggaaaaaaaaaattgtgattttctttgagtggtatatgttattaattaccattagcatttgctcttataaagggcaatgattatagtagacaatattgtaactcagtagacttgttgaatatgcaaacttactgtcaagtgacctcaaaaaaaaaatgaaaagatagaatacactagtagttcttatcctcttttgtaggaaaccaataatagccattgtggcaataattcatcagttgattttaaagcttcatgttatgcaaaaaagaatcctgctgttatacatgtgacagtgactttgtgctgaaatttcagctattccagataaacattgtatatcttgtaaattaatgtttaaaggtgtagttttgttcttacagaaagtgttgattgccaggttgcttatagcactttaagttattctaaaaatgaaattataagccaaatatttggcttaagtagatttagttgtatagcacttacatatttagttcttttgaaagtttagataattatttaaagaaagcataatgctaatggaaaagaaaatctgatgttctattataatatgctattgctgaatatgaatagaaatacagggcatcatttccttgtctcattataagttagtaacaatatatagattaaatgtttacaatatagggaattgtaaataaatatatcagtttttttccccttcggtcttccacagcagtattattgtctttgtggagttgactaatgataatttaaaaatcctgtaatggatttctactaaaataaggtcatagtggcatataccaaataaaatcaaatacagaaatacaaa

SEQ ID NO: 163042 - DNA, 2023 bp, Homo sapiens
  Payload ID: 12133
  Gene Symbol: OXR1
  Gene Name: oxidation resistance 1
  ENST ID: ENST00000435082
  CDS Start-End: 320-583
tttctgaccccgcatcggttccaggaagaatacacctatgtgacaagctaagttctgcctcattttgcatttagaagccacaagaaaaacttttcgaaaacttttgtccgtcttttgctcccccgacgcgtggtttcctgatggtccgtccccgggcagagagagggacgccccctcctcctccccgcctcttgtgaggcgcgcggagccgcctcccctgggtcaggtctgatgggccggtgggcgcgctagtggtggccgccaccgccgaaaccgtcgacctcctgggccccagttccgcgtccagccccgcggcagcatggactacctgacgacgttcaccgagaagagtgggcgccttctgcggggcacggccaaccgcctgttggggttcgggggcggcggcgaagcccggcaggtgcgcttcgaagattacctgagggagccagcccagggggacctcgggtgcgggtccccgccccaccggcccccggcgccgtccagcccggagggacctgattactacaagggaagacataaattcaaagcaggttgctacagtgaaagcagacctggagtctgaatcttttcgaccaaacctaagtgatcccagtgaacttttactgccagatcaaattgaaaagcttaccaagcatcttccaccaagaacaattggctatccatggactcttgtttatggtactggaaaacatggcacaagcttgaaaactctttatcgaacaatgacaggtttagacaccccagtgctgatggtgattaaagacagtgatggacaggtttttggtgcgttagcatctgagccactgaaagtgagtgatggcttttatggtactggagagacctttgtttttacattctgtccggagtttgaggtctttaagtggacaggagataatatgttttttatcaaaggagacatggattcactagctttcggtggtggaggaggagaatttgcgctttggcttgatggagatctctaccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtatcaccatttattacagttataattttggagtttatttttcaaatcatgttcttgtcccagagttctttaggttaacactagggactgcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggatacttctgtatctgtgaagttggcacaggtaacatttggacatgttcatcttattcttaggaaggaaaaaatcacttgccaaaataatacatacttcatagaccactgagttctagtttttattcacactacaacattctctttaacgatgttgcaggtattctcaatttccttttaagaaaaatgaaatgtgaggagaattctggttgtaatagatgacagtacatatgatctgcaggtttgggcatatgctttcatcattaaattatctgataaagttacaagtcacaaaggagaatgagaacttaatgattctattggatttaatatattagcaagaaaacatactatttacatatgtgtagcttagtaaggcattaacataagtacaaaaactatgaaacagatgcatatttcctcaacatactgtgtcaggtatactgttttataatttggttgttttagccttattgcacaccaactcccaaaatataggttactcttgttc

SEQ ID NO: 163043 - DNA, 4698 bp, Homo sapiens
  Payload ID: 12133
  Gene Symbol: OXR1
  Gene Name: oxidation resistance 1
  Uniprot ID: Q8N573
  ENST ID: ENST00000452423
  CDS Start-End: 329-2950
atgtctgcaagcgctcagcggcgccggcagcagcggggctagagctgggctgcgtcaggctgagcccattcacctcgcggccacaggagctcagcgccggcgccgcgccgcccagccccgccgagaggggcgcactcgccgccgcggggcccgccgccgctcaccgcagccccctcctggcgacccgcaagtcctctcaaactgtgagtaactaagtggtttgtgcatcattccagaagcaaagctaaaatttttagcggtgttgtcgacttgacctgctaatttcctgttctggaatcgagagaagactcctcaacaagttgctgcaatgtctgtgtctaatctatcatggctgaagaaaaagtcccagtcggtggatattaatgctccagggttcaaccctttggctggtgcaggaaagcaaacaccacaagccagtaagcccccggcacccaagacccccatcattgaagaagagcagaacaatgcagcaaatactcagaaacatccttccagaaggagcgaactgaagaggttctacacaattgacactggccaaaagaagaccctagacaagaaagatggaagacgaatgtcttttcagaaacctaaagggactattgagtatactgttgaatcaagggattctttgaatagcatagccctgaagtttgatacaacacctaacgaacttgttcaattaaataagttattctcccgagcagttgttactggacaggttctgtatgttcctgatcctgaatatgtctccagtgttgagagctctccatctctaagccccgtaagtcctctgtcaccaacatcatctgaggctgaatttgataagaccactaatcctgatgtccatccaacagaagcaactccctcatctactttcactggtattcgacctgcacgagttgtatcttcaacttctgaggaggaggaagcatttactgagaaatttcttaaaattaattgcaaatatattaccagtggcaagggcacagtcagtggtgtgctgctagttacaccaaataatataatgtttgatccacataaaaatgaccctttggttcaagagaatggctgtgaggaatatggcatcatgtgtccaatggaagaggtgatgtcagctgcaatgtacaaagaaattttggatagcaaaataaaggaatctttacccatagatatagatcagctatcaggaagggacttctgccattcaaagaaaatgacaggaagtaacactgaggaaatagactcaagaatccgagatgcaggtaatgatagtgccagcactgctcctaggagcactgaggagtctctttctgaagatgtgttcacagaatcagaactttcccctatacgagaggagcttgtatcttcagatgaactgcgacaagataaatcttctggtgcgtcatcagaatctgtgcaaactgtcaatcaggctgaagtagaaagtctgacagtcaaatcagaatctactggtactcctggtcacttaagatctgatactgaacattctacaaatgaagttgggactttatgtcataaaactgatttaaataatcttgaaatggccattaaggaagatcagattgcagataactttcaaggaatatcaggtcctaaagaagacagcacaagtataaaaggtaattcagaccaggattcttttcttcatgagaattcgttacaccaagaagagagtcaaaaagaaaatatgccttgtggggaaacagcagaatttaaacaaaagcaaagtgttaacaaaggaaaacaaggaaaggagcaaaatcaggactcacagacagaggcagaagagctacgcaaactttggaaaacccatactatgcaacaaactaaacagcaaagggaaaatattcaacaagtgtcacaaaaagaagctaagcataaaattacatctgctgatggacacatagaaagttctgcacttttaaaagaaaagcaaaggcatcgattacataagttcttgtgtctcagagttggaaaaccaatgaggaaaacgtttgtatctcaagcaagtgctacaatgcaacagtatgcacagagagataagaaacatgaatattggtttgctgtgccacaagaaaggacagatcacttgtatgccttcttcattcagtggagtccagaaatatatgcagaagatactggcgaatataccagagaacctggatttatagtagtaaaaaagattgaggagtctgaaacaattgaggattctagtaatcaagcagcagccagagaatgggaggtagtgtcagtggctgagtatcaccgcaggatcgatgctctaaatactgaagaactgcgcacactctgcagacgcctccagattactacaagggaagacataaattcaaagcaggttgctacagtgaaagcagacctggagtctgaatcttttcgaccaaacctaagtgatcccagtgaacttttactgccagatcaaattgaaaagcttaccaagcatcttccaccaagaacaattggctatccatggactcttgtttatggtactggaaaacatggcacaagcttgaaaactctttatcgaacaatgacaggtttagacaccccagtgctgatggtgattaaagacagtgatggacaggtttttggtgcgttagcatctgagccactgaaagtgagtgatggcttttatggtactggagagacctttgtttttacattctgtccggagtttgaggtctttaagtggacaggagataatatgttttttatcaaaggagacatggattcactagctttcggtggtggaggaggagaatttgcgctttggcttgatggagatctctaccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtatcaccatttattacagttataattttggagtttatttttcaaatcatgttcttgtcccagagttctttaggttaacactagggactgcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggatacttctgtatctgtgaagttggcacaggtaacatttggacatgttcatcttattcttaggaaggaaaaaatcacttgccaaaataatacatacttcatagaccactgagttctagtttttattcacactacaacattctctttaacgatgttgcaggtattctcaatttccttttaagaaaaatgaaatgtgaggagaattctggttgtaatagatgacagtacatatgatctgcaggtttgggcatatgctttcatcattaaattatctgataaagttacaagtcacaaaggagaatgagaacttaatgattctattggatttaatatattagcaagaaaacatactatttacatatgtgtagcttagtaaggcattaacataagtacaaaaactatgaaacagatgcatatttcctcaacatactgtgtcaggtatactgttttataatttggttgttttagccttattgcacaccaactcccaaaatataggttactcttgttcaaaaggaaaaaaaaaattgtgattttctttgagtggtatatgttattaattaccattagcatttgctcttataaagggcaatgattatagtagacaatattgtaactcagtagacttgttgaatatgcaaacttactgtcaagtgacctcaaaaaaaaaatgaaaagatagaatacactagtagttcttatcctcttttgtaggaaaccaataatagccattgtggcaataattcatcagttgattttaaagcttcatgttatgcaaaaaagaatcctgctgttatacatgtgacagtgactttgtgctgaaatttcagctattccagataaacattgtatatcttgtaaattaatgtttaaaggtgtagttttgttcttacagaaagtgttgattgccaggttgcttatagcactttaagttattctaaaaatgaaattataagccaaatatttggcttaagtagatttagttgtatagcacttacatatttagttcttttgaaagtttagataattatttaaagaaagcataatgctaatggaaaagaaaatctgatgttctattataatatgctattgctgaatatgaatagaaatacagggcatcatttccttgtctcattataagttagtaacaatatatagattaaatgtttacaatatagggaattgtaaataaatatatcagtttttttccccttcggtcttccacagcagtattattgtctttgtggagttgactaatgataatttaaaaatcctgtaatggatttctactaaaataaggtcatagtggcatataccaaataaaatcaaatacagaaat

SEQ ID NO: 163044 - DNA, 4617 bp, Homo sapiens
  Payload ID: 12133
  Gene Symbol: OXR1
  Gene Name: oxidation resistance 1
  Uniprot ID: Q8N573
  ENST ID: ENST00000445937
  CDS Start-End: 329-2869
atgtctgcaagcgctcagcggcgccggcagcagcggggctagagctgggctgcgtcaggctgagcccattcacctcgcggccacaggagctcagcgccggcgccgcgccgcccagccccgccgagaggggcgcactcgccgccgcggggcccgccgccgctcaccgcagccccctcctggcgacccgcaagtcctctcaaactgtgagtaactaagtggtttgtgcatcattccagaagcaaagctaaaatttttagcggtgttgtcgacttgacctgctaatttcctgttctggaatcgagagaagactcctcaacaagttgctgcaatgtctgtgtctaatctatcatggctgaagaaaaagtcccagtcggtggatattaatgctccagggttcaaccctttggctggtgcaggaaagcaaacaccacaagccagtaagcccccggcacccaagacccccatcattgaagaagagcagaacaatgcagcaaatactcagaaacatccttccagaaggagcgaactgaagaggttctacacaattgacactggccaaaagaagaccctagacaagaaagatggaagacgaatgtcttttcagaaacctaaagggactattgagtatactgttgaatcaagggattctttgaatagcatagccctgaagtttgatacaacacctaacgaacttgttcaattaaataagttattctcccgagcagttgttactggacaggttctgtatgttcctgatcctgaatatgtctccagtgttgagagctctccatctctaagccccgtaagtcctctgtcaccaacatcatctgaggctgaatttgataagaccactaatcctgatgtccatccaacagaagcaactccctcatctactttcactggtattcgacctgcacgagttgtatcttcaacttctgaggaggaggaagcatttactgagaaatttcttaaaattaattgcaaatatattaccagtggcaagggcacagtcagtggtgtgctgctagttacaccaaataatataatgtttgatccacataaaaatgaccctttggttcaagagaatggctgtgaggaatatggcatcatgtgtccaatggaagaggtgatgtcagctgcaatgtacaaagaaattttggatagcaaaataaaggaatctttacccatagatatagatcagctatcaggaagggacttctgccattcaaagaaaatgacaggaagtaacactgaggaaatagactcaagaatccgagatgcaggtaatgatagtgccagcactgctcctaggagcactgaggagtctctttctgaagatgtgttcacagaatcagaactttcccctatacgagaggagcttgtatcttcagatgaactgcgacaagataaatcttctggtgcgtcatcagaatctgtgcaaactgtcaatcaggctgaagtagaaagtctgacagtcaaatcagaatctactggtactcctggtcacttaagatctgatactgaacattctacaaatgaagttgggactttatgtcataaaactgatttaaataatcttgaaatggccattaaggaagatcagattgcagataactttcaaggaatatcaggtcctaaagaagacagcacaagtataaaaggtaattcagaccaggattcttttcttcatgagaattcgttacaccaagaagagagtcaaaaagaaaatatgccttgtggggaaacagcagaatttaaacaaaagcaaagtgttaacaaaggaaaacaaggaaaggagcaaaatcaggactcacagacagaggcagaagagctacgcaaactttggaaaacccatactatgcaacaaactaaacagcaaagggaaaatattcaacaagtgtcacaaaaagaagctaagcataaaattacatctgctgatggacacatagaaagttctgcacttttaaaagaaaagcaaaggcatcgattacataagttcttgtgtctcagagttggaaaaccaatgaggaaaacgtttgtatctcaagcaagtgctacaatgcaacagtatgcacagagagataagaaacatgaatattggtttgctgtgccacaagaaaggacagatcacttgtatgccttcttcattcagtggagtccagaaatatatgcagaagatactggcgaatataccagagaacctggatttatagtagtaaaaaagattgaggagtctgaaacaattgaggattctagtaatcaagcagcagccagagaatgggagattactacaagggaagacataaattcaaagcaggttgctacagtgaaagcagacctggagtctgaatcttttcgaccaaacctaagtgatcccagtgaacttttactgccagatcaaattgaaaagcttaccaagcatcttccaccaagaacaattggctatccatggactcttgtttatggtactggaaaacatggcacaagcttgaaaactctttatcgaacaatgacaggtttagacaccccagtgctgatggtgattaaagacagtgatggacaggtttttggtgcgttagcatctgagccactgaaagtgagtgatggcttttatggtactggagagacctttgtttttacattctgtccggagtttgaggtctttaagtggacaggagataatatgttttttatcaaaggagacatggattcactagctttcggtggtggaggaggagaatttgcgctttggcttgatggagatctctaccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtatcaccatttattacagttataattttggagtttatttttcaaatcatgttcttgtcccagagttctttaggttaacactagggactgcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggatacttctgtatctgtgaagttggcacaggtaacatttggacatgttcatcttattcttaggaaggaaaaaatcacttgccaaaataatacatacttcatagaccactgagttctagtttttattcacactacaacattctctttaacgatgttgcaggtattctcaatttccttttaagaaaaatgaaatgtgaggagaattctggttgtaatagatgacagtacatatgatctgcaggtttgggcatatgctttcatcattaaattatctgataaagttacaagtcacaaaggagaatgagaacttaatgattctattggatttaatatattagcaagaaaacatactatttacatatgtgtagcttagtaaggcattaacataagtacaaaaactatgaaacagatgcatatttcctcaacatactgtgtcaggtatactgttttataatttggttgttttagccttattgcacaccaactcccaaaatataggttactcttgttcaaaaggaaaaaaaaaattgtgattttctttgagtggtatatgttattaattaccattagcatttgctcttataaagggcaatgattatagtagacaatattgtaactcagtagacttgttgaatatgcaaacttactgtcaagtgacctcaaaaaaaaaatgaaaagatagaatacactagtagttcttatcctcttttgtaggaaaccaataatagccattgtggcaataattcatcagttgattttaaagcttcatgttatgcaaaaaagaatcctgctgttatacatgtgacagtgactttgtgctgaaatttcagctattccagataaacattgtatatcttgtaaattaatgtttaaaggtgtagttttgttcttacagaaagtgttgattgccaggttgcttatagcactttaagttattctaaaaatgaaattataagccaaatatttggcttaagtagatttagttgtatagcacttacatatttagttcttttgaaagtttagataattatttaaagaaagcataatgctaatggaaaagaaaatctgatgttctattataatatgctattgctgaatatgaatagaaatacagggcatcatttccttgtctcattataagttagtaacaatatatagattaaatgtttacaatatagggaattgtaaataaatatatcagtttttttccccttcggtcttccacagcagtattattgtctttgtggagttgactaatgataatttaaaaatcctgtaatggatttctactaaaataaggtcatagtggcatataccaaataaaatcaaatacagaaat

SEQ ID NO: 163045 - DNA, 2956 bp, Homo sapiens
  Payload ID: 12133
  Gene Symbol: OXR1
  Gene Name: oxidation resistance 1
  Uniprot ID: Q8N573
  ENST ID: ENST00000442977
  CDS Start-End: 100-2724
aacgagacatctagtacggggctcacaggtaacagaactctgatcagatccgccccggctcccacacagctataaggttgcctgcctgcctgcacagaaatgacgaaggacaaaaacagcccagggctgaagaaaaagtcccagtcggtggatattaatgctccagggttcaaccctttggctggtgcaggaaagcaaacaccacaagccagtaagcccccggcacccaagacccccatcattgaagaagagcagaacaatgcagcaaatactcagaaacatccttccagaaggagcgaactgaagaggttctacacaattgacactggccaaaagaagaccctagacaagaaagatggaagacgaatgtcttttcagaaacctaaagggactattgagtatactgttgaatcaagggattctttgaatagcatagccctgaagtttgatacaacacctaacgaacttgttcaattaaataagttattctcccgagcagttgttactggacaggttctgtatgttcctgatcctgaatatgtctccagtgttgagagctctccatctctaagccccgtaagtcctctgtcaccaacatcatctgaggctgaatttgataagaccactaatcctgatgtccatccaacagaagcaactccctcatctactttcactggtattcgacctgcacgagttgtatcttcaacttctgaggaggaggaagcatttactgagaaatttcttaaaattaattgcaaatatattaccagtggcaagggcacagtcagtggtgtgctgctagttacaccaaataatataatgtttgatccacataaaaatgaccctttggttcaagagaatggctgtgaggaatatggcatcatgtgtccaatggaagaggtgatgtcagctgcaatgtacaaagaaattttggatagcaaaataaaggaatctttacccatagatatagatcagctatcaggaagggacttctgccattcaaagaaaatgacaggaagtaacactgaggaaatagactcaagaatccgagatgcaggtaatgatagtgccagcactgctcctaggagcactgaggagtctctttctgaagatgtgttcacagaatcagaactttcccctatacgagaggagcttgtatcttcagatgaactgcgacaagataaatcttctggtgcgtcatcagaatctgtgcaaactgtcaatcaggctgaagtagaaagtctgacagtcaaatcagaatctactggtactcctggtcacttaagatctgatactgaacattctacaaatgaagttgggactttatgtcataaaactgatttaaataatcttgaaatggccattaaggaagatcagattgcagataactttcaaggaatatcaggtcctaaagaagacagcacaagtataaaaggtaattcagaccaggattcttttcttcatgagaattcgttacaccaagaagagagtcaaaaagaaaatatgccttgtggggaaacagcagaatttaaacaaaagcaaagtgttaacaaaggaaaacaaggaaaggagcaaaatcaggactcacagacagaggcagaagagctacgcaaactttggaaaacccatactatgcaacaaactaaacagcaaagggaaaatattcaacaagtgtcacaaaaagaagctaagcataaaattacatctgctgatggacacatagaaagttctgcacttttaaaagaaaagcaaaggcatcgattacataagttcttgtgtctcagagttggaaaaccaatgaggaaaacgtttgtatctcaagcaagtgctacaatgcaacagtatgcacagagagataagaaacatgaatattggtttgctgtgccacaagaaaggacagatcacttgtatgccttcttcattcagtggagtccagaaatatatgcagaagatactggcgaatataccagagaacctggatttatagtagtaaaaaagattgaggagtctgaaacaattgaggattctagtaatcaagcagcagccagagaatgggaggtagtgtcagtggctgagtatcaccgcaggatcgatgctctaaatactgaagaactgcgcacactctgcagacgcctccagattactacaagggaagacataaattcaaagcaggttgctacagtgaaagcagacctggagtctgaatcttttcgaccaaacctaagtgatcccagtgaacttttactgccagatcaaattgaaaagcttaccaagcatcttccaccaagaacaattggctatccatggactcttgtttatggtactggaaaacatggcacaagcttgaaaactctttatcgaacaatgacaggtttagacaccccagtgctgatggtgattaaagacagtgatggacaggtttttggtgcgttagcatctgagccactgaaagtgagtgatggcttttatggtactggagagacctttgtttttacattctgtccggagtttgaggtctttaagtggacaggagataatatgttttttatcaaaggagacatggattcactagctttcggtggtggaggaggagaatttgcgctttggcttgatggagatctctaccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtatcaccatttattacagttataattttggagtttatttttcaaatcatgttcttgtcccagagttctttaggttaacactagggactgcgtccatgtactagtataacagctt

SEQ ID NO: 163046 - DNA, 2621 bp, Homo sapiens
  Payload ID: 12133
  Gene Symbol: OXR1
  Gene Name: oxidation resistance 1
  Uniprot ID: Q8N573
  ENST ID: ENST00000449762
  CDS Start-End: 233-883
gaaattctctcttccctccccagctttacagcctccactcaggactatcattgctatggatactacttagtgattagctctctctcttgtcaatcaaatctttgtctctagcaaactgttttgtcactgtagtaaggctctagtgctggaaatttatctttgacagaggaagaatgcttttgaaaacagttcttacgtgattttatgtaacttaatttgccctggaaaggaaatgtctcgtctctggtatgggaaaaaagggagaagacatcaaccaattaatcataaatacactctgattactacaagggaagacataaattcaaagcaggttgctacagtgaaagcagacctggagtctgaatcttttcgaccaaacctaagtgatcccagtgaacttttactgccagatcaaattgaaaagcttaccaagcatcttccaccaagaacaattggctatccatggactcttgtttatggtactggaaaacatggcacaagcttgaaaactctttatcgaacaatgacaggtttagacaccccagtgctgatggtgattaaagacagtgatggacaggtttttggtgcgttagcatctgagccactgaaagtgagtgatggcttttatggtactggagagacctttgtttttacattctgtccggagtttgaggtctttaagtggacaggagataatatgttttttatcaaaggagacatggattcactagctttcggtggtggaggaggagaatttgcgctttggcttgatggagatctctaccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtatcaccatttattacagttataattttggagtttatttttcaaatcatgttcttgtcccagagttctttaggttaacactagggactgcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggatacttctgtatctgtgaagttggcacaggtaacatttggacatgttcatcttattcttaggaaggaaaaaatcacttgccaaaataatacatacttcatagaccactgagttctagtttttattcacactacaacattctctttaacgatgttgcaggtattctcaatttccttttaagaaaaatgaaatgtgaggagaattctggttgtaatagatgacagtacatatgatctgcaggtttgggcatatgctttcatcattaaattatctgataaagttacaagtcacaaaggagaatgagaacttaatgattctattggatttaatatattagcaagaaaacatactatttacatatgtgtagcttagtaaggcattaacataagtacaaaaactatgaaacagatgcatatttcctcaacatactgtgtcaggtatactgttttataatttggttgttttagccttattgcacaccaactcccaaaatataggttactcttgttcaaaaggaaaaaaaaaattgtgattttctttgagtggtatatgttattaattaccattagcatttgctcttataaagggcaatgattatagtagacaatattgtaactcagtagacttgttgaatatgcaaacttactgtcaagtgacctcaaaaaaaaaatgaaaagatagaatacactagtagttcttatcctcttttgtaggaaaccaataatagccattgtggcaataattcatcagttgattttaaagcttcatgttatgcaaaaaagaatcctgctgttatacatgtgacagtgactttgtgctgaaatttcagctattccagataaacattgtatatcttgtaaattaatgtttaaaggtgtagttttgttcttacagaaagtgttgattgccaggttgcttatagcactttaagttattctaaaaatgaaattataagccaaatatttggcttaagtagatttagttgtatagcacttacatatttagttcttttgaaagtttagataattatttaaagaaagcataatgctaatggaaaagaaaatctgatgttctattataatatgctattgctgaatatgaatagaaatacagggcatcatttccttgtctcattataagttagtaacaatatatagattaaatgtttacaatatagggaattgtaaataaatatatcagtttttttccccttcggtcttccacagcagtattattgtctttgtggagttgactaatgataatttaaaaatcctgtaatggatttctactaaaataaggtcatagtggcatataccaaataaaatcaa

SEQ ID NO: 163047 - DNA, 1436 bp, Homo sapiens
  Payload ID: 12133
  Gene Symbol: OXR1
  Gene Name: oxidation resistance 1
  ENST ID: ENST00000438229
  CDS Start-End: 97-219
caggtctgatgggccggtgggcgcgctagtggtggccgccaccgccgaaaccgtcgacctcctgggccccagttccgcgtccagccccgcggcagcatggactacctgacgacgttcaccgagaagagtgggcgccttctgcggggcacggccaaccgcctgttggggttcgggggcggcggcgaagcccggcagacactggccaaaagaagaccctagacaagaaagatggaagacgaatgtcttttcagaaacctaaagggactattgagtatactgttgaatcaagggattctttgaatagcatagccctgaagtttgatacaacacctaacgaacttgttcaattaaataagttattctcccgagcagttgttactggacaggttctgtatgttcctgatcctgaatatgtctccagtgttgagagctctccatctctaagccccgtaagtcctctgtcaccaacatcatctgaggctgaatttgataagaccactaatcctgatgtccatccaacagaagcaactccctcatctactttcactggtattcgacctgcacgagttgtatcttcaacttctgaggaggaggaagcatttactgagaaatttcttaaaattaattgcaaatatattaccagtggcaagggcacagtcagtggtgtgctgctagttacaccaaataatataatgtttgatccacataaaaatgaccctttggttcaagagaatggctgtgaggaatatggcatcatgtgtccaatggaagaggtgatgtcagctgcaatgtacaaagaaattttggatagcaaaataaaggaatctttacccatagatatagatcagctatcaggaagggacttctgccattcaaagaaaatgacaggaagtaacactgaggaaatagactcaagaatccgagatgcaggtaatgatagtgccagcactgctcctaggagcactgaggagtctctttctgaagatgtgttcacagaatcagaactttcccctatacgagaggagcttgtatcttcagatgaactgcgacaagataaatcttctggtgcgtcatcagaatctgtgcaaactgtcaatcaggctgaagtagaaagtctgacagtcaaatcagaatctactggtactcctggtcacttaagatctgatactgaacattctacaaatgaagttgggactttatgtcataaaactgatttaaataatcttgaaatggccattaaggaagatcagattgcagataactttcaaggaatatcaggtcctaaagaagacagcacaagtataaaaggtaattcagaccaggattcttttcttcatgagaattcgttacaccaagaagagagtcaaaaagaaaatatgccttgtggggaaacagcagaatttaaacaaaagcaaagtgttaacaaaggaaaacaa

SEQ ID NO: 163048 - DNA, 4501 bp, Homo sapiens
  Payload ID: 12133
  Gene Symbol: OXR1
  Gene Name: oxidation resistance 1
  Uniprot ID: Q8N573
  ENST ID: ENST00000517566
  CDS Start-End: 139-2760
gtcctctcaaactgtgagtaactaagtggtttgtgcatcattccagaagcaaagctaaaatttttagcggtgttgtcgacttgacctgctaatttcctgttctggaatcgagagaagactcctcaacaagttgctgcaatgtctgtgtctaatctatcatggctgaagaaaaagtcccagtcggtggatattaatgctccagggttcaaccctttggctggtgcaggaaagcaaacaccacaagccagtaagcccccggcacccaagacccccatcattgaagaagagcagaacaatgcagcaaatactcagaaacatccttccagaaggagcgaactgaagaggttctacacaattgacactggccaaaagaagaccctagacaagaaagatggaagacgaatgtcttttcagaaacctaaagggactattgagtatactgttgaatcaagggattctttgaatagcatagccctgaagtttgatacaacacctaacgaacttgttcaattaaataagttattctcccgagcagttgttactggacaggttctgtatgttcctgatcctgaatatgtctccagtgttgagagctctccatctctaagccccgtaagtcctctgtcaccaacatcatctgaggctgaatttgataagaccactaatcctgatgtccatccaacagaagcaactccctcatctactttcactggtattcgacctgcacgagttgtatcttcaacttctgaggaggaggaagcatttactgagaaatttcttaaaattaattgcaaatatattaccagtggcaagggcacagtcagtggtgtgctgctagttacaccaaataatataatgtttgatccacataaaaatgaccctttggttcaagagaatggctgtgaggaatatggcatcatgtgtccaatggaagaggtgatgtcagctgcaatgtacaaagaaattttggatagcaaaataaaggaatctttacccatagatatagatcagctatcaggaagggacttctgccattcaaagaaaatgacaggaagtaacactgaggaaatagactcaagaatccgagatgcaggtaatgatagtgccagcactgctcctaggagcactgaggagtctctttctgaagatgtgttcacagaatcagaactttcccctatacgagaggagcttgtatcttcagatgaactgcgacaagataaatcttctggtgcgtcatcagaatctgtgcaaactgtcaatcaggctgaagtagaaagtctgacagtcaaatcagaatctactggtactcctggtcacttaagatctgatactgaacattctacaaatgaagttgggactttatgtcataaaactgatttaaataatcttgaaatggccattaaggaagatcagattgcagataactttcaaggaatatcaggtcctaaagaagacagcacaagtataaaaggtaattcagaccaggattcttttcttcatgagaattcgttacaccaagaagagagtcaaaaagaaaatatgccttgtggggaaacagcagaatttaaacaaaagcaaagtgttaacaaaggaaaacaaggaaaggagcaaaatcaggactcacagacagaggcagaagagctacgcaaactttggaaaacccatactatgcaacaaactaaacagcaaagggaaaatattcaacaagtgtcacaaaaagaagctaagcataaaattacatctgctgatggacacatagaaagttctgcacttttaaaagaaaagcaaaggcatcgattacataagttcttgtgtctcagagttggaaaaccaatgaggaaaacgtttgtatctcaagcaagtgctacaatgcaacagtatgcacagagagataagaaacatgaatattggtttgctgtgccacaagaaaggacagatcacttgtatgccttcttcattcagtggagtccagaaatatatgcagaagatactggcgaatataccagagaacctggatttatagtagtaaaaaagattgaggagtctgaaacaattgaggattctagtaatcaagcagcagccagagaatgggaggtagtgtcagtggctgagtatcaccgcaggatcgatgctctaaatactgaagaactgcgcacactctgcagacgcctccagattactacaagggaagacataaattcaaagcaggttgctacagtgaaagcagacctggagtctgaatcttttcgaccaaacctaagtgatcccagtgaacttttactgccagatcaaattgaaaagcttaccaagcatcttccaccaagaacaattggctatccatggactcttgtttatggtactggaaaacatggcacaagcttgaaaactctttatcgaacaatgacaggtttagacaccccagtgctgatggtgattaaagacagtgatggacaggtttttggtgcgttagcatctgagccactgaaagtgagtgatggcttttatggtactggagagacctttgtttttacattctgtccggagtttgaggtctttaagtggacaggagataatatgttttttatcaaaggagacatggattcactagctttcggtggtggaggaggagaatttgcgctttggcttgatggagatctctaccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtatcaccatttattacagttataattttggagtttatttttcaaatcatgttcttgtcccagagttctttaggttaacactagggactgcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggatacttctgtatctgtgaagttggcacaggtaacatttggacatgttcatcttattcttaggaaggaaaaaatcacttgccaaaataatacatacttcatagaccactgagttctagtttttattcacactacaacattctctttaacgatgttgcaggtattctcaatttccttttaagaaaaatgaaatgtgaggagaattctggttgtaatagatgacagtacatatgatctgcaggtttgggcatatgctttcatcattaaattatctgataaagttacaagtcacaaaggagaatgagaacttaatgattctattggatttaatatattagcaagaaaacatactatttacatatgtgtagcttagtaaggcattaacataagtacaaaaactatgaaacagatgcatatttcctcaacatactgtgtcaggtatactgttttataatttggttgttttagccttattgcacaccaactcccaaaatataggttactcttgttcaaaaggaaaaaaaaaattgtgattttctttgagtggtatatgttattaattaccattagcatttgctcttataaagggcaatgattatagtagacaatattgtaactcagtagacttgttgaatatgcaaacttactgtcaagtgacctcaaaaaaaaaatgaaaagatagaatacactagtagttcttatcctcttttgtaggaaaccaataatagccattgtggcaataattcatcagttgattttaaagcttcatgttatgcaaaaaagaatcctgctgttatacatgtgacagtgactttgtgctgaaatttcagctattccagataaacattgtatatcttgtaaattaatgtttaaaggtgtagttttgttcttacagaaagtgttgattgccaggttgcttatagcactttaagttattctaaaaatgaaattataagccaaatatttggcttaagtagatttagttgtatagcacttacatatttagttcttttgaaagtttagataattatttaaagaaagcataatgctaatggaaaagaaaatctgatgttctattataatatgctattgctgaatatgaatagaaatacagggcatcatttccttgtctcattataagttagtaacaatatatagattaaatgtttacaatatagggaattgtaaataaatatatcagtttttttccccttcggtcttccacagcagtattattgtctttgtggagttgactaatgataatttaaaaatcctgtaatggatttctactaaaataaggtcatagtggcatataccaaataaaatcaaata

SEQ ID NO: 163049 - DNA, 564 bp, Homo sapiens
  Payload ID: 12133
  Gene Symbol: OXR1
  Gene Name: oxidation resistance 1
  ENST ID: ENST00000517686
  CDS Start-End: 266-564
attcttgtggctaccactgtcttacccagcactaaaagcttcttaaaattagtcagaggaagacaagtgggaaggtgtagacttctcacttcaatagtctgctaaagatggaggaaaaatatggtgctattcaaagacagtctagacttaaagatttagaattttggatggaaataatccggtgaaatagcaagaacatttgaaagagaacttgacaaaccactgctgcagaaagctgaattccaaggaaatatgcccaatatccatgaagctgagaaacactggccaaaagaagaccctagacaagaaagatggaagacgaatgtcttttcagaaacctaaagggactattgagtatactgttgaatcaagggattctttgaatagcatagccctgaagtttgatacaacacctaacgaacttgttcaattaaataagttattctcccgagcagttgttactggacaggttctgtatgttcctgatcctgaatatgtctccagtgttgagagctctccatctctaagccccgtaagtcctctgtcaccaacatcatctgaggc

SEQ ID NO: 163050 - DNA, 2476 bp, Homo sapiens
  Payload ID: 12133
  Gene Symbol: OXR1
  Gene Name: oxidation resistance 1
  ENST ID: ENST00000519415
  CDS Start-End: 1-1556
gagatatagatcagctatcaggaagggacttctgccattcaaagaaaatgacaggaagtaacactgaggaaatagactcaagaatccgagatgcaggtaatgatagtgccagcactgctcctaggagcactgaggagtctctttctgaagatgtgttcacagaatcagaactttcccctatacgagaggagcttgtatcttcagatgaactgcgacaagataaatcttctggtgcgtcatcagaatctgtgcaaactgtcaatcaggctgaagtagaaagtctgacagtcaaatcagaatctactggtactcctggtcacttaagatctgatactgaacattctacaaatgaagttgggactttatgtcataaaactgatttaaataatcttgaaatggccattaaggaagatcagattgcagataactttcaaggaatatcaggtcctaaagaagacagcacaagtataaaaggtaattcagaccaggattcttttcttcatgagaattcgttacaccaagaagagagtcaaaaagaaaatatgccttgtggggaaacagcagaatttaaacaaaagcaaagtgttaacaaaggaaaacaaggaaaggagcaaaatcaggactcacagacagaggcagaagagctacgcaaactttggaaaacccatactatgcaacaaactaaacagcaaagggaaaatattcaacaagtgtcacaaaaagaagctaagcataaaattacatctgctgatggacacatagaaagttctgcacttttaaaagaaaagcaaaggcatcgattacataagttcttgtgtctcagagttggaaaaccaatgaggaaaacgtttgtatctcaagcaagtgctacaatgcaacagtatgcacagagagataagaaacatgaatattggtttgctgtgccacaagaaaggacagatcacttgtatgccttcttcattcagtggagtccagaaatatatgcagaagatactggcgaatataccagagaacctggatttatagtagtaaaaaagattgaggagtctgaaacaattgaggattctagtaatcaagcagcagccagagaatgggagcttaccaagcatcttccaccaagaacaattggctatccatggactcttgtttatggtactggaaaacatggcacaagcttgaaaactctttatcgaacaatgacaggtttagacaccccagtgctgatggtgattaaagacagtgatggacaggtttttggtgcgttagcatctgagccactgaaagtgagtgatggcttttatggtactggagagacctttgtttttacattctgtccggagtttgaggtctttaagtggacaggagataatatgttttttatcaaaggagacatggattcactagctttcggtggtggaggaggagaatttgcgctttggcttgatggagatctctaccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtatcaccatttattacagttataattttggagtttatttttcaaatcatgttcttgtcccagagttctttaggttaacactagggactgcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggatacttctgtatctgtgaagttggcacaggtaacatttggacatgttcatcttattcttaggaaggaaaaaatcacttgccaaaataatacatacttcatagaccactgagttctagtttttattcacactacaacattctctttaacgatgttgcaggtattctcaatttccttttaagaaaaatgaaatgtgaggagaattctggttgtaatagatgacagtacatatgatctgcaggtttgggcatatgctttcatcattaaattatctgataaagttacaagtcacaaaggagaatgagaacttaatgattctattggatttaatatattagcaagaaaacatactatttacatatgtgtagcttagtaaggcattaacataagtacaaaaactatgaaacagatgcatatttcctcaacatactgtgtcaggtatactgttttataatttggttgttttagccttattgcacaccaactcccaaaatataggttactcttgttc

SEQ ID NO: 163051 - DNA, 2007 bp, Homo sapiens
  Payload ID: 12133
  Gene Symbol: OXR1
  Gene Name: oxidation resistance 1
  Uniprot ID: Q8N573
  ENST ID: ENST00000497705
  CDS Start-End: 40-1551
actgctagctgagcaaggttcgaaggaaggacctcagaaatgttctgccagcgcaaagacactggccaaaagaagaccctagacaagaaagatggaagacgaatgtcttttcagaaacctaaagggactattgagtatactgttgaatcaagggattctttgaatagcatagccctgaagtttgatacaacacctaacgaacttgttcaattaaataagttattctcccgagcagttgttactggacaggttctgtatgttcctgatcctgaatatgtctccagtgttgagagctctccatctctaagccccgtaagtcctctgtcaccaacatcatctgaggctgaatttgataagaccactaatcctgatgtccatccaacagaagcaactccctcatctactttcactggtattcgacctgcacgagttgtatcttcaacttctgaggaggaggaagcatttactgagaaatttcttaaaattaattgcaaatatattaccagtggcaagggcacagtcagtggtgtgctgctagttacaccaaataatataatgtttgatccacataaaaatgaccctttggttcaagagaatggctgtgaggaatatggcatcatgtgtccaatggaagaggtgatgtcagctgcaatgtacaaagaaattttggatagcaaaataaaggaatctttacccatagatatagatcagctatcaggaagggacttctgccattcaaagaaaatgacaggaagtaacactgaggaaatagactcaagaatccgagatgcaggtaatgatagtgccagcactgctcctaggagcactgaggagtctctttctgaagatgtgttcacagaatcagaactttcccctatacgagaggagcttgtatcttcagatgaactgcgacaagataaatcttctggtgcgtcatcagaatctgtgcaaactgtcaatcaggctgaagtagaaagtctgacagtcaaatcagaatctactggtactcctggtcacttaagatctgatactgaacattctacaaatgaagttgggactttatgtcataaaactgatttaaataatcttgaaatggccattaaggaagatcagattgcagataactttcaaggaatatcaggtcctaaagaagacagcacaagtataaaaggtaattcagaccaggattcttttcttcatgagaattcgttacaccaagaagagagtcaaaaagaaaatatgccttgtggggaaacagcagaatttaaacaaaagcaaagtgttaacaaaggaaaacaaggaaaggagcaaaatcaggactcacagacagaggcagaagagctacgcaaactttggaaaacccatactatgcaacaaactaaacagcaaagggaaaatattcaacaagtgtcacaaaaagaagctaagcataaaattacatctgctgatggacacatagaaagtaagtgttatagagtaaatgaagttagttcatccaattgtatggtgtctccgtctttcctcactgactcaaaagccgctgtaccttagggcaacctgaaggataagtgagtgacccttgaccggtgattctctggggacaagtatatacagtctccagtgtctactgtcttttcttatcccacaggtggattgtacacataatgagcatcattgctacccaccatgtttaaacattcttggctcactacatcgtatcattaaacaatttatttcttgagaaattgcacaaaagctgtataatacctttgatcactccattttctcttaaaaagtttttggtgtgttaccattaaaaatgtcttttttcatatataacattttaattgccaaagttgtaatcccatcttttataaaatgtacagttaaacctaaaagtgtacttacagaattcttccacgtatcgagaagtttcatcatcatcatctaattattttcttttaaaaacctgccctcaggacaaataaaaacactattttatctgtc

SEQ ID NO: 163052 - DNA, 3599 bp, Homo sapiens
  Payload ID: 12133
  Gene Symbol: OXR1
  Gene Name: oxidation resistance 1
  Uniprot ID: Q8N573
  ENST ID: ENST00000531443
  CDS Start-End: 139-2679
gtcctctcaaactgtgagtaactaagtggtttgtgcatcattccagaagcaaagctaaaatttttagcggtgttgtcgacttgacctgctaatttcctgttctggaatcgagagaagactcctcaacaagttgctgcaatgtctgtgtctaatctatcatggctgaagaaaaagtcccagtcggtggatattaatgctccagggttcaaccctttggctggtgcaggaaagcaaacaccacaagccagtaagcccccggcacccaagacccccatcattgaagaagagcagaacaatgcagcaaatactcagaaacatccttccagaaggagcgaactgaagaggttctacacaattgacactggccaaaagaagaccctagacaagaaagatggaagacgaatgtcttttcagaaacctaaagggactattgagtatactgttgaatcaagggattctttgaatagcatagccctgaagtttgatacaacacctaacgaacttgttcaattaaataagttattctcccgagcagttgttactggacaggttctgtatgttcctgatcctgaatatgtctccagtgttgagagctctccatctctaagccccgtaagtcctctgtcaccaacatcatctgaggctgaatttgataagaccactaatcctgatgtccatccaacagaagcaactccctcatctactttcactggtattcgacctgcacgagttgtatcttcaacttctgaggaggaggaagcatttactgagaaatttcttaaaattaattgcaaatatattaccagtggcaagggcacagtcagtggtgtgctgctagttacaccaaataatataatgtttgatccacataaaaatgaccctttggttcaagagaatggctgtgaggaatatggcatcatgtgtccaatggaagaggtgatgtcagctgcaatgtacaaagaaattttggatagcaaaataaaggaatctttacccatagatatagatcagctatcaggaagggacttctgccattcaaagaaaatgacaggaagtaacactgaggaaatagactcaagaatccgagatgcaggtaatgatagtgccagcactgctcctaggagcactgaggagtctctttctgaagatgtgttcacagaatcagaactttcccctatacgagaggagcttgtatcttcagatgaactgcgacaagataaatcttctggtgcgtcatcagaatctgtgcaaactgtcaatcaggctgaagtagaaagtctgacagtcaaatcagaatctactggtactcctggtcacttaagatctgatactgaacattctacaaatgaagttgggactttatgtcataaaactgatttaaataatcttgaaatggccattaaggaagatcagattgcagataactttcaaggaatatcaggtcctaaagaagacagcacaagtataaaaggtaattcagaccaggattcttttcttcatgagaattcgttacaccaagaagagagtcaaaaagaaaatatgccttgtggggaaacagcagaatttaaacaaaagcaaagtgttaacaaaggaaaacaaggaaaggagcaaaatcaggactcacagacagaggcagaagagctacgcaaactttggaaaacccatactatgcaacaaactaaacagcaaagggaaaatattcaacaagtgtcacaaaaagaagctaagcataaaattacatctgctgatggacacatagaaagttctgcacttttaaaagaaaagcaaaggcatcgattacataagttcttgtgtctcagagttggaaaaccaatgaggaaaacgtttgtatctcaagcaagtgctacaatgcaacagtatgcacagagagataagaaacatgaatattggtttgctgtgccacaagaaaggacagatcacttgtatgccttcttcattcagtggagtccagaaatatatgcagaagatactggcgaatataccagagaacctggatttatagtagtaaaaaagattgaggagtctgaaacaattgaggattctagtaatcaagcagcagccagagaatgggagattactacaagggaagacataaattcaaagcaggttgctacagtgaaagcagacctggagtctgaatcttttcgaccaaacctaagtgatcccagtgaacttttactgccagatcaaattgaaaagcttaccaagcatcttccaccaagaacaattggctatccatggactcttgtttatggtactggaaaacatggcacaagcttgaaaactctttatcgaacaatgacaggtttagacaccccagtgctgatggtgattaaagacagtgatggacaggtttttggtgcgttagcatctgagccactgaaagtgagtgatggcttttatggtactggagagacctttgtttttacattctgtccggagtttgaggtctttaagtggacaggagataatatgttttttatcaaaggagacatggattcactagctttcggtggtggaggaggagaatttgcgctttggcttgatggagatctctaccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtatcaccatttattacagttataattttggagtttatttttcaaatcatgttcttgtcccagagttctttaggttaacactagggactgcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggatacttctgtatctgtgaagttggcacaggtaacatttggacatgttcatcttattcttaggaaggaaaaaatcacttgccaaaataatacatacttcatagaccactgagttctagtttttattcacactacaacattctctttaacgatgttgcaggtattctcaatttccttttaagaaaaatgaaatgtgaggagaattctggttgtaatagatgacagtacatatgatctgcaggtttgggcatatgctttcatcattaaattatctgataaagttacaagtcacaaaggagaatgagaacttaatgattctattggatttaatatattagcaagaaaacatactatttacatatgtgtagcttagtaaggcattaacataagtacaaaaactatgaaacagatgcatatttcctcaacatactgtgtcaggtatactgttttataatttggttgttttagccttattgcacaccaactcccaaaatataggttactcttgttc

SEQ ID NO: 163053 - DNA, 993 bp, Homo sapiens
  Payload ID: 12133
  Gene Symbol: OXR1
  Gene Name: oxidation resistance 1
  ENST ID: ENST00000521592
  CDS Start-End: 380-739
atgcttttgaaaacagttcttacgtgattttatgtaacttaatttgccctggaaaggaaatgtctcgtctctggtagtgtcagtggctgagtatcaccgcaggatcgatgctctaaatactgaagaactgcgcacactctgcagacgcctccagattactacaagggaagacataaattcaaagcaggttgctacagtgaaagcagacctggagtctgaatcttttcgaccaaacctaagtgatcccagtgaacttttactgccagatcaaattgaaaagcttaccaagcatcttccaccaagaacaattggctatccatggactcttgtttatggtactggaaaacatggcacaagcttgaaaactctttatcgaacaatgacaggtttagacaccccagtgctgatggtgattaaagacagtgatggacaggtttttggtgcgttagcatctgagccactgaaagtgagtgatggcttttatggtactggagagacctttgtttttacattctgtccggagtttgaggtctttaagtggacaggagataatatgttttttatcaaaggagacatggattcactagctttcggtggtggaggaggagaatttgcgctttggcttgatggagatctctaccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtatcaccatttattacagttataattttggagtttatttttcaaatcatgttcttgtcccagagttctttaggttaacactagggactgcgtccatgtactagtataacagcttgggtttgttagaatttgggcaa

SEQ ID NO: 163054 - DNA, 2391 bp, Homo sapiens
  Payload ID: 12134
  Gene Symbol: OSGIN1
  Gene Name: oxidative stress induced growth inhibitor 1
  Uniprot ID: Q9UJX0
  ENST ID: ENST00000343939
  CDS Start-End: 384-2066
ggagcaactcagcaattctgttaccgataatcacctaacaggtaaacaagatggcagggaggaaagtccacgtctcgccccacagttccccatatcagcaaatcttcaaattctagaacaaggtcagggtcagcaggggcagggcaggtttggaggaaggccaggccaagcccaggagaagagacagggtccagggaagcccacctccttcctgggtctcccctccagacccccaagacccccagcctcaggccttctcaagccccagccttaaggagttgagcactccagggtggggggtctctgatcctgggtgcctgtctctctctgcctcagtttacacattcaaaaccactgggaagccacagaccaggcaccgtgggatggggaagtggagaccgagaggctgctgccggggaaatatgcagtgcagacaagaggttcctgctactctcacctcatcagagttgttttctaccaggaaccagccccagccccagccccagcccctgctggcagatgctccggtaccctgggctgtggcttccaggatgtgcctgactccagggcagggctgtggccaccagggccaggacgagggtccgctgccagccccaagccccccaccagccatgagctcctccagaaaggaccacctcggcgccagcagctcagagcccctcccggtcatcattgtgggtaacggcccctctggtatctgcctgtcctacctgctctccggctacacaccctacacgaagccagatgccatccacccacaccccctgctgcagaggaagctcaccgaggccccgggggtctccatcctggaccaggacctggactacctgtccgaaggcctcgaaggccgatcccaaagccccgtggccctgctctttgatgcccttctacgcccagacacagactttgggggaaacatgaagtcggtcctcacctggaagcaccggaaggagcacgccatcccccacgtggttctgggccggaacctccccgggggagcctggcactccatcgaaggctccatggtgatcctgagccaaggccagtggatggggctcccggacctggaggtcaaggactggatgcagaagaagcgaagaggtcttcgcaacagccgggccactgccggggacatcgcccactactacagggactacgtggtcaagaagggtctggggcataactttgtgtccggtgctgtagtcacagccgtggagtgggggacccccgatcccagcagctgtggggcccaggactccagccccctcttccaggtgagcggcttcctgaccaggaaccaggcccagcagcccttctcgctgtgggcccgcaacgtggtcctcgccacaggcacgttcgacagcccggcccggctgggcatccccggggaggccctgcccttcatccaccatgagctgtctgccctggaggccgccacaagggtgggtgcggtgaccccggcctcagaccctgtcctcatcattggcgcggggctgtcagcggccgacgcggtcctctacgcccgccactacaacatcccggtgatccatgccttccgccgggccgtggacgaccctggcctggtgttcaaccagctgcccaagatgctgtaccccgagtaccacaaggtgcaccagatgatgcgggagcagtccatcctgtcgcccagcccctatgagggttaccgcagcctccccaggcaccagctgctgtgcttcaaggaagactgccaggccgtgttccaggacctcgagggtgtcgagaaggtgtttggggtctccctggtgctggtcctcatcggctcccaccccgacctctccttcctgcctggggcaggggctgactttgcagtggatcctgaccagccgctgagcgccaagaggaaccccattgacgtggaccccttcacctaccagagcacccgccaggagggcctgtacgccatggggccgctggccggggacaacttcgtgaggtttgtgcaggggggcgccttggctgtggccagctccctgctaaggaaggagaccaggaagccaccctaacactcggccagacccgctggctcccaggccctgagaggacagagatgaccacatccctgctggatgcaggacccgtccaaagatgccccggggaggggtgtcagcccacgttgctggcctttggggtcaagaggagtagggatcccaggctgccctggacttagaccagtgtctgaggtggtaacagcggccgcaggccagggttggcctagacctgggatttgtggggaaagctgctggtgtgaccagctgagcacccagccaggagacctgcagccctgcgccttccagaagcaggtcccaaataaagccagtgcccacctgc

SEQ ID NO: 163055 - DNA, 2230 bp, Homo sapiens
  Payload ID: 12134
  Gene Symbol: OSGIN1
  Gene Name: oxidative stress induced growth inhibitor 1
  Uniprot ID: Q9UJX0
  ENST ID: ENST00000361711
  CDS Start-End: 473-1906
ggagcaactcagcaattctgttaccgataatcacctaacaggtaaacaagatggcagggaggaaagtccacgtctcgccccacagttccccatatcagcaaatcttcaaattctagaacaaggtcagggtcagcaggggcagggcaggtttggaggaaggccaggccaagcccaggagaagagacagggtccagggaagcccacctccttcctgggtctcccctccagacccccaagacccccagcctcaggccttctcaagccccagccttaaggagttgagcactccagggtggggggtctctgatcctgggtgcctgtctctctctgcctcagtttacacattcaaaaccactgggaagccacagaccaggcaccgtgggatggggaagtggagaccgagaggctgctgccggggaaatatgcagtgcagacaagaggtccgctgccagccccaagccccccaccagccatgagctcctccagaaaggaccacctcggcgccagcagctcagagcccctcccggtcatcattgtgggtaacggcccctctggtatctgcctgtcctacctgctctccggctacacaccctacacgaagccagatgccatccacccacaccccctgctgcagaggaagctcaccgaggccccgggggtctccatcctggaccaggacctggactacctgtccgaaggcctcgaaggccgatcccaaagccccgtggccctgctctttgatgcccttctacgcccagacacagactttgggggaaacatgaagtcggtcctcacctggaagcaccggaaggagcacgccatcccccacgtggttctgggccggaacctccccgggggagcctggcactccatcgaaggctccatggtgatcctgagccaaggccagtggatggggctcccggacctggaggtcaaggactggatgcagaagaagcgaagaggtcttcgcaacagccgggccactgccggggacatcgcccactactacagggactacgtggtcaagaagggtctggggcataactttgtgtccggtgctgtagtcacagccgtggagtgggggacccccgatcccagcagctgtggggcccaggactccagccccctcttccaggtgagcggcttcctgaccaggaaccaggcccagcagcccttctcgctgtgggcccgcaacgtggtcctcgccacaggcacgttcgacagcccggcccggctgggcatccccggggaggccctgcccttcatccaccatgagctgtctgccctggaggccgccacaagggtgggtgcggtgaccccggcctcagaccctgtcctcatcattggcgcggggctgtcagcggccgacgcggtcctctacgcccgccactacaacatcccggtgatccatgccttccgccgggccgtggacgaccctggcctggtgttcaaccagctgcccaagatgctgtaccccgagtaccacaaggtgcaccagatgatgcgggagcagtccatcctgtcgcccagcccctatgagggttaccgcagcctccccaggcaccagctgctgtgcttcaaggaagactgccaggccgtgttccaggacctcgagggtgtcgagaaggtgtttggggtctccctggtgctggtcctcatcggctcccaccccgacctctccttcctgcctggggcaggggctgactttgcagtggatcctgaccagccgctgagcgccaagaggaaccccattgacgtggaccccttcacctaccagagcacccgccaggagggcctgtacgccatggggccgctggccggggacaacttcgtgaggtttgtgcaggggggcgccttggctgtggccagctccctgctaaggaaggagaccaggaagccaccctaacactcggccagacccgctggctcccaggccctgagaggacagagatgaccacatccctgctggatgcaggacccgtccaaagatgccccggggaggggtgtcagcccacgttgctggcctttggggtcaagaggagtagggatcccaggctgccctggacttagaccagtgtctgaggtggtaacagcggccgcaggccagggttggcctagacctgggatttgtggggaaagctgctggtgtgaccagctgagcacccagccaggagacctgcagccctgcgccttccagaagcaggtcccaaataaagccagtgcccacctg

SEQ ID NO: 163056 - DNA, 1940 bp, Homo sapiens
  Payload ID: 12134
  Gene Symbol: OSGIN1
  Gene Name: oxidative stress induced growth inhibitor 1
  Uniprot ID: Q9UJX0
  ENST ID: ENST00000393306
  CDS Start-End: 182-1615
acttccctctggcctctcagagcctcttggatccccacagggtaatgggtgtcccgatctcgcgggggactctgtgatccgtgttcccctgaccctcctagtgcacaacttggccgggctcactgggctcctgcaccactgcctgtcaggtccgctgccagccccaagccccccaccagccatgagctcctccagaaaggaccacctcggcgccagcagctcagagcccctcccggtcatcattgtgggtaacggcccctctggtatctgcctgtcctacctgctctccggctacacaccctacacgaagccagatgccatccacccacaccccctgctgcagaggaagctcaccgaggccccgggggtctccatcctggaccaggacctggactacctgtccgaaggcctcgaaggccgatcccaaagccccgtggccctgctctttgatgcccttctacgcccagacacagactttgggggaaacatgaagtcggtcctcacctggaagcaccggaaggagcacgccatcccccacgtggttctgggccggaacctccccgggggagcctggcactccatcgaaggctccatggtgatcctgagccaaggccagtggatggggctcccggacctggaggtcaaggactggatgcagaagaagcgaagaggtcttcgcaacagccgggccactgccggggacatcgcccactactacagggactacgtggtcaagaagggtctggggcataactttgtgtccggtgctgtagtcacagccgtggagtgggggacccccgatcccagcagctgtggggcccaggactccagccccctcttccaggtgagcggcttcctgaccaggaaccaggcccagcagcccttctcgctgtgggcccgcaacgtggtcctcgccacaggcacgttcgacagcccggcccggctgggcatccccggggaggccctgcccttcatccaccatgagctgtctgccctggaggccgccacaagggtgggtgcggtgaccccggcctcagaccctgtcctcatcattggcgcggggctgtcagcggccgacgcggtcctctacgcccgccactacaacatcccggtgatccatgccttccgccgggccgtggacgaccctggcctggtgttcaaccagctgcccaagatgctgtaccccgagtaccacaaggtgcaccagatgatgcgggagcagtccatcctgtcgcccagcccctatgagggttaccgcagcctccccaggcaccagctgctgtgcttcaaggaagactgccaggccgtgttccaggacctcgagggtgtcgagaaggtgtttggggtctccctggtgctggtcctcatcggctcccaccccgacctctccttcctgcctggggcaggggctgactttgcagtggatcctgaccagccgctgagcgccaagaggaaccccattgacgtggaccccttcacctaccagagcacccgccaggagggcctgtacgccatggggccgctggccggggacaacttcgtgaggtttgtgcaggggggcgccttggctgtggccagctccctgctaaggaaggagaccaggaagccaccctaacactcggccagacccgctggctcccaggccctgagaggacagagatgaccacatccctgctggatgcaggacccgtccaaagatgccccggggaggggtgtcagcccacgttgctggcctttggggtcaagaggagtagggatcccaggctgccctggacttagaccagtgtctgaggtggtaacagcggccgcaggccagggttggcctagacctgggatttgtggggaaagctgctggtgtgaccagctgagcacccagccaggagacctgcagccctgcgccttccagaagcaggtcccaaataaagccagtgcccacctgc

SEQ ID NO: 163057 - DNA, 434 bp, Homo sapiens
  Payload ID: 12134
  Gene Symbol: OSGIN1
  Gene Name: oxidative stress induced growth inhibitor 1
  ENST ID: ENST00000561552
  CDS Start-End: 120-434
cgggttcaagcaattctcctccctcagactcctgagtagctgggattacagaaaccctcttgtgagcacgcctgaatttggaggatcacgtcacaagctctcaatagccacttgaactcatggccttaaagagcacaagtatcggcctttgtcttagtcaagctttcgaggagcaactcagcaattctgttaccgataatcacctaacagtttacacattcaaaaccactgggaagccacagaccaggcaccgtgggatggggaagtggagaccgagaggctgctgccggggaaatatgcagtgcagacaagagggtaatgggtgtcccgatctcgcgggggactctgtgatccgtgttcccctgaccctcctagtgcacaacttggccgggctcactgggctcctgcaccactgcctgtcaggtccgctgcca

SEQ ID NO: 163058 - DNA, 534 bp, Homo sapiens
  Payload ID: 12134
  Gene Symbol: OSGIN1
  Gene Name: oxidative stress induced growth inhibitor 1
  ENST ID: ENST00000567707
  CDS Start-End: 167-534
actgcttccatttccccaagtccatcccagctcctggggcaggccacagcgctggcccattccctgtggcagattcactccaggcaggtgcttcccgtctgtgatcctactgtgtccctcaaccaccctaggaggtccgctgccagccccaagccccccaccagccatgagctcctccagaaaggaccacctcggcgccagcagctcagagcccctcccggtcatcattgtgggtaacggcccctctggtatctgcctgtcctacctgctctccggctacacaccctacacgaagccagatgccatccacccacaccccctgctgcagaggaagctcaccgaggccccgggggtctccatcctggaccaggacctggactacctgtccgaaggcctcgaaggccgatcccaaagccccgtggccctgctctttgatgcccttctacgcccagacacagactttgggggaaacatgaagtcggtcctcacctggaagcaccggaaggagcacgccatcccccacgtggttctggg

SEQ ID NO: 163059 - DNA, 833 bp, Homo sapiens
  Payload ID: 12134
  Gene Symbol: OSGIN1
  Gene Name: oxidative stress induced growth inhibitor 1
  ENST ID: ENST00000565123
  CDS Start-End: 165-656
cagagcctcttggatccccacagggtaatgggtgtcccgatctcgcgggggactctgtgatccgtgttcccctgaccctcctagtgcacaacttggccgggctcactgggctcctgcaccactgcctgtcaggtccgctgccagccccaagccccccaccagccatgagctcctccagaaaggaccacctcggcgccagcagctcagagcccctcccggtcatcattgtgggtaacggcccctctggtatctgcctgtcctacctgctctccggctacacaccctacacgaagccagatgccatccacccacaccccctgctgcagaggaagctcaccgaggccccgggggtctccatcctggaccaggacctggactacctgtccgaaggcctcgaaggccgatcccaaagccccgtggccctgctctttgatgcccttctacgcccagacacagactttgggggaaacatgaagtcggtcctcacctggaagcaccggaaggagcacgccatcccccacgtggttctgggccggaacctccccgggggagcctggcactccatcgaaggctccatggtgatcctgagccaaggccagtggatggggctcccggacctggaggtcaaggactggatgcagaagaagcgaaggtgaggccgccccggaacgccttgggggacacggaaggttgggcctgtgaacccagaaaatctgagacaggtctcagttaatttagaaagtttatttttccaaggttgaggacgcgcccgtgacagcctcaggaagtcctaatgacatgtgcccaaggtgatccggcacagcttggtttta

SEQ ID NO: 163060 - DNA, 4209 bp, Homo sapiens
  Payload ID: 12135
  Gene Symbol: OSGIN2
  Gene Name: oxidative stress induced growth inhibitor family member 2
  Uniprot ID: Q9Y236
  ENST ID: ENST00000297438
  CDS Start-End: 356-1873
ggtgtggtctggggcgggcctgatgagcacctggattttcacccggcgtgctggtaattcctacacttgtgggtgtttgagagacatgaagaggggaggatgacctcttcccggaagcgggacttccataaaagaagcgtggtgggcgggtcccgggcacctgtggtttggtgagtcctccaggtaactgtgatgcgggggtcagcgggagaggcacccggaagctcccggcgtctgcaccccggcagcgcgaggaaatgcccaaagaaactatagtgacactgaaactgaaggagagatttttaattccttagtgcaatactttggtgacaacttggggcgaaaagttaaagcgatgccattagttgaagaaacttctttactggaagattcgtcagtgacttttcctgtggtaataataggaaatggaccctcaggaatatgcctttcttatatgttatcaggctacagaccgtatttatcatcagaagcaatacacccaaatacaatcttaaatagtaaattagaagaagcaagacatctttccattgttgatcaggacttagaatacttgtctgagggccttgagggccgatcatccaatccagttgcagtacttttcgatacacttcttcatccagatgctgactttgggtatgattatccatccgttttgcattggaaattagagcaacatcattatatccctcacgtagttcttggtaaaggtccacctggtggggcttggcataatatggaaggctccatgttgacaatcagctttggaagttggatggaactacctggacttaaatttaaggactgggtatcaagtaaacgaaggagcctaaaaggggatcgagttatgccagaggaaatagctcgctactataaacattatgtaaaagtcatgggtcttcagaagaatttcagagagaatacttacataacttccgtatcaagactctacagagatcaagatgatgatgatattcaagacagagatatttcaacaaagcatttacagatagagaagtcaaactttatcaagagaaactgggaaattaggggttatcagcgaatagctgatggttctcatgttcccttctgcctctttgctgagaatgtagcgctggcaactggaacgctggattctcctgcccatctggaaattgaaggggaagattttccttttgtgtttcattcaatgcctgaatttggagctgctataaacaaaggaaagttgcgtggcaaagtggatccagtgttaattgtaggttctgggcttactgccgctgacgcagtactgtgtgcttacaacagtaatatccctgtgattcatgtgtttcgcagacgagtaactgatccaagcttaattttcaaacagcttcccaaaaagctgtatcctgaatatcataaagtctatcatatgatgtgtactcagtcatattctgtagactcaaatcttttatctgattataccagctttcccgagcaccgtgtgctttcctttaagtcggacatgaaatgtgttctccaaagcgtttctggattgaagaaaatatttaagctgtctgcagcagtagtattgataggttctcatcctaatctgtcttttctgaaggatcaagggtgttacctaggccataagtcaagccagccaatcacatgtaagggtaatcctgtggaaatagatacatatacctatgagtgtattaaagaagccaacctttttgcattgggtcctttggttggagacaattttgttcgatttttaaagggaggggcgctgggtgttacacgctgtttagctacaagacagaagaaaaagcatttgtttgttgaaagaggaggaggagatgggatagcttaaagcaagtttacaagtaattaaaatggacagtttgccattaaagatttttaatagtggttttgcagtgtactggcttgaattttctggacttgagttaactgaaggagagcctcaaactatagtaacttcatttttaaaagttactagaatttggtatcctgatttatattgcagtgtttcaaaggtgtcactgtcagacaaatagaaacactgccaacttggtgtaacttaagctttcatttaactaaaacattcttttcttgcaaaacttatttttcatgatcatttttggttatttattatacttgattccaaaatagtacagccttgaatctataaaactgtgcagtcattatgccagaaattatcttaaatatataatgggtcaccttgctgttcaaagggtggtgcaaggtcctgcagcatcttacatctgtagcttgttagaaatgtaaactctcaggccccacaacttacttcctgcattttaacaagatccccaagggatatgtatgctcataaaaatttgagacactggtttaaatgaaaatggatataaggtatgtataactgggggtggggtgagggtaggaggcatttacaactcagattttatttattttgaaattatcaattgtataaatctaatttattaccaaatagggtcttttaaaaaatatttttatcgttgaaaccttgacaggtacttcatattcttctaataatttaaacagtccaataatgtggtatacactttgacatccaagaactcaccaagatgtttttcagagatttattctcgatttaactatcatagcatttaatgaatctgatttgtagttcaataaattgtgggttgaactacttatccctgtgtgaacattgaattactttctgtcactgaaactgaggtatttgggtgtggtaagtacttcgaaaattgtaatactgtttgggcattgtctaaattattaaaggttaaaatagaaaataaagtcagaatttttcttttccattccaaaggtgtacttagagatctctattagtattcattcgagatgacatagcagctcatatcatggttgtttattggatttatctgttctaattatataagtgtgtttactgtctgtgttttcacacaaactgctagaatttttaatgttaagacgaaaacatctgaagttctccatggcaaattgaatttttcagtcattttcttttctttttttggtacaattacttcatctggaatgtcttcattgaactcgttattctatttttcttagaattaaaagtggattaatgtgggtttttctgttcattttattgcagtattaaatgcttaagcttattaggaccataattcactttaaatataattgtatagaatatatttgcgtcgatcaaataattgcttcagatgaattcttagactcttgataatatcacacctaatttaacttgattttacaagctgtacaatccagttttagttttctattgtgataataacttttttcaaaccagtttcacatcttaatgaaataacattctctgactgcacttgcttcagtactctcttgcctgcctgtttttgacctctgcatgagttggattagatgtttttcttactgtcacttctaaatagaaaatgacagtgttataaaaaagggaaggataaaacctttgacatccccttgtgtctcaaaagtccacagttattcaaacaatggctttttttgtgatgagagtatttgttaaaaaaaaaaaaagacttcaagaaaaataaaagttcagtggagctgcaaataaatctggtgaataatttcatctttggtaatctcccatttcctgagttcttcctcaatccaagctgtcctgtgtagtatataacatttgggcattttctctgatatactatactctcatgttctataaatttctgtcccgtaattctaacactttacattttttctttgctatcagctatagctattcatggaagggaagaatcactaaatacttgtctagttatagcatgatgtgagcatctcctccttatccctcgatgcctggcttggtgtctggcaaacagtccataattagcagatgttgaaagaccgtttacaaagcagaatttggggatttaaagtgcaatgatacaacaaaaagatttaattacagcttccagtgttttgactatgtgaaccatatccaactacttttttgaaaatctagttctatgtaatatatttctgtggcatcaaattttagttgattgtattagtcaataggaagtggtggaaaatttctaaataaattcaactattaaa

SEQ ID NO: 163061 - DNA, 4266 bp, Homo sapiens
  Payload ID: 12135
  Gene Symbol: OSGIN2
  Gene Name: oxidative stress induced growth inhibitor family member 2
  Uniprot ID: Q9Y236
  ENST ID: ENST00000451899
  CDS Start-End: 261-1910
gctccgcccctatcgcggcgccccgagatcacccgcctccggcgcctggctccctgcaggcgaggagcggaagccgctatctggaggcggactccggcgccacagagccggggcagccgcggcaacggcgaggcgcgaggcaggggcgcccggcagaccccgcgaccccgagccagcgggcgccccgagcgggcagcctcgccgggggaggcggaggcggccacggcggccgcgctcgggcgcccctcgcgcagcgctccatgcccgtgtggtgctgccgctgctccctggccggtcatttcagaaactatagtgacactgaaactgaaggagagatttttaattccttagtgcaatactttggtgacaacttggggcgaaaagttaaagcgatgccattagttgaagaaacttctttactggaagattcgtcagtgacttttcctgtggtaataataggaaatggaccctcaggaatatgcctttcttatatgttatcaggctacagaccgtatttatcatcagaagcaatacacccaaatacaatcttaaatagtaaattagaagaagcaagacatctttccattgttgatcaggacttagaatacttgtctgagggccttgagggccgatcatccaatccagttgcagtacttttcgatacacttcttcatccagatgctgactttgggtatgattatccatccgttttgcattggaaattagagcaacatcattatatccctcacgtagttcttggtaaaggtccacctggtggggcttggcataatatggaaggctccatgttgacaatcagctttggaagttggatggaactacctggacttaaatttaaggactgggtatcaagtaaacgaaggagcctaaaaggggatcgagttatgccagaggaaatagctcgctactataaacattatgtaaaagtcatgggtcttcagaagaatttcagagagaatacttacataacttccgtatcaagactctacagagatcaagatgatgatgatattcaagacagagatatttcaacaaagcatttacagatagagaagtcaaactttatcaagagaaactgggaaattaggggttatcagcgaatagctgatggttctcatgttcccttctgcctctttgctgagaatgtagcgctggcaactggaacgctggattctcctgcccatctggaaattgaaggggaagattttccttttgtgtttcattcaatgcctgaatttggagctgctataaacaaaggaaagttgcgtggcaaagtggatccagtgttaattgtaggttctgggcttactgccgctgacgcagtactgtgtgcttacaacagtaatatccctgtgattcatgtgtttcgcagacgagtaactgatccaagcttaattttcaaacagcttcccaaaaagctgtatcctgaatatcataaagtctatcatatgatgtgtactcagtcatattctgtagactcaaatcttttatctgattataccagctttcccgagcaccgtgtgctttcctttaagtcggacatgaaatgtgttctccaaagcgtttctggattgaagaaaatatttaagctgtctgcagcagtagtattgataggttctcatcctaatctgtcttttctgaaggatcaagggtgttacctaggccataagtcaagccagccaatcacatgtaagggtaatcctgtggaaatagatacatatacctatgagtgtattaaagaagccaacctttttgcattgggtcctttggttggagacaattttgttcgatttttaaagggaggggcgctgggtgttacacgctgtttagctacaagacagaagaaaaagcatttgtttgttgaaagaggaggaggagatgggatagcttaaagcaagtttacaagtaattaaaatggacagtttgccattaaagatttttaatagtggttttgcagtgtactggcttgaattttctggacttgagttaactgaaggagagcctcaaactatagtaacttcatttttaaaagttactagaatttggtatcctgatttatattgcagtgtttcaaaggtgtcactgtcagacaaatagaaacactgccaacttggtgtaacttaagctttcatttaactaaaacattcttttcttgcaaaacttatttttcatgatcatttttggttatttattatacttgattccaaaatagtacagccttgaatctataaaactgtgcagtcattatgccagaaattatcttaaatatataatgggtcaccttgctgttcaaagggtggtgcaaggtcctgcagcatcttacatctgtagcttgttagaaatgtaaactctcaggccccacaacttacttcctgcattttaacaagatccccaagggatatgtatgctcataaaaatttgagacactggtttaaatgaaaatggatataaggtatgtataactgggggtggggtgagggtaggaggcatttacaactcagattttatttattttgaaattatcaattgtataaatctaatttattaccaaatagggtcttttaaaaaatatttttatcgttgaaaccttgacaggtacttcatattcttctaataatttaaacagtccaataatgtggtatacactttgacatccaagaactcaccaagatgtttttcagagatttattctcgatttaactatcatagcatttaatgaatctgatttgtagttcaataaattgtgggttgaactacttatccctgtgtgaacattgaattactttctgtcactgaaactgaggtatttgggtgtggtaagtacttcgaaaattgtaatactgtttgggcattgtctaaattattaaaggttaaaatagaaaataaagtcagaatttttcttttccattccaaaggtgtacttagagatctctattagtattcattcgagatgacatagcagctcatatcatggttgtttattggatttatctgttctaattatataagtgtgtttactgtctgtgttttcacacaaactgctagaatttttaatgttaagacgaaaacatctgaagttctccatggcaaattgaatttttcagtcattttcttttctttttttggtacaattacttcatctggaatgtcttcattgaactcgttattctatttttcttagaattaaaagtggattaatgtgggtttttctgttcattttattgcagtattaaatgcttaagcttattaggaccataattcactttaaatataattgtatagaatatatttgcgtcgatcaaataattgcttcagatgaattcttagactcttgataatatcacacctaatttaacttgattttacaagctgtacaatccagttttagttttctattgtgataataacttttttcaaaccagtttcacatcttaatgaaataacattctctgactgcacttgcttcagtactctcttgcctgcctgtttttgacctctgcatgagttggattagatgtttttcttactgtcacttctaaatagaaaatgacagtgttataaaaaagggaaggataaaacctttgacatccccttgtgtctcaaaagtccacagttattcaaacaatggctttttttgtgatgagagtatttgttaaaaaaaaaaaaagacttcaagaaaaataaaagttcagtggagctgcaaataaatctggtgaataatttcatctttggtaatctcccatttcctgagttcttcctcaatccaagctgtcctgtgtagtatataacatttgggcattttctctgatatactatactctcatgttctataaatttctgtcccgtaattctaacactttacattttttctttgctatcagctatagctattcatggaagggaagaatcactaaatacttgtctagttatagcatgatgtgagcatctcctccttatccctcgatgcctggcttggtgtctggcaaacagtccataattagcagatgttgaaagaccgtttacaaagcagaatttggggatttaaagtgcaatgatacaacaaaaagatttaattacagcttccagtgttttgactatgtgaaccatatccaactacttttttgaaaatctagttctatgtaatatatttctgtggcatcaaattttagttgattgtattagtcaataggaagtggtggaaaatttctaaataaattcaactattaaataaatgcaagttccactaaa

SEQ ID NO: 163062 - DNA, 801 bp, Homo sapiens
  Payload ID: 12135
  Gene Symbol: OSGIN2
  Gene Name: oxidative stress induced growth inhibitor family member 2
  ENST ID: ENST00000520659
  CDS Start-End: 34-657
ggccgcgctcgggcgcccctcgcgcagcgctccatgcccgtgtggtgctgccgctgctccctggccggtcatttcagaaactatagtgacactgaaactgaaggagagatttttaattccttagtgcaatactttggtgacaacttggggcgaaaagttaaagcgatgccattagttgaagaaacttctttactggaagattcgtcagtgacttttcctgtggtaataataggaaatggaccctcaggaatatgcctttcttatatgttatcaggctacagaccgtatttatcatcagaagcaatacacccaaatacaatcttaaatagtaaattagaagaagcaagacatctttccattgttgatcaggacttagaatacttgtctgagggccttgagggccgatcatccaatccagttgcagtacttttcgatacacttcttcatccagatgctgactttgggtatgattatccatccgttttgcattggaaattagagcaacatcattatatccctcacgtagttcttggtaaaggtccacctggtggggcttggcataatatggaaggctccatgttgacaatcagctttggaagttggatggaactacctggacttaaatttaaggactgggtatcaagtaaacgaaggtaaagattgaactgtattaaaattctttggtgtacgttgaaaaagagaatgtggaaaaatttcaaaatatttgtgattttgtcatggctgaagaatataaatgtacgtctttcaaataaaaatgtgtccttgaagcagtgattataa

SEQ ID NO: 163063 - DNA, 4553 bp, Homo sapiens
  Payload ID: 12136
  Gene Symbol: OXSR1
  Gene Name: oxidative stress responsive 1
  Uniprot ID: O95747
  ENST ID: ENST00000311806
  CDS Start-End: 373-1956
gtgtcggcaggtggaggaagaggggaaagtttggcccgtgcgtggggctggggtggagggcgggacagaggggctgggcccaggcaaagcttctgtcgctgctgctgcggaggccgaggacaggacgtgggctgggccgggcagtgccggactcggaggagcaggaggcgaggtccgccggagctctgagcccccgctgctctgccgcgcggtgaccccgcgccccggcgccgtccgacccgtggctgttccgagacgattggtgggggcgcggcggcggcggcggcggctgttgggggtggggagacgcgcggcgaggagacgagcgaggtcagcgagtttgagggaggaccgcgagccgctgccgccgtcatgtccgaggactcgagcgccctgccctggtccatcaacagggacgattacgagctgcaggaggtgatcgggagtggagcaactgctgtagtccaagcagcttattgtgcccctaaaaaggagaaagtggcaatcaaacggataaaccttgagaaatgtcaaactagcatggatgaactcctgaaagaaattcaagccatgagtcaatgccatcatcctaatattgtatcttactacacatcttttgtggtaaaagatgagctgtggcttgtcatgaagctgctaagtggaggttctgttctggatattattaagcacattgtggcaaaaggggaacacaaaagtggagtcctagatgaatctaccattgctacgatactccgagaagtactggaagggctggaatatctgcataaaaatggacagatccacagagatgtgaaagctggaaacattcttcttggagaagatggctcagtacagattgcagactttggggttagtgcttttttagcaactggtggtgatattacccgaaataaagtgagaaagacctttgttggcaccccttgttggatggcacctgaagttatggaacaggtccgtggttatgatttcaaagctgatatttggagttttggaattacagcaattgaattggctacaggggcggctccttatcataaatatccaccaatgaaggttttaatgctgacactgcagaacgatcctccttctttggaaactggtgttcaagataaagaaatgctgaaaaaatatggaaaatcatttagaaaaatgatttcattgtgccttcaaaaagatccagaaaaaagaccaacagcagcagaactattaaggcacaaatttttccagaaagcaaagaataaagaatttcttcaagaaaaaacattgcagagagcaccaaccatttctgaaagagcaaaaaaggttcggagagtaccaggttccagtgggcgtcttcataagacagaggatggaggctgggagtggagtgatgatgaatttgatgaagaaagtgaggaagggaaagcagcaatttcacaactcaggtctccccgagtgaaagaatcaatatcaaattctgagctctttccaacaactgatcctgtgggtactttgctccaagttccagaacagatctctgctcatctacctcagccagctgggcagattgctacacagccaactcaagtctctctcccacccaccgcagagccagcaaaaacagctcaggctttgtcttcaggatcaggttcacaagaaaccaagatcccaatcagtctagtactaagattaaggaattccaaaaaagaactaaatgatattcgatttgaatttactcctgggagagatacagcagagggtgtctctcaggaactcatttctgctggcctggtcgacggaagggatttagtaatagtggcagctaatttgcagaaaattgtggaagaacctcagtcaaatcgatctgtcactttcaaactggcatctggtgtcgaaggctcagatattcctgatgatggtaaactgataggatttgcccagctcagcatcagctaaaccacaaccctggaagaggcggcctaaggagattccacacatgcgtatctctgttgcttctattggcctaaacccactactgccaaagaacccagcaacaaacctcccggctaggagctttagaagtctttatgttcttcctgccatcattcctccttttcccacagggaaagaaaagttggatcactagtggccagcatccccagagttccgttagtaaacttacttcatatgtcccctgtcttcctccatctgagaagtggcccatgtgcttcaaggcccaggagggagatctgtcagctcattcttgccttactccaatgatggcccaggtggaaaagtagcagctgtatcgggcttcctcatcctgcctgttcccccacacctgccaggatatggacatcttgggatatctctttaccactgaagtagaattgattgttcagctggagcccagagaatttaatttaatgttttttctttgtacctgatgtgaattctagcaacctttgttaggaaaaagcacagcctcagatggaggcagcctaaactgtgttcttgttttgttcatggtgtttctaagcgttttgctgaagctgctctcaggcacccccttcttcattgctctctccagaaagggttgctagccttaacttcagctggtgcaaaacatctgactgtagccgaacttcagccatcagatccttcaaagtggaactttggattgtttttacagacaacatcgagtaatggcttgtaaatgtgaattttgccagaggtggtttttgaacaggaaaatcataattcatatcattggagaagtatttattttcaaatatcaaattgaagaaaaactcaatcctcccatgaaaatcagttcgcctggcctccaagtcgtgaggaaatgggtatgcaaggctgagatttctacagcaataaaggagacacacactgggccagagaggcctgccttctgcctgctctcctgcactgaccctttggagggggtctctgtgtgctgaagctaactcaagatggaaagtgaaaccacatgtgccgtgacctttaggttttatgagtagacagtgttcatttgattttctacagaaataatataaattattctttaggtttaaaaaagagcactcataatgcaatatgtgaataatcagtgaggttgatttttcttttttcctaccgtttcatagtctttgtctaactgctagtaaccctaccgagttttatatatgagtgggatactcaatctggccttaaaaagatacacaaagatgggctgtgggtccctggaaagggggagagttgccctttacagaatcactcgagccctttccagcactgttggtctgatgaacaaggttgttttaccttattttctcttggaacatatctgaaaaccttccccacaaataacttgtcacaccttttgtttcattctgagtctttagttttagtcatgggctttcttcacctgctctaggtgcaaaggcatgttgggaaagagatggatgttggggaggaagagaggagatggatttcagttgggagttaggaggagagtaggtgagatgatcagacaccggagttcaacgtcccagcagtcttggtaaaaggagggagcctgctgagccaggagggagaaaagaagattgaccagcttgctagaaaaatacttagcttttctttttctttttttgtggaggggggacggagaggaacaaggatggggaggtaggaatgaggtatagaaaagagatagcatcttctttggcacaagactagtggcttaccgcttaccttagagttttgttttttttttttcaaacccatcaaaatctacttatttatgaatccaaggggtggcagcatcactctgttctagcattctttgtggagatggtctggtgcctagctgggagtgagcagcagcccatcccctgttcactttctctagcccatcattacctgtgaactgcagtggggcagtcatggcaaatagaattgggctggggtttctccttcttttcagttcattgtttgccctgctaggaattagaagacagacaccatgtcccaggacagtgttacttcttctgcatgatgtgtggtagactccctttgctggcttgtgcagtgatactgagaaaatacatgaacagaaactgcccaggtggaacagcacgtaacctagtgagtgactgtactcctttctaggaatgctgattcagagtgcacctctttgactaggtcccaggatccccttgtccctggagtagggactaactatagcacaaagtaatatgtgccaatgctatttgtgaaatgtttggtctttctaaacgactaaaggatttgttgggtttttgcttaagttttgaaccaaatcctagagccagctgataatatttaataatctggaggagagaataatgatgtaccaataagtggagattcctccttatgatgtatgctaggttatggaagatgtaaaatattcaactttttcctcctttttttggactttgtattttactgcatgttttcttcatttttaatcaataaagagtaaattgtcctta

SEQ ID NO: 163064 - DNA, 1581 bp, Homo sapiens
  Payload ID: 12136
  Gene Symbol: OXSR1
  Gene Name: oxidative stress responsive 1
  ENST ID: ENST00000426620
  CDS Start-End: 231-572
agtgccggactcggaggagcaggaggcgaggtccgccggagctctgagcccccgctgctctgccgcgcggtgaccccgcgccccggcgccgtccgacccgtggctgttccgagacgattggtgggggcgcggcggcggcggcggcggctgttgggggtggggagacgcgcggcgaggagacgagcgaggtcagcgagtttgagggaggaccgcgagccgctgccgccgtcatgtccgaggactcgagcgccctgccctggtccatcaacagggacgattacgagctgcaggaggtgatcgggagtggagcaactgctgtagtccaagcagcttattgtgcccctaaaaaggagaaagtggcaatcaaacggataaaccttgagaaatgtcaaactagcatggatgaactcctgaaagaaattcaagccatgagtcaatgccatcatcctaatattgtatcttactacacatcttttgtggtaaaagatgagctgtggcttgtcatgaagctgctaagtggagtgacacactggagaaactggattgctttgttaaaggccctgttcatatgatggttggaagctttgctaacaccaaccacctttcaagatggtggtcaagcatggttctttcagtatggagagatatgggagtattaggttctgttctggatattattaagcacattgtggcaaaaggggaacacaaaagtggagtcctagatgaatctaccattgctacgatactccgagaagtactggaagggctggaatatctgcataaaaatggacagatccacagagatgtgaaagctggaaacattcttcttggagaagatggctcagtacagattgcagactttggggttagtgcttttttagcaactggtggtgatattacccgaaataaagtgagaaagacctttgttggcaccccttgttggatggcacctgaagttatggaacaggtccgtggttatgatttcaaagctgatatttggagttttggaattacagcaattgaattggctacaggggcggctccttatcataaatatccaccaatgaaggttttaatgctgacactgcagaacgatcctccttctttggaaactggtgttcaagataaagaaatgctgaaaaaatatggaaaatcatttagaaaaatgatttcattgtgccttcaaaaagatccagaaaaaagaccaacagcagcagaactattaaggcacaaatttttccagaaagcaaagaataaagaatttcttcaagaaaaaacattgcagagagcaccaaccatttctgaaagagcaaaaaaggtaaatcagaatttaactcagttttcctgaagaatttactttatttttgcattttgaaaacatgttaagtaatacattgttaatagtatatgagaattactggttttctgtcgatcctttctaaagcattctttgatacattcattcagcaaatatctttggtctaccatatgccttggtattactctgctatcttttaggatgaaaagggatgctagacagtaattggtaaattaattctaaactctgtttgataactgttt

SEQ ID NO: 163065 - DNA, 1908 bp, Homo sapiens
  Payload ID: 12136
  Gene Symbol: OXSR1
  Gene Name: oxidative stress responsive 1
  ENST ID: ENST00000446845
  CDS Start-End: 373-1779
gtgtcggcaggtggaggaagaggggaaagtttggcccgtgcgtggggctggggtggagggcgggacagaggggctgggcccaggcaaagcttctgtcgctgctgctgcggaggccgaggacaggacgtgggctgggccgggcagtgccggactcggaggagcaggaggcgaggtccgccggagctctgagcccccgctgctctgccgcgcggtgaccccgcgccccggcgccgtccgacccgtggctgttccgagacgattggtgggggcgcggcggcggcggcggcggctgttgggggtggggagacgcgcggcgaggagacgagcgaggtcagcgagtttgagggaggaccgcgagccgctgccgccgtcatgtccgaggactcgagcgccctgccctggtccatcaacagggacgattacgagctgcaggaggtgatcgggagtggagcaactgctgtagtccaagcagcttattgtgcccctaaaaaggagaaagtggcaatcaaacggataaaccttgagaaatgtcaaactagcatggatgaactcctgaaagaaattcaagccatgagtcaatgccatcatcctaatattgtatcttactacacatcttttgtggtaaaagatgagctgtggcttgtcatgaagctgctaagtggaggttctgttctggatattattaagcacattgtggcaaaaggggaacacaaaagtggagtcctagatgaatctaccattgctacgatactccgagaagtactggaagggctggaatatctgcataaaaatggacagatccacagagatgtgaaagctggaaacattcttcttggagaagatggctcagtacagattgcagactttggggttagtgcttttttagcaactggtggtgatattacccgaaataaagtgagaaagacctttgttggcaccccttgttggatggcacctgaagttatggaacaggtccgtggttatgatttcaaagctgatatttggagttttggaattacagcaattgaattggctacaggggcggctccttatcataaatatccaccaatgaaggttttaatgctgacactgcagaacgatcctccttctttggaaactggtgttcaagataaagaaatgctgaaaaaatatggaaaatcatttagaaaaatgatttcattgtgccttcaaaaagatccagaaaaaagaccaacagcagcagaactattaaggcacaaatttttccagaaagcaaagaataaagaatttcttcaagaaaaaacattgcagagagcaccaaccatttctgaaagagcaaaaaaggttcggagagtaccaggttccagtgggcgtcttcataagacagaggatggaggctgggagtggagtgatgatgaatttgatgaagaaagtgaggaagggaaagcagcaatttcacaactcaggtctccccgagtgaaagaatcaatatcaaattctgagctctttccaacaactgatcctgtgggtactttgctccaagttccagaacagatctctgctcatctacctcagccagctgggcagattgctacacagccaactcaagtctctctcccacccaccgcagagccagcaaaaacagctcaggctttgtcttcaggatcaggttcacaagaaaccaagatcccaatcagtctagtactaagattaaggaattccaaaaaagaactaaatgatattcgatttgaatttactcctgggagaggtgaggcatcaaatggattgaaaacaaaatagcttccaatttgtgattcaatgaaatgtgttgtgaagtttctgtcctttgtgaagttttgcttttaaaggataataaaaattttcctggttttggcgagtatatgagtgagataaaaatgcagttcgttg

SEQ ID NO: 163066 - DNA, 1572 bp, Homo sapiens
  Payload ID: 12137
  Gene Symbol: OSER1
  Gene Name: oxidative stress responsive serine-rich 1
  Uniprot ID: Q9NX31
  ENST ID: ENST00000255174
  CDS Start-End: 138-1016
ggctggtttggatccgggtcagtcgggtgccgagatttgggagagacgctctgaactgactgccccgcatcaccggagcgtcccagctgcgaggagtgtaaacaggaacatcgataagtagtgtaaaaacttgcacaatgaaatccgaagccaaggatggagaggaggagagtctacagactgctttcaaaaaattaagagtggatgcatcagggtctgtagcatctctgtctgttggagaaggcacaggtgtcagagcaccagtcagaacagcaacagatgataccaaacctaaaaccacatgtgcatctaaagacagttggcacgggtctacaaggaagtcttcacgaggagcagtgagaactcagcgtcgtcgacgttctaagtctcctgtccttcatcctccaaagtttatacattgcagtacaatagcgtcttcttccagcagtcaactcaagcacaaaagccagactgactcacctgatggcagcagtgggctgggaatttcatcccctaaagagttcagtgcaggagaaagctctacttctctcgatgctaatcacacaggggcagtcgttgagcctttgagaacttctgttccaaggctcccatcagagagtaagaaggaagactcctctgacgctacccaagtcccccaagcaagtctcaaagccagtgatctctctgactttcaatcagtttccaagctaaaccagggcaagccatgcacatgcataggcaaggaatgccagtgtaagagatggcatgatatggaagtgtattccttttcaggcctgcagagtgtccctcccttggctccagaacgaagatccacacttgaggactactctcagtcgctgcacgccagaactctgtctggctctccccgatcctgttctgagcaagctcgagtcttcgtggatgatgtgaccattgaggacctgtcaggctacatggagtattacttgtatattcccaagaaaatgtcccacatggcagaaatgatgtacacctgatagcaagaagctaattcatatgctttaaaccaatgaaggcttgtcaaagagatttagttaatggcagaccttgtggccactttgtgtgagaagacatctctttctgctcactgtgcttgcaataaaaacttttcttggcatctcagttaatcttcattctttcaacttactctcttgagttcttacatacacttcaaggcgagcagatcaaagaaaaatcccccttatttagaaatgttcctgggggatgaagaaaccataattacttgagactggcagcagtgggtatatggtaaaagcctttgtaaaacagtgcatttttcagatttgtttaaggtttgctagccaaggaaagtaaaatgtgattttgtaactgcactaaacatttgtcatgctgtagttgccagcccagaatattagaagttacaagactgatttaaaccgtctctgatttaatgcaagatatattgtgtctataaaggtttctcttgttattgttaagccagagatctaaggtttagattcaatttgaataaactagctggcctgccctcta

SEQ ID NO: 163067 - DNA, 1616 bp, Homo sapiens
  Payload ID: 12137
  Gene Symbol: OSER1
  Gene Name: oxidative stress responsive serine-rich 1
  Uniprot ID: Q9NX31
  ENST ID: ENST00000372970
  CDS Start-End: 182-1060
gaaagaactttgtgctttggctgcagcgctgcgagtataaagggatgagtgggttgcacggagaggctatgaagaaaaacacaaatggaagtatcaaccttactggtttctagaccaactggggagattcccgttaaaaatgtaaacaggaacatcgataagtagtgtaaaaacttgcacaatgaaatccgaagccaaggatggagaggaggagagtctacagactgctttcaaaaaattaagagtggatgcatcagggtctgtagcatctctgtctgttggagaaggcacaggtgtcagagcaccagtcagaacagcaacagatgataccaaacctaaaaccacatgtgcatctaaagacagttggcacgggtctacaaggaagtcttcacgaggagcagtgagaactcagcgtcgtcgacgttctaagtctcctgtccttcatcctccaaagtttatacattgcagtacaatagcgtcttcttccagcagtcaactcaagcacaaaagccagactgactcacctgatggcagcagtgggctgggaatttcatcccctaaagagttcagtgcaggagaaagctctacttctctcgatgctaatcacacaggggcagtcgttgagcctttgagaacttctgttccaaggctcccatcagagagtaagaaggaagactcctctgacgctacccaagtcccccaagcaagtctcaaagccagtgatctctctgactttcaatcagtttccaagctaaaccagggcaagccatgcacatgcataggcaaggaatgccagtgtaagagatggcatgatatggaagtgtattccttttcaggcctgcagagtgtccctcccttggctccagaacgaagatccacacttgaggactactctcagtcgctgcacgccagaactctgtctggctctccccgatcctgttctgagcaagctcgagtcttcgtggatgatgtgaccattgaggacctgtcaggctacatggagtattacttgtatattcccaagaaaatgtcccacatggcagaaatgatgtacacctgatagcaagaagctaattcatatgctttaaaccaatgaaggcttgtcaaagagatttagttaatggcagaccttgtggccactttgtgtgagaagacatctctttctgctcactgtgcttgcaataaaaacttttcttggcatctcagttaatcttcattctttcaacttactctcttgagttcttacatacacttcaaggcgagcagatcaaagaaaaatcccccttatttagaaatgttcctgggggatgaagaaaccataattacttgagactggcagcagtgggtatatggtaaaagcctttgtaaaacagtgcatttttcagatttgtttaaggtttgctagccaaggaaagtaaaatgtgattttgtaactgcactaaacatttgtcatgctgtagttgccagcccagaatattagaagttacaagactgatttaaaccgtctctgatttaatgcaagatatattgtgtctataaaggtttctcttgttattgttaagccagagatctaaggtttagattcaatttgaataaactagctggcctgccctcta

SEQ ID NO: 163068 - DNA, 2462 bp, Homo sapiens
  Payload ID: 12138
  Gene Symbol: OLR1
  Gene Name: oxidized low density lipoprotein (lectin-like) receptor 1
  Uniprot ID: P78380
  ENST ID: ENST00000309539
  CDS Start-End: 62-883
atttttagtttgttgaagttcgtgactgcttcactctctcattcttagcttgaatttggaaatgacttttgatgacctaaagatccagactgtgaaggaccagcctgatgagaagtcaaatggaaaaaaagctaaaggtcttcagtttctttactctccatggtggtgcctggctgctgcgactctaggggtcctttgcctgggattagtagtgaccattatggtgctgggcatgcaattatcccaggtgtctgacctcctaacacaagagcaagcaaacctaactcaccagaaaaagaaactggagggacagatctcagcccggcaacaagcagaagaagcttcacaggagtcagaaaacgaactcaaggaaatgatagaaacccttgctcggaagctgaatgagaaatccaaagagcaaatggaacttcaccaccagaatctgaatctccaagaaacactgaagagagtagcaaattgttcagctccttgtccgcaagactggatctggcatggagaaaactgttacctattttcctcgggctcatttaactgggaaaagagccaagagaagtgcttgtctttggatgccaagttgctgaaaattaatagcacagctgatctggacttcatccagcaagcaatttcctattccagttttccattctggatggggctgtctcggaggaaccccagctacccatggctctgggaggacggttctcctttgatgccccacttatttagagtccgaggcgctgtctcccagacatacccttcaggtacctgtgcatatatacaacgaggagctgtttatgcggaaaactgcattttagctgccttcagtatatgtcagaagaaggcaaacctaagagcacagtgaatttgaaggctctggaagaaaagaaaaaagtctttgagttttattctggaatttaagctattctttgtcacttgggtgccaaacatgagagcccagaaaactgtcatttagctggctgcagaactcctttgcagaaactggggttccaggagcctggcacctttatgtcaacatttttgattctagctacctgtattatttcacctagcttgtcccaagcttccctgccagcctgaagtccattttcccctttttattttaaaatttgactcctcttcaagcttgaaaaccctctgaactcagtcttctttacctcattatcaccttcccctcacactcctaaaattgcatgaaagacagaacatggagaacttgctcaagtgcaggcagagagcaaaaaggggaaatatgtctgggaaaaagtgcacgtgaagaaacaaagaaggacagaggccattccgaaatcaagaaactcatgttcttaactttaaaaaaggtatcaatccttggtttttaaactgtggtccatctccagactctaccacttacggacagacagacagacagacacacacacacacacacacacacattttgggacaagtggggagcccaagaaagtaattagtaagtgagtggtcttttctgtaagctaatccacaacctgttaccacttcctgaatcagttattatttcttcatttttttttctaccagaggacagattaatagatttaacccttcacaacagttcttgttagaatcatgggatgtgtggcccagaggtaagaatagaatttctttccctaaagaacataccttttgtagatgaactcttctcaactctgttttgctatgctataattccgaaacatacaagacaaaaaaaatgaagacactcaatctagaacaaactaagccaggtatgcaaatatcgctgaatagaaacagatggaattagaaatatatcttctatttttaggcttctatttcctttccacccactcttcacaggctattctactttaaaggaagcctttttattttgctgcacacaatctagcaggaatctttttttttttttaagagctgtgtcatccttatgtaggcaagagatgtttgcttttgttaaaagctttattgagatataattaacataaaataaactgaacatatttaaagtgtactatttgataagttttcacaccttgtggagaacatgcatactacaattaagagagtgaacatatccatcatccctcaaagtgtcacaatgctcctcctgatgactcctccccagaaaaccaccaatcggctttcattttgcattttgtagttttatgtgaatggaatcatatagtatgtcttttttttttgtctggcttctttcactttgcataattattttgagattcatatgtctccatcttgatgctcgtatgaattcattcttttaaatgttgaatattcccttgtatggatataccacaattcatttacccatttacttgttgatgacatttgggttgttttagttttgggatattacaaataaagctgctgtgaacatttgtgtacaa

SEQ ID NO: 163069 - DNA, 591 bp, Homo sapiens
  Payload ID: 12138
  Gene Symbol: OLR1
  Gene Name: oxidized low density lipoprotein (lectin-like) receptor 1
  ENST ID: ENST00000339968
  CDS Start-End: 279-591
ctactaatagtcactgagtctgagatggggtttcaccatgttggccaggatggtctctatctcttgacctcgtgatctgcctgcctcggcctcccaaagtgctgggattacagacctgagccaccgtgcctggccaaaatcttgtatcccaggtgtctgacctcctaacacaagagcaagcaaacctaactcaccagaaaaagaaactggagggacagatctcagcccggcaacaagcagaagaagcttcacaggagtcagaaaacgaactcaaggaaatgatagaaacccttgctcggaagctgaatgagaaatccaaagagcaaatggaacttcaccaccagaatctgaatctccaagaaacactgaagagagtagcaaattgttcagctccttgtccgcaagactggatctggcatggagaaaactgttacctattttcctcgggctcatttaactgggaaaagagccaagagaagtgcttgtctttggatgccaagttgctgaaaattaatagcacagctgatctggacttcatccagcaagcaatttcctattccagttttccattctggatggggctgtctcgga

SEQ ID NO: 163070 - DNA, 950 bp, Homo sapiens
  Payload ID: 12138
  Gene Symbol: OLR1
  Gene Name: oxidized low density lipoprotein (lectin-like) receptor 1
  Uniprot ID: P78380
  ENST ID: ENST00000432556
  CDS Start-End: 56-601
agtttgttgaagttcgtgactgcttcactctctcattcttagcttgaatttggaaatgacttttgatgacctaaagatccagactgtgaaggaccagcctgatgagaagtcaaatggaaaaaaagctaaaggtcttcagtttctttactctccatggtggtgcctggctgctgcgactctaggggtcctttgcctgggattagtagtgaccattatggtgctgggcatgcaattatcccaggtgtctgacctcctaacacaagagcaagcaaacctaactcaccagaaaaagaaactggagggacagatctcagcccggcaacaagcagaagaagcttcacaggagtcagaaaacgaactcaaggaaatgatagaaacccttgctcggaagctgaatgagaaatccaaagagcaaatggaacttcaccaccagaatctgaatctccaagaaacactgaagagagtagcaaattgttcaggacttcatccagcaagcaatttcctattccagttttccattctggatggggctgtctcggaggaaccccagctacccatggctctgggaggacggttctcctttgatgccccacttatttagagtccgaggcgctgtctcccagacatacccttcaggtacctgtgcatatatacaacgaggagctgtttatgcggaaaactgcattttagctgccttcagtatatgtcagaagaaggcaaacctaagagcacagtgaatttgaaggctctggaagaaaagaaaaaagtctttgagttttattctggaatttaagctattctttgtcacttgggtgccaaacatgagagcccagaaaactgtcatttagctggctgcagaactcctttgcagaaactggggttccaggagcctggcacctttatgtcaacatttttgattctagctacctgtattatttcacctagcttgt

SEQ ID NO: 163071 - DNA, 516 bp, Homo sapiens
  Payload ID: 12138
  Gene Symbol: OLR1
  Gene Name: oxidized low density lipoprotein (lectin-like) receptor 1
  ENST ID: ENST00000538873
  CDS Start-End: 346-516
acaagtgtttgcaatgttcctgacattaaacaaaatactgcaggaatattcaagaacctccaaatctgtaacttctgagtaaatctgggtcatttttcagcagcttatctattgtcaaaatagatttaattctgttttgatttcctcaaaaagtccctggagggatttttatttggattagaactagagtcttaatgcaactgtgattcagtatcccaggtgtctgacctcctaacacaagagcaagcaaacctaactcaccagaaaaagaaactggagggacagatctcagcccggcaacaagcagaagaagcttcacaggagtcagaaaacgaactcaaggaaatgatagaaacccttgctcggaagctgaatgagaaatccaaagagcaaatggaacttcaccaccagaatctgaatctccaagaaacactgaagagagtagcaaattgttcagctccttgtccgcaagactggatctggcatggagaaaactgttacctattttcctcgggc

SEQ ID NO: 163072 - DNA, 580 bp, Homo sapiens
  Payload ID: 12138
  Gene Symbol: OLR1
  Gene Name: oxidized low density lipoprotein (lectin-like) receptor 1
  ENST ID: ENST00000538745
  CDS Start-End: 213-580
agaatgggaggagacacagcagaggaattgagacataaatagagtaaatcgctaatgacatttcctactaatagtcactgagtctggtgtctgacctcctaacacaagagcaagcaaacctaactcaccagaaaaagaaactggagggacagatctcagcccggcaacaagcagaagaagcttcacaggagtcagaaaacgaactcaaggaaatgatagaaacccttgctcggaagctgaatgagaaatccaaagagcaaatggaacttcaccaccagaatctgaatctccaagaaacactgaagagagtagcaaattgttcagctccttgtccgcaagactggatctggcatggagaaaactgttacctattttcctcgggctcatttaactgggaaaagagccaagagaagtgcttgtctttggatgccaagttgctgaaaattaatagcacagctgatctggacttcatccagcaagcaatttcctattccagttttccattctggatggggctgtctcggaggaaccccagctacccatggctctgggaggacggttctcctttgatgccccactt

SEQ ID NO: 163073 - DNA, 1008 bp, Homo sapiens
  Payload ID: 12138
  Gene Symbol: OLR1
  Gene Name: oxidized low density lipoprotein (lectin-like) receptor 1
  Uniprot ID: P78380
  ENST ID: ENST00000545927
  CDS Start-End: 41-610
gtgactgcttcactctctcattcttagcttgaatttggaaatgacttttgatgacctaaagatccagactgtgaaggaccagcctgatgagaagtcaaatggaaaaaaagctaaaggtcttcagtttctttactctccatggtggtgcctggctgctgcgactctaggggtcctttgcctgggattagtagtgaccattatggtgctgggcatgcaattatcccaggtgtctgacctcctaacacaagagcaagcaaacctaactcaccagaaaaagaaactggagggacagatctcagcccggcaacaagcagaagaagcttcacaggagtcagaaaacgaactcaaggaaatgatagaaacccttgctcggaagctgaatgagaaatccaaagagcaaatggaacttcaccaccagaatctgaatctccaagaaacactgaagagagtagcaaattgttcagctccttgtccgcaagactggatctggcatggagaaaactgttacctattttcctcgggctcatttaactgggaaaagagccaagagaagtgcttgtctttggatgccaagttgctgaaaattaatagcacagctgatctgatttagagtccgaggcgctgtctcccagacatacccttcaggtacctgtgcatatatacaacgaggagctgtttatgcggaaaactgcattttagctgccttcagtatatgtcagaagaaggcaaacctaagagcacagtgaatttgaaggctctggaagaaaagaaaaaagtctttgagttttattctggaatttaagctattctttgtcacttgggtgccaaacatgagagcccagaaaactgtcatttagctggctgcagaactcctttgcagaaactggggttccaggagcctggcacctttatgtcaacatttttgattctagctacctgtattatttcacctagcttgtcccaagcttccctgccagcctgaagtccattttcccctttttattttaa

SEQ ID NO: 163074 - DNA, 732 bp, Homo sapiens
  Payload ID: 12138
  Gene Symbol: OLR1
  Gene Name: oxidized low density lipoprotein (lectin-like) receptor 1
  ENST ID: ENST00000539518
  CDS Start-End: 91-732
actctaggtcttcagtttctttactctccatggtggtgcctggctgctgcgactctaggggtcctttgcctgggattagtagtgaccattatggtgctgggcatgcaattatcccaggtgtctgacctcctaacacaagagcaagcaaacctaactcaccagaaaaagaaactggagggacagatctcagcccggcaacaagcagaagaagcttcacaggagtcagaaaacgaactcaaggaaatgatagaaacccttgctcggaagctgaatgagaaatccaaagagcaaatggaacttcaccaccagaatctgaatctccaagaaacactgaagagagtagcaaattgttcagctccttgtccgcaagactggatctggcatggagaaaactgttacctattttcctcgggctcatttaactgggaaaagagccaagagaagtgcttgtctttggatgccaagttgctgaaaattaatagcacagctgatctggacttcatccagcaagcaatttcctattccagttttccattctggatggggctgtctcggaggaaccccagctacccatggctctgggaggacggttctcctttgatgccccacttatttagagtccgaggcgctgtctcccagacatacccttcaggtacctgtgcatatatacaacgaggagctgtttatgcggaaaactgcattttagctgccttcagtatatgtcagaagaag

SEQ ID NO: 163075 - DNA, 466 bp, Homo sapiens
  Payload ID: 12138
  Gene Symbol: OLR1
  Gene Name: oxidized low density lipoprotein (lectin-like) receptor 1
  ENST ID: ENST00000543414
  CDS Start-End: 154-466
attatttgcaagagacacagctatcttctacaacttctctgctagcttgccacacacactctagaagccagtcttcagtttctttactctccatggtggtgcctggctgctgcgactctaggggtcctttgcctgggattagtagtgaccattatggtgctgggcatgcaattatcccaggtgtctgacctcctaacacaagagcaagcaaacctaactcaccagaaaaagaaactggagggacagatctcagcccggcaacaagcagaagaagcttcacaggagtcagaaaacgaactcaaggaaatgatagaaacccttgctcggaagctgaatgagaaatccaaagagcaaatggaacttcaccaccagaatctgaatctccaagaaacactgaagagagtagcaaattgttcagctccttgtccgcaagactggatctggcatggagaaaactgttacctat

SEQ ID NO: 163076 - DNA, 924 bp, Homo sapiens
  Payload ID: 12138
  Gene Symbol: OLR1
  Gene Name: oxidized low density lipoprotein (lectin-like) receptor 1
  ENST ID: ENST00000544577
  CDS Start-End: 62-559
atttttagtttgttgaagttcgtgactgcttcactctctcattcttagcttgaatttggaaatgacttttgatgacctaaagatccagactgtgaaggaccagcctgatgagaagtcaaatggaaaaaaagctaaaggtcttcagtttctttactctccatggtggtgcctggctgctgcgactctaggggtcctttgcctgggattagtagtgaccattatggtgctgggcatgcaattatcccaggtgtctgacctcctaacacaagagcaagcaaacctaactcaccagaaaaagaaactggagggacagatctcagcccggcaacaagcagaagaagcttcacaggagtcagaaaacgaactcaaggaaatgatagaaacccttgctcggaagctgaatgagaaatccaaagagcaaatggaacttcaccaccagaatctgaatctccaagaaacactgaagagagtagcaaattgttcagctgtttatgcggaaaactgcattttagctgccttcagtatatgtcagaagaaggcaaacctaagagcacagtgaatttgaaggctctggaagaaaagaaaaaagtctttgagttttattctggaatttaagctattctttgtcacttgggtgccaaacatgagagcccagaaaactgtcatttagctggctgcagaactcctttgcagaaactggggttccaggagcctggcacctttatgtcaacatttttgattctagctacctgtattatttcacctagcttgtcccaagcttccctgccagcctgaagtccattttcccctttttattttaaaatttgactcctcttcaagcttgaaaaccctctgaactcagtcttctttacctcattatcaccttcccctcacactcctaaaattgcatgaaagacagaacat

SEQ ID NO: 163077 - DNA, 822 bp, Homo sapiens
  Payload ID: 12138
  Gene Symbol: OLR1
  Gene Name: oxidized low density lipoprotein (lectin-like) receptor 1
  ENST ID: ENST00000543993
  CDS Start-End: 157-390
ctactaatagtcactgagtctgtatcccaggtgtctgacctcctaacacaagagcaagcaaacctaactcaccagaaaaagaaactggagggacagatctcagcccggcaacaagcagaagaagcttcacaggagtcagaaaacgaactcaaggaaatgatagaaacccttgctcggaagctgaatgagaaatccaaagagcaaatggaacttcaccaccagaatctgaatctccaagaaacactgaagagagtagcaaattgttcaggacttcatccagcaagcaatttcctattccagttttccattctggatggggctgtctcggaggaaccccagctacccatggctctgggaggacggttctcctttgatgccccacttatttagagtccgaggcgctgtctcccagacatacccttcaggtacctgtgcatatatacaacgaggagctgtttatgcggaaaactgcattttagctgccttcagtatatgtcagaagaaggcaaacctaagagcacagtgaatttgaaggctctggaagaaaagaaaaaagtctttgagttttattctggaatttaagctattctttgtcacttgggtgccaaacatgagagcccagaaaactgtcatttagctggctgcagaactcctttgcagaaactggggttccaggagcctggcacctttatgtcaacatttttgattctagctacctgtattatttcacctagcttgtcccaagcttccctgccagcctgaagtccattttcccctttttattttaaaatttgactcctcttcaagcttgaaaaccctctg

SEQ ID NO: 163078 - DNA, 3929 bp, Homo sapiens
  Payload ID: 12139
  Gene Symbol: OXNAD1
  Gene Name: oxidoreductase NAD-binding domain containing 1
  Uniprot ID: Q96HP4
  ENST ID: ENST00000285083
  CDS Start-End: 466-1404
ctgggaccgcggagtattccaggcgcctgcaactaaacgtggccgggtctgcaagctaggtgccagcggggaaagtttccctgcttcttatcgtctgctttaacgccttaaatagcccgctgaaggctgcagcaggtgctaggtagcagcctcccggccctcgggaaaggcggggtggggaggcgagagcagcttagcctcctcgacctcccttcctggtgacggacgaacagttcccgtagaatttcgcttcaccgagtgaccttgagcccagggcgacggtcagcttgttaattcctggctgcaggaactttgtgagaattttaatgcatggaaaagctgtccatgttccaactgctgtacatccaaaagtctcagtgtaatagcaggaccaaaatattctgtcaatcagctgaccatatacttaatgactcctaaaatctcgtggacttctaagaaagcgccatggcctgtgctgctgttatgattcctgggttgttgcggtgctctgttggagccatccgtattgaggctgcgtcactgagattgacactcagcactttgcgccaccttactctaaccagcataatgaaatccaaaaggaaaactgatcacatggagagaactgcaagtgtccttcgacgggagattgtgtcagcagctaaggtgtgtggagctgccagtgagtcaccgtcagtgaagagcctccgcttgcttgttgctgatcaagacttttcctttaaagctggccagtgggttgatttctttattccaggagtctctgtggttggtgggttttcaatatgctccagtcccagactgctagaacaagagagagtgatagaattggcagtgaaatatacgaaccaccctcctgccctctgggttcacaatacgtgtacacttgactgtgaagtggctgtgagagtgggtggagagttcttctttgaccctcagcctgcggatgcctctagaaacctcgtgttgattgcaggaggagtcggaattaaccctctgctttccatcctgcggcacgcagcagatctcctcagagagcaggcaaacaaaagaaatggatatgagataggaacaataaaactattctacagtgcaaaaaataccagcgaactcctgtttaagaaaaatatccttgatttagtaaatgaatttcctgagaagattgcatgcagtttgcatgttacaaaacagactacacaaatcaatgcggaactcaagccatacatcacggaaggaagaataacggagaaggagataagagatcatatttcaaaagagactttgttctatatttgtggcccacctccaatgacagactttttctccaagcaactggaaaacaaccatgtacccaaagaacacatttgctttgagaagtggtggtaggaggcagacaaaggcagaaaaaataaagaggtgagatctactcaggagagctcctgtcctttgtggcatgattaattttttttatctctacttgagttgtcttattttttaaggctataaacttagtgaccagctggataataaaagccagctggcagacttaaatgataaactttttgcaaagacctcagtgatcaaactattttttactatactgattttctgttattaacaacgatttaattgtctcatgatgtaccatgattggtcagtatagatttttcttttgtctttaggcaaaaaaaagatatatacttatgtctaatcataggaaaatgtgatttttgagtataaaatgtgggctagctttaaattatttgacagccatctatatatcttatgtttaatgaaagtataatttaaatacaatcttaataattttactttgaaaattctttttatttaatgcctttgtttactgtaccatggcctacagtcttatttggtccatcaaagttaagtttggacatggaaaattgttaggaaaactgctttagggagttaaatatccagcatatttgctttcttgttaatgaatatcctaagtgtgtatcctgactaattgttagtttcttctcaaatgaaaccctttctgtgtcttggctgtctgccttaacgctgtaggaggcagcttcttgcttgggacaaaggcattggtgatgtgttccatgttgaatctgccttcagtgcctgggctggcttgctatggaaatgtgcttagcattgattagggggtagagagctgtttctaaatcctgcttttctactttttatttcactcatttgccagaattgttcttggcaccagcagctccttaacatatagttgttgaatgactgaaagaaagcaactaatgttttaactccttgctaagtctgagattgggaggcagtcccctagagtggatagaaagaatggtggagcctcatcccaaagctgctctgatgaaactgctagaaagcagattgtagttctttgtttagatttttaaaaatccaaaagaagtcctgactgaggccaggccattccttttatgacaagtagtcctgggcccaaggttgcctgcatagagatcacaggagggtgaagggagcctgggaagaaggacagataagtgctggagacctaggagctccagttgagattctgttctggagcggatgagagaagacaggttaccctttcttatctttgttgttgcaggcctcccagggacttgtgggcttgaacagatatgattcatgggacctgaaggtgactctagcttctgcccagttttgagttttgtcaagttttaagcagagatcatttgtcaactattttgatcccagatttgaatttggggaggaagggaggagctactgacctgatgggaatatcataatccattcaaggaaatggtcattagtacctcagaggtgaagggaatatgtgaagctctggatcactacaaggagccctgacttaccagttggccccaaagtgcccaggctgagggcataggagcatgatgagatgcaaggatgtgggattatcaaggggcacgtctactaactggtgaaggcagtctgcgggggaggacacctaaaggtatgcggaaagtacctaacccagacctctctgcattaggagtggaggtgcaaagtgagcatctccagtgcagcatgggatgggaagatagggaggtgtcgcccactgtctcggtttagccagcaccacggctggctgtgtgcctgctactgtcagagagcaagggtcatctgtcctgcccagctatgcctgccaccctgttgctgactcagtattggcagaattgctgagatgggccaggtcatcacctttgcctggagtgttcatcctttcagtgccattattctggtgctaagtgctgaagaacattttcaggtctagccgagaatgtcctcttgctcttgcctgccaggcctgtccagatctttttggtacttaaattgagctaactccagccagagtggcttggaattcatagtgcggtggctcagagtataggctcgaaagcccttgagccagattgcctgggttcagatctcacctatactacttactaggtagatgaccttgagcaagtcacttaactgctctatgcctcatttaaaattacatacaactacatgtaaaagggagatgatactgctgcctacctacctacatgatagggctgttacggggattgaaggtgatcatacatgtaaagtgcttggcagagcactgcatgagtgtgttgtcgttattaatttgctattccttgtcctattcagaaaggatttcaagaggctggatgccttagatgtggtctaacttgaaaccttcatgtgggtgtgcgtctgtcttgtttattgctgtgccaggcacaaaataggtatttcataaatatttgttaatatgctcagagttgataagctggattaaagtgacttcttaagga

SEQ ID NO: 163079 - DNA, 1643 bp, Homo sapiens
  Payload ID: 12139
  Gene Symbol: OXNAD1
  Gene Name: oxidoreductase NAD-binding domain containing 1
  ENST ID: ENST00000435829
  CDS Start-End: 417-1409
gagtattccaggcgcctgcaactaaacgtggccgggtctgcaagctaggtgccagcggggaaagtttccctgcttcttatcgtctgctttaacgccttaaatagcccgctgaaggctgcagcaggtgctaggtagcagcctcccggccctcgggaaaggcggggtggggaggcgagagcagcttagcctcctcgacctcccttcctggtgacggacgaacagttcccgtagaatttcgcttcaccgagtgaccttgagcccagggcgacggtcagcttgttaattcctggctgcaggaactttgtgagaattttaatgcatggaaaagctgtccatgttccaactgctgtacatccaaaagtctcagtgtaatagcaggaccaaaatattctgtcaatcagctgaccatatacttaatgactcctaaaatctcgtggacttctaagttttctgtttgcccagaaagcgccatggcctgtgctgctgttatgattcctgggttgttgcggtgctctgttggagccatccgtattgaggctgcgtcactgagattgacactcagcactttgcgccaccttactctaaccagcataatgaaatccaaaaggaaaactgatcacatggagagaactgcaagtgtccttcgacgggagattgtgtcagcagctaaggtgtgtggagctgccagtgagtcaccgtcagtgaagagcctccgcttgcttgttgctgatcaagacttttcctttaaagctggccagtgggttgatttctttattccaggagtctctgtggttggtgggttttcaatatgctccagtcccagactgctagaacaagagagagtgatagaattggcagtgaaatatacgaaccaccctcctgccctctgggttcacaatacgtgtacacttgactgtgaagtggctgtgagagtgggtggagagttcttctttgaccctcagcctgcggatgcctctagaaacctcgtgttgattgcaggaggagtcggaattaaccctctgctttccatcctgcggcacgcagcagatctcctcagagagcaggcaaacaaaagaaatggatatgagataggaacaataaaactattctacagtgcaaaaaataccagcgaactcctgtttaagaaaaatatccttgatttagtaaatgaatttcctgagaagattgcatgcagtttgcatgttacaaaacagactacacaaatcaatgcggaactcaagccatacatcacggaaggaagaataacggagaaggagataagagatcatatttcaaaagagactttgttctatatttgtggcccacctccaatgacagactttttctccaagcaactggaaaacaaccatgtacccaaagaacacatttgctttgagaagtggtggtaggaggcagacaaaggcagaaaaaataaagaggaaccctgcctacgccatgaggacaggcccaggctagccttcggatgatgagagacctgtggccctgctaagcagcagacgtgagagatgccatcttggagctgctagctgtggtccacccatcagcgcctgcaggcacatgctgagattagtcgatttcctaaaagttgaaggaaaaatcacccagctgacctgtttgggtta

SEQ ID NO: 163080 - DNA, 960 bp, Homo sapiens
  Payload ID: 12139
  Gene Symbol: OXNAD1
  Gene Name: oxidoreductase NAD-binding domain containing 1
  ENST ID: ENST00000452581
  CDS Start-End: 432-602
aaacgtggccgggtctgcaagctaggtgccagcggggaaagtttccctgcttcttatcgtctgctttaacgccttaaatagcccgctgaaggctgcagcaggtgctaggtagcagcctcccggccctcgggaaaggcggggtggggaggcgagagcagcttagcctcctcgacctcccttcctggtgacggacgaacagttcccgtagaatttcgcttcaccgagtgaccttgagcccagggcgacggtcagcttgttaattcctggctgcaggaactttgtgagaattttaatgcatggaaaagctgtccatgttccaactgctgtacatccaaaagtctcagtgtaatagcaggaccaaaatattctgtcaatcagctgaccatatacttaatgactcctaaaatctcgtggacttctaagaaagcgccatggcctgtgctgctgttatgattcctgggttgttgcggtgctctgttggagccatccgtattgaggctgcgtcactgagattgacactcagcactttgcgccaccttactctaaccagattgtgtcagcagctaaggtgtgtggagctgccagtgagtcaccgtcagtgaagagcctccgcttgcttgttgctgatcaagacttttcctttaaagctggccagtgggttgatttctttattccaggagtctctgtggttggtgggttttcaatatgctccagtcccagactgctagaacaagagagagtgatagaattggcagtgaaatatacgaaccaccctcctgccctctgggttcacaatacgtgtacacttgactgtgaagtggctgtgagagtgggtggagagttcttctttgaccctcagcctgcggatgcctctagaaacctcgtgttgattgcaggaggagtcggaattaaccctctgctttccatcctgcggcacgcagcagatctcctcagagagca

SEQ ID NO: 163081 - DNA, 1994 bp, Homo sapiens
  Payload ID: 12139
  Gene Symbol: OXNAD1
  Gene Name: oxidoreductase NAD-binding domain containing 1
  ENST ID: ENST00000442255
  CDS Start-End: 458-673
gcggagtattccaggcgcctgcaactaaacgtggccgggtctgcaagctaggtgccagcggggaaagtttccctgcttcttatcgtctgctttaacgccttaaatagcccgctgaaggctgcagcaggtgctaggtagcagcctcccggccctcgggaaaggcggggtggggaggcgagagcagcttagcctcctcgacctcccttcctggtgacggacgaacagttcccgtagaatttcgcttcaccgagtgaccttgagcccagggcgacggtcagcttgttaattcctggctgcaggaactttgtgagaattttaatgcatggaaaagctgtccatgttccaactgctgtacatccaaaagtctcagtgtaatagcaggaccaaaatattctgtcaatcagctgaccatatacttaatgactcctaaaatctcgtggacttctaagaaagcgccatggcctgtgctgctgttatgattcctgggttgttgcggtgctctgttggagccatccgtattgaggctgcgtcactgagattgacactcagcactttgcgccaccttactctaaccagcataatgaaatccaaaaggaaaactgatcacatggagagaactgcaagtgtccttcgacgggagagcaacttatttcatcaagggagaaagcactaacatctgagaaaggaaagtggacgagctcttgttacccttctaatgtacagattttttccaccatattcagactatagaaagctaatctaccacctgaaggggtgtcaagggctgagaaataaaggatcctcaccctttacctcaattgtgtcagcagctaaggtgtgtggagctgccagtgagtcaccgtcagtgaagagcctccgcttgcttgttgctgatcaagacttttcctttaaagctggccagtgggttgatttctttattccaggagtctctgtggttggtgggttttcaatatgctccagtcccagactgctagaacaagagagagtgatagaattggcagtgaaatatacgaaccaccctcctgccctctgggttcacaatacgtgtacacttgactgtgaagtggctgtgagagtgggtggagagttcttctttgaccctcagcctgcggatgcctctagaaacctcgtgttgattgcaggaggagtcggaattaaccctctgctttccatcctgcggcacgcagcagatctcctcagagagcaggcaaacaaaagaaatggatatgagataggaacaataaaactattctacagtgcaaaaaataccagcgaactcctgtttaagaaaaatatccttgatttagtaaatgaatttcctgagaagattgcatgcagtttgcatgttacaaaacagactacacaaatcaatgcggaactcaagccatacatcacggaaggaagaataacggagaaggagataagagatcatatttcaaaagagactttgttctatatttgtggcccacctccaatgacagactttttctccaagcaactggaaaacaaccatgtacccaaagaacacatttgctttgagaagtggtggtaggaggcagacaaaggcagaaaaaataaagaggtgagatctactcaggagagctcctgtcctttgtggcatgattaattttttttatctctacttgagttgtcttattttttaaggctataaacttagtgaccagctggataataaaagccagctggcagacttaaatgataaactttttgcaaagacctcagtgatcaaactattttttactatactgattttctgttattaacaacgatttaattgtctcatgatgtaccatgattggtcagtatagatttttcttttgtctttaggcaaaaaaaagatatatacttatgtctaatcataggaaaatgtgatttttgagtataaaatgtgggctagctttaaattatttgacagccatctatatatcttatgtttaatgaaagtataattt

SEQ ID NO: 163082 - DNA, 1681 bp, Homo sapiens
  Payload ID: 12139
  Gene Symbol: OXNAD1
  Gene Name: oxidoreductase NAD-binding domain containing 1
  Uniprot ID: Q96HP4
  ENST ID: ENST00000605932
  CDS Start-End: 463-1401
ggaccgcggagtattccaggcgcctgcaactaaacgtggccgggtctgcaagctaggtgccagcggggaaagtttccctgcttcttatcgtctgctttaacgccttaaatagcccgctgaaggctgcagcaggtgctaggtagcagcctcccggccctcgggaaaggcggggtggggaggcgagagcagcttagcctcctcgacctcccttcctggtgacggacgaacagttcccgtagaatttcgcttcaccgagtgaccttgagcccagggcgacggtcagcttgttaattcctggctgcaggaactttgtgagaattttaatgcatggaaaagctgtccatgttccaactgctgtacatccaaaagtctcagtgtaatagcaggaccaaaatattctgtcaatcagctgaccatatacttaatgactcctaaaatctcgtggacttctaagaaagcgccatggcctgtgctgctgttatgattcctgggttgttgcggtgctctgttggagccatccgtattgaggctgcgtcactgagattgacactcagcactttgcgccaccttactctaaccagcataatgaaatccaaaaggaaaactgatcacatggagagaactgcaagtgtccttcgacgggagattgtgtcagcagctaaggtgtgtggagctgccagtgagtcaccgtcagtgaagagcctccgcttgcttgttgctgatcaagacttttcctttaaagctggccagtgggttgatttctttattccaggagtctctgtggttggtgggttttcaatatgctccagtcccagactgctagaacaagagagagtgatagaattggcagtgaaatatacgaaccaccctcctgccctctgggttcacaatacgtgtacacttgactgtgaagtggctgtgagagtgggtggagagttcttctttgaccctcagcctgcggatgcctctagaaacctcgtgttgattgcaggaggagtcggaattaaccctctgctttccatcctgcggcacgcagcagatctcctcagagagcaggcaaacaaaagaaatggatatgagataggaacaataaaactattctacagtgcaaaaaataccagcgaactcctgtttaagaaaaatatccttgatttagtaaatgaatttcctgagaagattgcatgcagtttgcatgttacaaaacagactacacaaatcaatgcggaactcaagccatacatcacggaaggaagaataacggagaaggagataagagatcatatttcaaaagagactttgttctatatttgtggcccacctccaatgacagactttttctccaagcaactggaaaacaaccatgtacccaaagaacacatttgctttgagaagtggtggtaggaggcagacaaaggcagaaaaaataaagaggaaccctgcctacgccatgaggacaggcccaggctagccttcggatgatgagagacctgtggccctgctaagcagcagacgtgagagatgccatcttggagctgctagctgtggtccacccatcagcgcctgcaggcacatgctgagattagtcgatttcctaaaagttgaaggaaaaatcacccagctgacctgtttgggttatgattttaactcactaagctttggggagctttattacacagcagaa

SEQ ID NO: 163083 - DNA, 2288 bp, Homo sapiens
  Payload ID: 12139
  Gene Symbol: OXNAD1
  Gene Name: oxidoreductase NAD-binding domain containing 1
  ENST ID: ENST00000606098
  CDS Start-End: 199-1134
agcccagggcgacggtcagcttgttaattcctggctgcaggaactttgtgagaattttaatgcatggaaaagctgtccatgttccaactgctgtacatccaaaagtctcagtgtaatagcaggaccaaaatattctgtcaatcagctgaccatatacttaatgactcctaaaatctcgtggacttctaagaaagcgccatggcctgtgctgctgttatgattcctgggttgttgcggtgctctgttggagccatccgtattgaggctgcgtcactgagattgacactcagcactttgcgccaccttactctaaccagcataatgaaatccaaaaggaaaactgatcacatggagagaactgcaagtgtccttcgacgggagattgtgtcagcagctaaggtgtgtggagctgccagtgagtcaccgtcagtgaagagcctccgcttgcttgttgctgatcaagacttttcctttaaagctggccagtgggttgatttctttattccaggagtctctgtggttggtgggttttcaatatgctccagtcccagactgctagaacaagagagagtgatagaattggcagtgaaatatacgaaccaccctcctgccctctgggttcacaatacgtgtacacttgactgtgaagtggctgtgagagtgggtggagagttcttctttgaccctcagcctgcggatgcctctagaaacctcgtgttgattgcaggaggagtcggaattaaccctctgctttccatcctgcggcacgcagcagatctcctcagagagcaggcaaacaaaagaaatggatatgagataggaacaataaaactattctacagtgcaaaaaataccagcgaactcctgtttaagaaaaatatccttgatttagtaaatgaatttcctgagaagattgcatgcagtttgcatgttacaaaacagactacacaaatcaatgcggaactcaagccatacatcacgggaagaataacggagaaggagataagagatcatatttcaaaagagactttgttctatatttgtggcccacctccaatgacagactttttctccaagcaactggaaaacaaccatgtacccaaagaacacatttgctttgagaagtggtggtaggaggcagacaaaggcagaaaaaataaagagcagaagagtactagcggccatctccagagacaagaagaaaaagaatttcagaggctcagaggaaagttcaatatggccccatggcaagaaatacaggcatgctggctccaggtggacttgtcaccctaagataaaagttggaggcaactaaggaaaaccactgtggctgtagagatggatgagtgtgaatttataaggacagaagggggtacctgagcctccagggatggtgacaaaagtaaggcaaacccaaaagaggaggaatgttgagcctggaatgagctgaggtgtgcaggtggcgtgaggtatacacacatgcacctcagcctagaatgagatgaggtatgtgaactacgtatgtgcatgtgtgcacacgtatacacatacgccatttaaaatcatgctcaaagcaagaagttgcacaagaaaagggtatgttcaagacaataaaaatgggattattcaactcctattttacttgcttttctacaaggagacaaatttggctaaagtctaagagactgtgaagttttctccccattaatggcatcacagcatttgtatctgattcatcaggattctcctgagaaagagaatcagtaggctatcttgtatctagaaagattcattttgaggaactggcttacatgactgtggaggatgtaaaatccaaagtttgcagggtagcccagcaggctggatattccagcaggagtcgatgttgcagttttgagtctgcaggctgaattccttcctcttccgggatctcaatcttttttcttaaggccttcaactgattgaagtccactcacattaggaagggtaatgtgctttactcttctactgagtggaatgttaatcacatctaaaaatactttcatagcaacatctagattggtgtttgatcaagtaagtgagtactatagcccaacaaagctgacataaaattaaccatcacaggacaattctgcaacttaattttctcgtttaacatttcctgtaattccttccatgtcagcttatacagaatgacctcatctataataagaatatattatcctttgtttaaccattcccctactgatggacatgaacattattaccttttttgatattacaagtaa

SEQ ID NO: 163084 - DNA, 3983 bp, Homo sapiens
  Payload ID: 12139
  Gene Symbol: OXNAD1
  Gene Name: oxidoreductase NAD-binding domain containing 1
  ENST ID: ENST00000627468
  CDS Start-End: 467-1459
caatagaatgtggggctcgcccgcgctgctacgtcacgtctgggaccgcggagtattccaggcgcctgcaactaaacgtggccgggtctgcaagctaggtgccagcggggaaagtttccctgcttcttatcgtctgctttaacgccttaaatagcccgctgaaggctgcagcaggtgctaggtagcagcctcccggccctcgggaaaggcggggtggggaggcgagagcagcttagcctcctcgacctcccttcctggtgacggacgaacagttcccgtagaatttcgcttcaccgagtgaccttgagcccagggcgacggtcagcttgttaattcctggctgcaggaactttgtgagaattttaatgcatggaaaagctgtccatgttccaactgctgtacatccaaaagtctcagtgtaatagcaggaccaaaatattctgtcaatcagctgaccatatacttaatgactcctaaaatctcgtggacttctaagttttctgtttgcccagaaagcgccatggcctgtgctgctgttatgattcctgggttgttgcggtgctctgttggagccatccgtattgaggctgcgtcactgagattgacactcagcactttgcgccaccttactctaaccagcataatgaaatccaaaaggaaaactgatcacatggagagaactgcaagtgtccttcgacgggagattgtgtcagcagctaaggtgtgtggagctgccagtgagtcaccgtcagtgaagagcctccgcttgcttgttgctgatcaagacttttcctttaaagctggccagtgggttgatttctttattccaggagtctctgtggttggtgggttttcaatatgctccagtcccagactgctagaacaagagagagtgatagaattggcagtgaaatatacgaaccaccctcctgccctctgggttcacaatacgtgtacacttgactgtgaagtggctgtgagagtgggtggagagttcttctttgaccctcagcctgcggatgcctctagaaacctcgtgttgattgcaggaggagtcggaattaaccctctgctttccatcctgcggcacgcagcagatctcctcagagagcaggcaaacaaaagaaatggatatgagataggaacaataaaactattctacagtgcaaaaaataccagcgaactcctgtttaagaaaaatatccttgatttagtaaatgaatttcctgagaagattgcatgcagtttgcatgttacaaaacagactacacaaatcaatgcggaactcaagccatacatcacggaaggaagaataacggagaaggagataagagatcatatttcaaaagagactttgttctatatttgtggcccacctccaatgacagactttttctccaagcaactggaaaacaaccatgtacccaaagaacacatttgctttgagaagtggtggtaggaggcagacaaaggcagaaaaaataaagaggtgagatctactcaggagagctcctgtcctttgtggcatgattaattttttttatctctacttgagttgtcttattttttaaggctataaacttagtgaccagctggataataaaagccagctggcagacttaaatgataaactttttgcaaagacctcagtgatcaaactattttttactatactgattttctgttattaacaacgatttaattgtctcatgatgtaccatgattggtcagtatagatttttcttttgtctttaggcaaaaaaaagatatatacttatgtctaatcataggaaaatgtgatttttgagtataaaatgtgggctagctttaaattatttgacagccatctatatatcttatgtttaatgaaagtataatttaaatacaatcttaataattttactttgaaaattctttttatttaatgcctttgtttactgtaccatggcctacagtcttatttggtccatcaaagttaagtttggacatggaaaattgttaggaaaactgctttagggagttaaatatccagcatatttgctttcttgttaatgaatatcctaagtgtgtatcctgactaattgttagtttcttctcaaatgaaaccctttctgtgtcttggctgtctgccttaacgctgtaggaggcagcttcttgcttgggacaaaggcattggtgatgtgttccatgttgaatctgccttcagtgcctgggctggcttgctatggaaatgtgcttagcattgattagggggtagagagctgtttctaaatcctgcttttctactttttatttcactcatttgccagaattgttcttggcaccagcagctccttaacatatagttgttgaatgactgaaagaaagcaactaatgttttaactccttgctaagtctgagattgggaggcagtcccctagagtggatagaaagaatggtggagcctcatcccaaagctgctctgatgaaactgctagaaagcagattgtagttctttgtttagatttttaaaaatccaaaagaagtcctgactgaggccaggccattccttttatgacaagtagtcctgggcccaaggttgcctgcatagagatcacaggagggtgaagggagcctgggaagaaggacagataagtgctggagacctaggagctccagttgagattctgttctggagcggatgagagaagacaggttaccctttcttatctttgttgttgcaggcctcccagggacttgtgggcttgaacagatatgattcatgggacctgaaggtgactctagcttctgcccagttttgagttttgtcaagttttaagcagagatcatttgtcaactattttgatcccagatttgaatttggggaggaagggaggagctactgacctgatgggaatatcataatccattcaaggaaatggtcattagtacctcagaggtgaagggaatatgtgaagctctggatcactacaaggagccctgacttaccagttggccccaaagtgcccaggctgagggcataggagcatgatgagatgcaaggatgtgggattatcaaggggcacgtctactaactggtgaaggcagtctgcgggggaggacacctaaaggtatgcggaaagtacctaacccagacctctctgcattaggagtggaggtgcaaagtgagcatctccagtgcagcatgggatgggaagatagggaggtgtcgcccactgtctcggtttagccagcaccacggctggctgtgtgcctgctactgtcagagagcaagggtcatctgtcctgcccagctatgcctgccaccctgttgctgactcagtattggcagaattgctgagatgggccaggtcatcacctttgcctggagtgttcatcctttcagtgccattattctggtgctaagtgctgaagaacattttcaggtctagccgagaatgtcctcttgctcttgcctgccaggcctgtccagatctttttggtacttaaattgagctaactccagccagagtggcttggaattcatagtgcggtggctcagagtataggctcgaaagcccttgagccagattgcctgggttcagatctcacctatactacttactaggtagatgaccttgagcaagtcacttaactgctctatgcctcatttaaaattacatacaactacatgtaaaagggagatgatactgctgcctacctacctacatgatagggctgttacggggattgaaggtgatcatacatgtaaagtgcttggcagagcactgcatgagtgtgttgtcgttattaatttgctattccttgtcctattcagaaaggatttcaagaggctggatgccttagatgtggtctaacttgaaaccttcatgtgggtgtgcgtctgtcttgtttattgctgtgccaggcacaaaataggtatttcataaatatttgttaatatgctcagagttgataagctggattaaagtgacttcttaagg

SEQ ID NO: 163085 - DNA, 620 bp, Homo sapiens
  Payload ID: 12140
  Gene Symbol: OXLD1
  Gene Name: oxidoreductase-like domain containing 1
  Uniprot ID: Q5BKU9
  ENST ID: ENST00000374741
  CDS Start-End: 12-455
gtccgcgggcgatgctgctgcggagggtggtcgagggaggccgggcggtagccgccgcggtccgtggctcgggggctcgccggttctccagcccggactgctgccagaggcttcctggaggtggcagctttcttcaaaggcaccatcccggagcgcaagcccctgatgggcgcagaaaattcgggacagaccacgtagaggtgggctcccaagcaggtgcggacggcaccaggccgcccaaggcatcgctgccacctgagctccagccgcccacaaactgctgcatgagtggctgccccaactgcgtgtgggtggagtacgcggacaggctgctgcagcacttccaggacggtggggagcgggccctggctgccctggaggagcacgtggctgatgagaacctcaaggccttcctcaggatggagatccggctgcacaccaggtgcggaggctgagccatccctgctggactccctaccgcaggacggagtccaggacgcagccgcagcctccttccttcacaccccctcacagactccttgtgtccaacgggaataggaagaattagttactgacttcacctgagaaaaaaataaattctctatggtggtttcacagga

SEQ ID NO: 163086 - DNA, 923 bp, Homo sapiens
  Payload ID: 12140
  Gene Symbol: OXLD1
  Gene Name: oxidoreductase-like domain containing 1
  ENST ID: ENST00000571757
  CDS Start-End: 57-335
ttggccggagcgcccgccgctcacggtcaggggttgccggatcccgtccgcgggcgatgctgctgcggagggtggtcgagggaggccgggcggtagccgccgcggtccgtggctcggcaagtaccaggacgggtcttggcagcgccgaagggcacgtccgagaggccgctgtccgggggcccgcacgtaccgggaggagccccggcccctccacccgcatgtggggacggagccgggaggatcgcgcgctggccgccgccgaaggacccctcgctcctctcctccatcggctcttaccgagtccccgccccggaatctgtggaggggccgcttagccttgggagaggaagcagcccggtgaacggccactttcctgtttctcagtatctgccgagcgcctgtgtgcgagccctcctgggctctggggactggccgtggacatggagcggatgatgcccctcgcaggactagttaaataaggggctcgccggttctccagcccggactgctgccagaggcttcctggaggtggcagctttcttcaaaggcaccatcccggagcgcaagcccctgatgggcgcagaaaattcgggacagaccacgtagaggtgggctcccaagcaggtgcggacggcaccaggccgcccaaggcatcgctgccacctgagctccagccgcccacaaactgctgcatgagtggctgccccaactgcgtgtgggtggagtacgcggacaggctgctgcagcacttccaggacggtggggagcgggccctggctgccctggaggagcacgtggctgatgagaacctcaaggccttcctcaggatggagatccggctgcacaccaggtgcggaggctgagccatccctgctggactccctaccgcaggacggagtccaggacgcagccgcagcctcctt

SEQ ID NO: 163087 - DNA, 553 bp, Homo sapiens
  Payload ID: 12140
  Gene Symbol: OXLD1
  Gene Name: oxidoreductase-like domain containing 1
  ENST ID: ENST00000571092
  CDS Start-End: 2-280
gatgctgctgcggagggtggtcgagggaggccgggcggtagccgccgcggtccgtggctcggcaagtaccaggacgggtcttggcagcgccgaagggcacgtccgagaggccgctgtccgggggcccgcacgtaccgggaggagccccggcccctccacccgcatgtggggacggagccgggaggatcgcgcgctggccgccgccgaaggacccctcgctcctctcctccatcggctcttaccgagtccccgccccggaatctgtggaggggccgcttagccttgggagaggaagcagcccggtgaacggccactttcctgtttctcagtatctgccgagcgcctgtgtgcgagccctcctgggctctggggactggccgtggacatggagcggatgatgcccctcgcaggactagttaaataagtgaaggggctcgccggttctccagcccggactgctgccagaggcttcctggaggtggcagctttcttcaaaggcaccatcccggagcgcaagcccctgatgggcgcagaaaattcgggacagaccacg

SEQ ID NO: 163088 - DNA, 821 bp, Homo sapiens
  Payload ID: 12140
  Gene Symbol: OXLD1
  Gene Name: oxidoreductase-like domain containing 1
  ENST ID: ENST00000575992
  CDS Start-End: 1-239
ccgccgcggtccgtggctcggcaagtaccaggacgggtcttggcagcgccgaagggcacgtccgagaggccgctgtccgggggcccgcacgtaccgggaggagccccggcccctccacccgcatgtggggacggagccgggaggatcgcgcgctggccgccgccgaaggacccctcgctcctctcctccatcggctcttaccgagtccccgccccggaatctgtggaggggccgcttagccttgggagaggaagcagcccggtgaacggccactttcctgtttctcagtatctgccgagcgcctgtgtgcgagccctcctgggctctggggactggccgtggacatggagcggatgatgcccctcgcaggactagttaaataagtgaagttgggggctcgccggttctccagcccggactgctgccagaggcttcctggaggtggcagctttcttcaaaggcaccatcccggagcgcaagcccctgatgggcgcagaaaattcgggacagaccacgtagaggtgggctcccaagcaggtgcggacggcaccaggccgcccaaggcatcgctgccacctgagctccagccgcccacaaactgctgcatgagtggctgccccaactgcgtgtgggtggagtacgcggacaggctgctgcagcacttccaggacggtggggagcgggccctggctgccctggaggagcacgtggctgatgagaacctcaaggccttcctcaggatggagatccggctgcacaccaggtgcggaggctgagccatccctgctggactccctaccgcaggacggagtccaggacgc

SEQ ID NO: 163089 - DNA, 803 bp, Homo sapiens
  Payload ID: 12140
  Gene Symbol: OXLD1
  Gene Name: oxidoreductase-like domain containing 1
  ENST ID: ENST00000571503
  CDS Start-End: 19-297
ggatcccgtccgcgggcgatgctgctgcggagggtggtcgagggaggccgggcggtagccgccgcggtccgtggctcggcaagtaccaggacgggtcttggcagcgccgaagggcacgtccgagaggccgctgtccgggggcccgcacgtaccgggaggagccccggcccctccacccgcatgtggggacggagccgggaggatcgcgcgctggccgccgccgaaggacccctcgctcctctcctccatcggctcttaccgagtccccgccccggaatctgtggaggggccgcttagccttgggagaggaagcagcccgggggctcgccggttctccagcccggactgctgccagaggcttcctggaggtggcagctttcttcaaaggcaccatcccggagcgcaagcccctgatgggcgcagaaaattcgggacagaccacgtagaggtgggctcccaagcaggtgcggacggcaccaggccgcccaaggcatcgctgccacctgagctccagccgcccacaaactgctgcatgagtggctgccccaactgcgtgtgggtggagtacgcggacaggctgctgcagcacttccaggacggtggggagcgggccctggctgccctggaggagcacgtggctgatgagaacctcaaggccttcctcaggatggagatccggctgcacaccaggtgcggaggctgagccatccctgctggactccctaccgcaggacggagtccaggacgcagccgcagcctccttccttcacaccccctcacagactccttgtgtccaacgggaa

SEQ ID NO: 163090 - DNA, 1781 bp, Homo sapiens
  Payload ID: 12141
  Gene Symbol: OXER1
  Gene Name: oxoeicosanoid (OXE) receptor 1
  Uniprot ID: Q8TDS5
  ENST ID: ENST00000378661
  CDS Start-End: 83-1354
ggctgcagggttccccttggcctgcaaacaggaacacagggtgtttctcagtggctgcgagaatgctgatgaaaaccccaggatgttgtgtcaccgtggtggccagctgatagtgccaatcatcccactttgccctgagcactcctgcaggggtagaagactccagaaccttctctcaggcccatggcccaagcagcccatggaacttcataacctgagctctccatctccctctctctcctcctctgttctccctccctccttctctccctcaccctcctctgctccctctgcctttaccactgtgggggggtcctctggagggccctgccaccccacctcttcctcgctggtgtctgccttcctggcaccaatcctggccctggagtttgtcctgggcctggtggggaacagtttggccctcttcatcttctgcatccacacgcggccctggacctccaacacggtgttcctggtcagcctggtggccgctgacttcctcctgatcagcaacctgcccctccgcgtggactactacctcctccatgagacctggcgctttggggctgctgcctgcaaagtcaacctcttcatgctgtccaccaaccgcacggccagcgttgtcttcctcacagccatcgcactcaaccgctacctgaaggtggtgcagccccaccacgtgctgagccgtgcttccgtgggggcagctgcccgggtggccgggggactctgggtgggcatcctgctcctcaacgggcacctgctcctgagcaccttctccggcccctcctgcctcagctacagggtgggcacgaagccctcggcctcgctccgctggcaccaggcactgtacctgctggagttcttcctgccactggcgctcatcctctttgctattgtgagcattgggctcaccatccggaaccgtggtctgggcgggcaggcaggcccgcagagggccatgcgtgtgctggccatggtggtggccgtctacaccatctgcttcttgcccagcatcatctttggcatggcttccatggtggctttctggctgtccgcctgccgatccctggacctctgcacacagctcttccatggctccctggccttcacctacctcaacagtgtcctggaccccgtgctctactgcttctctagccccaacttcctccaccagagccgggccttgctgggcctcacgcggggccggcagggcccagtgagcgacgagagctcctaccaaccctccaggcagtggcgctaccgggaggcctctaggaaggcggaggccatagggaagctgaaagtgcagggcgaggtctctctggaaaaggaaggctcctcccagggctgagggccagctgcagggctgcagcgctgtgggggtaagggctgccgcgctctggcctggagggacaaggccagcacacggtgcctcaaccaactggacaagggatggcggcagaccaggggccaggccaaagcactggcaggactcaggtgggtggcagggagagaaacccacctaggcctctcagtgtgtccaggatggcattcccagaatgcaggggagagcaggatgccgggtggaggagacaggcaaggtgccgttggcacaccagctcagacaggggcctgcgcagctgcaggggacagacgccaatcactgtcacagcagagtcaccttagaaattggacagctgcatgttctgtgctctccagtttgtcccttccaatattaataaacttcccttttaaatatatttatttgcaagaccaaa

SEQ ID NO: 163091 - DNA, 4181 bp, Homo sapiens
  Payload ID: 12142
  Gene Symbol: OGDH
  Gene Name: oxoglutarate (alpha-ketoglutarate) dehydrogenase (lipoamide)
  Uniprot ID: Q02218
  ENST ID: ENST00000222673
  CDS Start-End: 43-3114
ctgagccggagacaggcagttgtgaaaaacttcaggacaaaaatgtttcatttaaggacttgtgctgctaagttgaggccattgacggcttcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagtcatgggacattttttttcgcaacacgaatgccggagccccaccgggcactgcctaccagagtccccttcccctgagccgaggctccctggctgctgtggcccatgcacagtccctggtagaagcacagcccaacgtggacaagctcgtggaggaccacctggcagtgcagtcgctcatcagggcatatcagatacgagggcaccatgtagcacagctggaccccctggggattttggatgctgatctggactcctccgtgcccgctgacattatctcatccacagacaaacttgggttctatggcctggatgagtctgacctcgacaaggtcttccacttgcccaccaccactttcatcgggggacaggaatcagcacttcctctgcgggagatcatccgtcggctggagatggcctactgccagcatattggggtggagttcatgttcatcaatgacctggagcagtgccagtggatccggcagaagtttgagacccctgggatcatgcagttcacaaatgaggagaaacggaccctgctggccaggcttgtgcggtccaccaggtttgaggagttcctacagcggaagtggtcctctgagaagcgctttggtctagaaggctgcgaggtactgatccctgccctcaagaccatcattgacaagtctagtgagaatggcgtggactacgtgatcatgggcatgccacacagagggcggctgaacgtgcttgcaaatgtcatcaggaaggagctggaacagatcttctgtcaattcgattcaaagctggaggcagctgatgagggctccggagatgtgaagtaccacctgggcatgtatcaccgcaggatcaatcgtgtcaccgacaggaacattaccttgtccttggtggccaacccttcccaccttgaggccgctgaccccgtggtgatgggcaagaccaaagccgaacagttttactgtggcgacactgaagggaaaaaggtcatgtccatcctgttgcatggggatgctgcatttgctggccagggcattgtgtacgagaccttccacctcagcgacctgccatcctacacaactcatggcaccgtgcacgtggtcgtcaacaaccagatcggcttcaccaccgaccctcggatggcccgctcctccccctaccccactgacgtggcccgagtggtgaatgcccccattttccacgtgaactcagatgaccccgaggctgtcatgtacgtgtgcaaagtggcggccgagtggaggagcaccttccacaaggacgtggttgtcgatttggtgtgttaccggcgcaacggccacaacgagatggatgagcccatgttcacgcagccgctcatgtacaagcagatccgcaagcagaagcctgtgttacagaagtacgctgagctgctggtgtcgcagggtgtggtcaaccagcctgagtatgaggaggaaatttccaagtatgataagatctgtgaggaagcttttgccagatctaaagatgagaagatcttgcacattaagcactggctggactctccctggcctggcttcttcaccctggacgggcagcccaggagcatgtcctgcccctccacgggtctgacggaggatattctgacacacatcgggaatgtggctagttctgtgcctgtggaaaactttactattcatggagggctgagccggatcttgaagactcgtggggaaatggtgaagaaccggactgtggactgggctctagcggagtacatggcgtttggctcgctcctgaaggagggcatccacattcggctgagcggccaggacgtggagcggggcacattcagccaccgccaccatgtgctccatgaccagaatgtggacaagagaacctgcatccccatgaaccatctctggcccaatcaggccccctatactgtgtgcaacagctcactgtctgagtacggcgtgctgggctttgagctgggcttcgccatggccagtcctaatgccctggtcctctgggaagcccaatttggtgacttccacaacacggcccagtgtatcatcgaccagttcatctgcccgggacaagccaagtgggtgcggcagaatggcatcgtgttgctgctgccccatggcatggagggcatgggtccagaacattcctccgcccgcccagagcggttcttgcagatgtgcaacgatgacccagatgtcctgccagaccttaaagaagccaacttcgacatcaatcagctatatgactgcaattgggttgttgtcaactgctccactcctggcaacttcttccacgtgctacgacgccagatcctgctgccattccggaagccgttaattatcttcacccccaaatccctgttgcgccaccccgaggccagatccagctttgatgagatgcttccaggaacccacttccagcgggtgatcccagaagatggccctgcagctcagaacccagaaaatgtcaaaaggcttctcttctgcaccggcaaagtgtattatgacctcacccgggagcgcaaagcacgcgacatggtggggcaggtggccatcacaaggattgagcagctgtcgccattcccctttgacctcctgctgaaggaggtgcagaagtaccccaatgctgagctggcctggtgccaggaggagcacaagaaccaaggctactatgactacgtgaagccaagacttcggaccaccatcagccgcgccaagcccgtctggtatgccggccgggacccagcggctgctccagccaccggcaacaagaagacccacctgacggagctgcagcgcctcctggacacggccttcgacctggacgtcttcaagaacttctcgtagatgctgcctagggttgcttgggccactgccctctccacacccatgactgccccttgcttctcaactaaagaatagtgcctcagcgctgcccacaccaccgccctcctcgctgtgccaccacccctccctctgctctcataggagttaggctgtcgtccccctccagtgcttggctgccccacaggccacacgctgcccaggctctgctgacttctgagcagttttccaggaggccggggggagcaggaggaggaaaggtagcccccgagggatgtccttggggaggggtcagctctggccacaatcctccccaccagtctcacccactaggataggaactgggccttgtgtgctggcttccgctgtcacccagcaaggcacaggctcctgtatttgagactaggatagcttcatcttgagcctgagccttagaatctgtagaggagcctggagtcggatctagccatggctggcagaggtttctagggtgggccccagccgtggcgtgaactgaggatgacccggggcagctggcaggagagagccttggcctgacctggcacagaaagggcagcttcagtctctgcagtgtccattatctgctgttccttcgagggttccaggctgtgtgtggggcccaagcatgccccacccacccctcctgggcccaggcagcacctggagcccacagagtctgtgtgtagccaggaagccccgctcaggtagccaccaccggggcactggctgctctgtcttggtcctgttaaccctccacctcctctcttggactccctccccaccccaaccactctttctttctcctttaacccaatggagactttctgatgcatcgttttctttgctgtgccaaagcaggtcagaagagggagaggaggggctgggggtgaggggccaggccatggccaaggggccagctgcccctcatttatcactctgaccttcacagggacagatctgatttatttattttggttaaaaaaaaaaaaaaggaacagaaacaactttgcattgcattggcttgacccataaactaagttatatccgtg

SEQ ID NO: 163092 - DNA, 1744 bp, Homo sapiens
  Payload ID: 12142
  Gene Symbol: OGDH
  Gene Name: oxoglutarate (alpha-ketoglutarate) dehydrogenase (lipoamide)
  Uniprot ID: Q02218
  ENST ID: ENST00000443864
  CDS Start-End: 94-1377
ccgagagtttggagccccggagtggggtgtcggcgcctcattcgggtggagctgagccggagacaggcagttgtgaaaaacttcaggacaaaaatgtttcatttaaggacttgtgctgctaagttgaggccattgacggcttcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagtcatgggacattttttttcgcaacacgaatgccggagccccaccgggcactgcctaccagagtccccttcccctgagccgaggctccctggctgctgtggcccatgcacagtccctggtagaagcacagcccaacgtggacaagctcgtggaggaccacctggcagtgcagtcgctcatcagggcatatcagatacgagggcaccatgtagcacagctggaccccctggggattttggatgctgatctggactcctccgtgcccgctgacattatctcatccacagacaaacttgggttctatggcctggatgagtctgacctcgacaaggtcttccacttgcccaccaccactttcatcgggggacaggaatcagcacttcctctgcgggagatcatccgtcggctggagatggcctactgccagcatattggggtggagttcatgttcatcaatgacctggagcagtgccagtggatccggcagaagtttgagacccctgggatcatgcagttcacaaatgaggagaaacggaccctgctggccaggcttgtgcggtccaccaggtttgaggagttcctacagcggaagtggtcctctgagaagcgctttggtctagaaggctgcgaggtactgatccctgccctcaagaccatcattgacaagtctagtgagaatggcgtggactacgtgatcatgggcatgccacacagagggcggctgaacgtgcttgcaaatgtcatcaggaaggagctggaacagatcttctgtcaattcgattcaaagctggaggcagctgatgagggctccggagatgtgaagtaccacctgggcatgtatcaccgcaggatcaatcgtgtcaccgacaggaacattaccttgtccttggtggccaacccttcccaccttgaggccgctgaccccgtggtgatgggcaagaccaaagccgaacagttttactgtggcgacactgaagggaaaaaggtaaggcccagagagaggcgtgcaaggcagatcgtcaaggccccatgttccagcatggagttccgctcaccaacataacccagagccctgggtgcatctagactttaaaaaaatatttaaagtcggccgggcgcagtgtctcacgcctgtaatcccagcactttgggaggccgaggtgggcagatcacctgagttcgggagttggagaccagcctgaccaacatggagaaactccatctctactaaaaatacaaaattagctgggcgtggtggcgcgcgcctgtaatcccagctactcaggaggctgaggcaggagaatcgcttgaacccgggaggtggaggttgcagtgagccgagattacgccattgcactccagcctgggccaacaagagcgaaactctgtctcaaagaaaaaaataaataaataaaaaatatatgtatatg

SEQ ID NO: 163093 - DNA, 3474 bp, Homo sapiens
  Payload ID: 12142
  Gene Symbol: OGDH
  Gene Name: oxoglutarate (alpha-ketoglutarate) dehydrogenase (lipoamide)
  ENST ID: ENST00000447398
  CDS Start-End: 91-3195
agagtttggagccccggagtggggtgtcggcgcctcattcgggtggagctgagccggagacaggcagttgtgaaaaacttcaggacaaaaatgtttcatttaaggacttgtgctgctaagttgaggccattgacggcttcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagtcatgggacattttttttcgcaacacgaatgccggagccccaccgggcactgcctaccagagtccccttcccctgagccgaggctccctggctgctgtggcccatgcacagtccctggtagaagcacagcccaacgtggacaagctcgtggaggaccacctggcagtgcagtcgctcatcagggcatatcaggtcaggggtcaccacattgcaaaacttgatcctctcggaattagttgtgtaaattttgatgatgctccagtaactgtttcttcaaacgtggatcttgcagttttcaaggaacgacttcgaatgctaacagtaggagggttctatggcctggatgagtctgacctcgacaaggtcttccacttgcccaccaccactttcatcgggggacaggaatcagcacttcctctgcgggagatcatccgtcggctggagatggcctactgccagcatattggggtggagttcatgttcatcaatgacctggagcagtgccagtggatccggcagaagtttgagacccctgggatcatgcagttcacaaatgaggagaaacggaccctgctggccaggcttgtgcggtccaccaggtttgaggagttcctacagcggaagtggtcctctgagaagcgctttggtctagaaggctgcgaggtactgatccctgccctcaagaccatcattgacaagtctagtgagaatggcgtggactacgtgatcatgggcatgccacacagagggcggctgaacgtgcttgcaaatgtcatcaggaaggagctggaacagatcttctgtcaattcgattcaaagctggaggcagctgatgagggctccggagatgtgaagtaccacctgggcatgtatcaccgcaggatcaatcgtgtcaccgacaggaacattaccttgtccttggtggccaacccttcccaccttgaggccgctgaccccgtggtgatgggcaagaccaaagccgaacagttttactgtggcgacactgaagggaaaaaggtcatgtccatcctgttgcatggggatgctgcatttgctggccagggcattgtgtacgagaccttccacctcagcgacctgccatcctacacaactcatggcaccgtgcacgtggtcgtcaacaaccagatcggcttcaccaccgaccctcggatggcccgctcctccccctaccccactgacgtggcccgagtggtgaatgcccccattttccacgtgaactcagatgaccccgaggctgtcatgtacgtgtgcaaagtggcggccgagtggaggagcaccttccacaaggacgtggttgtcgatttggtgtgttaccggcgcaacggccacaacgagatggatgagcccatgttcacgcagccgctcatgtacaagcagatccgcaagcagaagcctgtgttacagaagtacgctgagctgctggtgtcgcagggtgtggtcaaccagcctgagtatgaggaggaaatttccaagtatgataagatctgtgaggaagcttttgccagatctaaagatgagaagatcttgcacattaagcactggctggactctccctggcctggcttcttcaccctggacgggcagcccaggagcatgtcctgcccctccacgggtctgacggaggatattctgacacacatcgggaatgtggctagttctgtgcctgtggaaaactttactattcatggagggctgagccggatcttgaagactcgtggggaaatggtgaagaaccggactgtggactgggctctagcggagtacatggcgtttggctcgctcctgaaggagggcatccacattcggctgagcggccaggacgtggagcggggcacattcagccaccgccaccatgtgctccatgaccagaatgtggacaagagaacctgcatccccatgaaccatctctggcccaatcaggccccctatactgtgtgcaacagctcactgtctgagtacggcgtgctgggctttgagctgggcttcgccatggccagtcctaatgccctggtcctctgggaagcccaatttggtgacttccacaacacggcccagtgtatcatcgaccagttcatctgcccgggacaagccaagtgggtgcggcagaatggcatcgtgttgctgctgccccatggcatggagggcatgggtccagaacattcctccgcccgcccagagcggttcttgcagatgtgcaacgatgacccagatgtcctgccagaccttaaagaagccaacttcgacatcaatcagctatatgactgcaattgggttgttgtcaactgctccactcctggcaacttcttccacgtgctacgacgccagatcctgctgccattccggaagccgttaattatcttcacccccaaatccctgttgcgccaccccgaggccagatccagctttgatgagatgcttccaggaacccacttccagcgggtgatcccagaagatggccctgcagctcagaacccagaaaatgtcaaaaggcttctcttctgcaccggcaaagtgtattatgacctcacccgggagcgcaaagcacgcgacatggtggggcaggtggccatcacaaggattgagcagctgtcgccattcccctttgacctcctgctgaaggaggtgcagaagtaccccaatgctgagctggcctggtgccaggaggagcacaagaaccaaggctactatgactacgtgaagccaagacttcggaccaccatcagccgcgccaagcccgtctggtatgccggccgggacccagcggctgctccagccaccggcaacaagaagacccacctgacggagctgcagcgcctcctggacacggccttcgacctggacgtcttcaagaacttctcgtagatgctgcctagggttgcttgggccactgccctctccacacccatgactgccccttgcttctcaactaaagaatagtgcctcagcgctgcccacaccaccgccctcctcgctgtgccaccacccctccctctgctctcataggagttaggctgtcgtccccctccagtgcttggctgccccacaggccacacgctgcccaggctctgctgacttctgagcagttttccaggaggccggggggagcaggaggaggaaaggtagcccccgagggatgtcctt

SEQ ID NO: 163094 - DNA, 3479 bp, Homo sapiens
  Payload ID: 12142
  Gene Symbol: OGDH
  Gene Name: oxoglutarate (alpha-ketoglutarate) dehydrogenase (lipoamide)
  Uniprot ID: Q02218
  ENST ID: ENST00000449767
  CDS Start-End: 91-3150
agagtttggagccccggagtggggtgtcggcgcctcattcgggtggagctgagccggagacaggcagttgtgaaaaacttcaggacaaaaatgtttcatttaaggacttgtgctgctaagttgaggccattgacggcttcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagtcatgggacattttttttcgcaacacgaatgccggagccccaccgggcactgcctaccagagtccccttcccctgagccgaggctccctggctgctgtggcccatgcacagtccctggtagaagcacagcccaacgtggacaagctcgtggaggaccacctggcagtgcagtcgctcatcagggcatatcaggtcaggggtcaccacattgcaaaacttgatcctctcggaattagttgtgtaaattttgatgatgctccagtaactgtttcttcaaacgtggggttctatggcctggatgagtctgacctcgacaaggtcttccacttgcccaccaccactttcatcgggggacaggaatcagcacttcctctgcgggagatcatccgtcggctggagatggcctactgccagcatattggggtggagttcatgttcatcaatgacctggagcagtgccagtggatccggcagaagtttgagacccctgggatcatgcagttcacaaatgaggagaaacggaccctgctggccaggcttgtgcggtccaccaggtttgaggagttcctacagcggaagtggtcctctgagaagcgctttggtctagaaggctgcgaggtactgatccctgccctcaagaccatcattgacaagtctagtgagaatggcgtggactacgtgatcatgggcatgccacacagagggcggctgaacgtgcttgcaaatgtcatcaggaaggagctggaacagatcttctgtcaattcgattcaaagctggaggcagctgatgagggctccggagatgtgaagtaccacctgggcatgtatcaccgcaggatcaatcgtgtcaccgacaggaacattaccttgtccttggtggccaacccttcccaccttgaggccgctgaccccgtggtgatgggcaagaccaaagccgaacagttttactgtggcgacactgaagggaaaaaggtcatgtccatcctgttgcatggggatgctgcatttgctggccagggcattgtgtacgagaccttccacctcagcgacctgccatcctacacaactcatggcaccgtgcacgtggtcgtcaacaaccagatcggcttcaccaccgaccctcggatggcccgctcctccccctaccccactgacgtggcccgagtggtgaatgcccccattttccacgtgaactcagatgaccccgaggctgtcatgtacgtgtgcaaagtggcggccgagtggaggagcaccttccacaaggacgtggttgtcgatttggtgtgttaccggcgcaacggccacaacgagatggatgagcccatgttcacgcagccgctcatgtacaagcagatccgcaagcagaagcctgtgttacagaagtacgctgagctgctggtgtcgcagggtgtggtcaaccagcctgagtatgaggaggaaatttccaagtatgataagatctgtgaggaagcttttgccagatctaaagatgagaagatcttgcacattaagcactggctggactctccctggcctggcttcttcaccctggacgggcagcccaggagcatgtcctgcccctccacgggtctgacggaggatattctgacacacatcgggaatgtggctagttctgtgcctgtggaaaactttactattcatggagggctgagccggatcttgaagactcgtggggaaatggtgaagaaccggactgtggactgggctctagcggagtacatggcgtttggctcgctcctgaaggagggcatccacattcggctgagcggccaggacgtggagcggggcacattcagccaccgccaccatgtgctccatgaccagaatgtggacaagagaacctgcatccccatgaaccatctctggcccaatcaggccccctatactgtgtgcaacagctcactgtctgagtacggcgtgctgggctttgagctgggcttcgccatggccagtcctaatgccctggtcctctgggaagcccaatttggtgacttccacaacacggcccagtgtatcatcgaccagttcatctgcccgggacaagccaagtgggtgcggcagaatggcatcgtgttgctgctgccccatggcatggagggcatgggtccagaacattcctccgcccgcccagagcggttcttgcagatgtgcaacgatgacccagatgtcctgccagaccttaaagaagccaacttcgacatcaatcagctatatgactgcaattgggttgttgtcaactgctccactcctggcaacttcttccacgtgctacgacgccagatcctgctgccattccggaagccgttaattatcttcacccccaaatccctgttgcgccaccccgaggccagatccagctttgatgagatgcttccaggaacccacttccagcgggtgatcccagaagatggccctgcagctcagaacccagaaaatgtcaaaaggcttctcttctgcaccggcaaagtgtattatgacctcacccgggagcgcaaagcacgcgacatggtggggcaggtggccatcacaaggattgagcagctgtcgccattcccctttgacctcctgctgaaggaggtgcagaagtaccccaatgctgagctggcctggtgccaggaggagcacaagaaccaaggctactatgactacgtgaagccaagacttcggaccaccatcagccgcgccaagcccgtctggtatgccggccgggacccagcggctgctccagccaccggcaacaagaagacccacctgacggagctgcagcgcctcctggacacggccttcgacctggacgtcttcaagaacttctcgtagatgctgcctagggttgcttgggccactgccctctccacacccatgactgccccttgcttctcaactaaagaatagtgcctcagcgctgcccacaccaccgccctcctcgctgtgccaccacccctccctctgctctcataggagttaggctgtcgtccccctccagtgcttggctgccccacaggccacacgctgcccaggctctgctgacttctgagcagttttccaggaggccggggggagcaggaggaggaaaggtagcccccgagggatgtccttggggaggggtcagctctggccacaatcctccccaccagtctcacccacta

SEQ ID NO: 163095 - DNA, 2962 bp, Homo sapiens
  Payload ID: 12142
  Gene Symbol: OGDH
  Gene Name: oxoglutarate (alpha-ketoglutarate) dehydrogenase (lipoamide)
  ENST ID: ENST00000439616
  CDS Start-End: 110-2731
atacgccggggcggggccgagagtttggagccccggagtggggtgtcggcgcctcattcgggtggagctgagccggagacaggcagttgtgaaaaacttcaggacaaaaatgtttcatttaaggacttgtgctgctaagttgaggccattgacggcttcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagggttctatggcctggatgagtctgacctcgacaaggtcttccacttgcccaccaccactttcatcgggggacaggaatcagcacttcctctgcgggagatcatccgtcggctggaggtttgaggagttcctacagcggaagtggtcctctgagaagcgctttggtctagaaggctgcgaggtactgatccctgccctcaagaccatcattgacaagtctagtgagaatggcgtggactacgtgatcatgggcatgccacacagagggcggctgaacgtgcttgcaaatgtcatcaggaaggagctggaacagatcttctgtcaattcgattcaaagctggaggcagctgatgagggctccggagatgtgaagtaccacctgggcatgtatcaccgcaggatcaatcgtgtcaccgacaggaacattaccttgtccttggtggccaacccttcccaccttgaggccgctgaccccgtggtgatgggcaagaccaaagccgaacagttttactgtggcgacactgaagggaaaaaggtcatgtccatcctgttgcatggggatgctgcatttgctggccagggcattgtgtacgagaccttccacctcagcgacctgccatcctacacaactcatggcaccgtgcacgtggtcgtcaacaaccagatcggcttcaccaccgaccctcggatggcccgctcctccccctaccccactgacgtggcccgagtggtgaatgcccccattttccacgtgaactcagatgaccccgaggctgtcatgtacgtgtgcaaagtggcggccgagtggaggagcaccttccacaaggacgtggttgtcgatttggtgtgttaccggcgcaacggccacaacgagatggatgagcccatgttcacgcagccgctcatgtacaagcagatccgcaagcagaagcctgtgttacagaagtacgctgagctgctggtgtcgcagggtgtggtcaaccagcctgagtatgaggaggaaatttccaagtatgataagatctgtgaggaagcttttgccagatctaaagatgagaagatcttgcacattaagcactggctggactctccctggcctggcttcttcaccctggacgggcagcccaggagcatgtcctgcccctccacgggtctgacggaggatattctgacacacatcgggaatgtggctagttctgtgcctgtggaaaactttactattcatggagggctgagccggatcttgaagactcgtggggaaatggtgaagaaccggactgtggactgggctctagcggagtacatggcgtttggctcgctcctgaaggagggcatccacattcggctgagcggccaggacgtggagcggggcacattcagccaccgccaccatgtgctccatgaccagaatgtggacaagagaacctgcatccccatgaaccatctctggcccaatcaggccccctatactgtgtgcaacagctcactgtctgagtacggcgtgctgggctttgagctgggcttcgccatggccagtcctaatgccctggtcctctgggaagcccaatttggtgacttccacaacacggcccagtgtatcatcgaccagttcatctgcccgggacaagccaagtgggtgcggcagaatggcatcgtgttgctgctgccccatggcatggagggcatgggtccagaacattcctccgcccgcccagagcggttcttgcagatgtgcaacgatgacccagatgtcctgccagaccttaaagaagccaacttcgacatcaatcagctatatgactgcaattgggttgttgtcaactgctccactcctggcaacttcttccacgtgctacgacgccagatcctgctgccattccggaagccgttaattatcttcacccccaaatccctgttgcgccaccccgaggccagatccagctttgatgagatgcttccaggaacccacttccagcgggtgatcccagaagatggccctgcagctcagaacccagaaaatgtcaaaaggcttctcttctgcaccggcaaagtgtattatgacctcacccgggagcgcaaagcacgcgacatggtggggcaggtggccatcacaaggattgagcagctgtcgccattcccctttgacctcctgctgaaggaggtgcagaagtaccccaatgctgagctggcctggtgccaggaggagcacaagaaccaaggctactatgactacgtgaagccaagacttcggaccaccatcagccgcgccaagcccgtctggtatgccggccgggacccagcggctgctccagccaccggcaacaagaagacccacctgacggagctgcagcgcctcctggacacggccttcgacctggacgtcttcaagaacttctcgtagatgctgcctagggttgcttgggccactgccctctccacacccatgactgccccttgcttctcaactaaagaatagtgcctcagcgctgcccacaccaccgccctcctcgctgtgccaccacccctccctctgctctcataggagttaggctgtcgtccccctccagtgcttggctgccccacaggccacacgctgcccaggctctgctgacttctgagcagttttccagga

SEQ ID NO: 163096 - DNA, 789 bp, Homo sapiens
  Payload ID: 12142
  Gene Symbol: OGDH
  Gene Name: oxoglutarate (alpha-ketoglutarate) dehydrogenase (lipoamide)
  ENST ID: ENST00000419661
  CDS Start-End: 157-789
tttggagccccggagtggggtgtcggcgcctcattcgggtggagctgagccggagacaggcagcgtccttgtgaactttccgcttggatcctgactctgctgttagtagcctatgaccttggatgaaatgcagttgtgaaaaacttcaggacaaaaatgtttcatttaaggacttgtgctgctaagttgaggccattgacggcttcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagtcatgggacattttttttcgcaacacgaatgccggagccccaccgggcactgcctaccagagtccccttcccctgagccgaggctccctggctgctgtggcccatgcacagtccctggtagaagcacagcccaacgtggacaagctcgtggaggaccacctggcagtgcagtcgctcatcagggcatatcagatacgagggcaccatgtagcacagctggaccccctggggattttggatgctgatctggactcctccgtgcccgctgacattatctcatccacagacaaacttgggttctatggcctggatgagtctgacctcgacaaggtcttccacttgcccaccaccactttcatcgggggacaggaatcagcacttcctctgcgggagatcatccgtcggctggag

SEQ ID NO: 163097 - DNA, 3309 bp, Homo sapiens
  Payload ID: 12142
  Gene Symbol: OGDH
  Gene Name: oxoglutarate (alpha-ketoglutarate) dehydrogenase (lipoamide)
  ENST ID: ENST00000444676
  CDS Start-End: 54-3170
ttcgggtggagctgagccggagacaggcagttgtgaaaaacttcaggacaaaaatgtttcatttaaggacttgtgctgctaagttgaggccattgacggcttcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagtcatgggacattttttttcgcaacacgaatgccggagccccaccgggcactgcctaccagagtccccttcccctgagccgaggctccctggctgctgtggcccatgcacagtccctggtagaagcacagcccaacgtggacaagctcgtggaggaccacctggcagtgcagtcgctcatcagggcatatcagatacgagggcaccatgtagcacagctggaccccctggggattttggatgctgatctggactcctccgtgcccgctgacattatctcatccacagacaaacttgatcttgcagttttcaaggaacgacttcgaatgctaacagtaggagggttctatggcctggatgagtctgacctcgacaaggtcttccacttgcccaccaccactttcatcgggggacaggaatcagcacttcctctgcgggagatcatccgtcggctggagatggcctactgccagcatattggggtggagttcatgttcatcaatgacctggagcagtgccagtggatccggcagaagtttgagacccctgggatcatgcagttcacaaatgaggagaaacggaccctgctggccaggcttgtgcggtccaccaggtttgaggagttcctacagcggaagtggtcctctgagaagcgctttggtctagaaggctgcgaggtactgatccctgccctcaagaccatcattgacaagtctagtgagaatggcgtggactacgtgatcatgggcatgccacacagagggcggctgaacgtgcttgcaaatgtcatcaggaaggagctggaacagatcttctgtcaattcgattcaaagctggaggcagctgatgagggctccggagatgtgaagtaccacctgggcatgtatcaccgcaggatcaatcgtgtcaccgacaggaacattaccttgtccttggtggccaacccttcccaccttgaggccgctgaccccgtggtgatgggcaagaccaaagccgaacagttttactgtggcgacactgaagggaaaaaggtcatgtccatcctgttgcatggggatgctgcatttgctggccagggcattgtgtacgagaccttccacctcagcgacctgccatcctacacaactcatggcaccgtgcacgtggtcgtcaacaaccagatcggcttcaccaccgaccctcggatggcccgctcctccccctaccccactgacgtggcccgagtggtgaatgcccccattttccacgtgaactcagatgaccccgaggctgtcatgtacgtgtgcaaagtggcggccgagtggaggagcaccttccacaaggacgtggttgtcgatttggtgtgttaccggcgcaacggccacaacgagatggatgagcccatgttcacgcagccgctcatgtacaagcagatccgcaagcagaagcctgtgttacagaagtacgctgagctgctggtgtcgcagggtgtggtcaaccagcctgagtatgaggaggaaatttccaagtatgataagatctgtgaggaagcttttgccagatctaaagatgagaagatcttgcacattaagcactggctggactctccctggcctggcttcttcaccctggacgggcagcccaggagcatgtcctgcccctccacgggtctgacggaggatattctgacacacatcgggaatgtggctagttctgtgcctgtggaaaactttactattcatggagggctgagccggatcttgaagactcgtggggaaatggtgaagaaccggactgtggactgggctctagcggagtacatggcgtttggctcgctcctgaaggagggcatccacattcggctgagcggccaggacgtggagcggggcacattcagccaccgccaccatgtgctccatgaccagaatgtggacaagagaacctgcatccccatgaaccatctctggcccaatcaggccccctatactgtgtgcaacagctcactgtctgagtacggcgtgctgggctttgagctgggcttcgccatggccagtcctaatgccctggtcctctgggaagcccaatttggtgacttccacaacacggcccagtgtatcatcgaccagttcatctgcccgggacaagccaagtgggtgcggcagaatggcatcgtgttgctgctgccccatggcatggagggcatgggtccagaacattcctccgcccgcccagagcggttcttgcagatgtgcaacgatgacccagatgtcctgccagaccttaaagaagccaacttcgacatcaatcagctatatgactgcaattgggttgttgtcaactgctccactcctggcaacttcttccacgtgctacgacgccagatcctgctgccattccggaagccgttaattatcttcacccccaaatccctgttgcgccaccccgaggccagatccagctttgatgagatgcttccaggaacccacttccagcgggtgatcccagaagatggccctgcagctcagaacccagaaaatgtcaaaaggcttctcttctgcaccggcaaagtgtattatgacctcacccgggagcgcaaagcacgcgacatggtggggcaggtggccatcacaaggattgagcagctgtcgccattcccctttgacctcctgctgaaggaggtgcagaagtaccccaatgctgagctggcctggtgccaggaggagcacaagaaccaaggctactatgactacgtgaagccaagacttcggaccaccatcagccgcgccaagcccgtctggtatgccggccgggacccagcggctgctccagccaccggcaacaagaagacccacctgacggagctgcagcgcctcctggacacggccttcgacctggacgtcttcaagaacttctcgtagatgctgcctagggttgcttgggccactgccctctccacacccatgactgccccttgcttctcaactaaagaatagtgcctcagcgctgcccacaccaccgccctcctcgctgtgccaccacccctccctctgctctcat

SEQ ID NO: 163098 - DNA, 4116 bp, Homo sapiens
  Payload ID: 12142
  Gene Symbol: OGDH
  Gene Name: oxoglutarate (alpha-ketoglutarate) dehydrogenase (lipoamide)
  ENST ID: ENST00000631326
  CDS Start-End: 54-3059
ttcgggtggagctgagccggagacaggcagttgtgaaaaacttcaggacaaaaatgtttcatttaaggacttgtgctgctaagttgaggccattgacggcttcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagtcatgggacattttttttcgcaacacgaatgccggagccccaccgggcactgcctaccagagtccccttcccctgagccgaggctccctggctgctgtggcccatgcacagtccctggtagaagcacagcccaacgtggacaagctcgtggaggaccacctggcagtgcagtcgctcatcagggcatatcagatacgagggcaccatgtagcacagctggaccccctggggattttggatgctgatctggactcctccgtgcccgctgacattatctcatccacagacaaacttgggttctatggcctggatgagtctgacctcgacaaggtcttccacttgcccaccaccactttcatcgggggacaggaatcagcacttcctctgcgggagatcatccgtcggctggagatggcctactgccagcatattggggtggagttcatgttcatcaatgacctggagcagtgccagtggatccggcagaagtttgagacccctgggatcatgcagttcacaaatgaggagaaacggaccctgctggccaggcttgtgcggtccaccaggtttgaggagttcctacagcggaagtggtcctctgagaagcgctttggtctagaaggctgcgaggtactgatccctgccctcaagaccatcattgacaagtctagtgagaatggcgtggactacgtgatcatgggcatgccacacagagggcggctgaacgtgcttgcaaatgtcatcaggaaggagctggaacagatcttctgtcaattcgattcaaagctggaggcagctgatgagggctccggagatgtgaagtaccacctgggcatgtatcaccgcaggatcaatcgtgtcaccgacaggaacattaccttgtccttggtggccaacccttcccaccttgaggccgctgaccccgtggtgatgggcaagaccaaagccgaacagttttactgtggcgacactgaagggaaaaaggtcatgtccatcctgttgcatggggatgctgcatttgctggccagggcattgtgtacgagaccttccacctcagcgacctgccatcctacacaactcatggcaccgtgcacgtggtcgtcaacaaccagatcggcttcaccaccgaccctcggatggcccgctcctccccctaccccactgacgtggcccgagtggtgaatgcccccattttccacgtgaactcagatgaccccgaggctgtcatgtacgtgtgcaaagtggcggccgagtggaggagcaccttccacaaggacgtggttgtcgatttggtgtgttaccggcgcaacggccacaacgagatggatgagcccatgttcacgcagccgctcatgtacaagcagatccgcaagcagaagcctgtgttacagaagtacgctgagctgctggtgtcgcagggtgtggtcaaccagcctgagtatgaggaggaaatttccaagtatgataagatctgtgaggaagcttttgccagatctaaagatgagaagatcttgcacattaagcactggctggactctccctggcctggcttcttcaccctggacgggcagcccaggagcatgtcctgcccctccacgggtctgacggaggatattctgacacacatcgggaatgtggctagttctgtgcctgtggaaaactttactattcatggagggctgagccggatcttgaagactcgtggggaaatggtgaagaaccggactgtggactgggctctagcggagtacatggcgtttggctcgctcctgaaggagggcatccacattcggctgagcggccaggacgtggagcggggcacattcagccaccgccaccatgtgctccatgaccagaatgtggacaagagaacctgcatccccatgaaccatctctggcccaatcaggccccctatactgtgtgcaacagctcactgtctgagtacggcgtgctggggcttgctgggcttcgcatggccagtcctaatgccctggtcctctgggaagcccaatttggtgacttccacaacacggcccagtgtatcatcgaccagttcatctgcccgggacaagccaagtgggtgcggcagaatggcatcgtgttgctgctgccccatggcatggagggcatgggtccagaacattcctccgcccgcccagagcggttcttgcagatgtgcaacgatgacccagatgtcctgccagaccttaaagaagccaacttcgacatcaatcagctatatgactgcaattgggttgttgtcaactgctccactcctggcaacttcttccacgtgctacgacgccagatcctgctgccattccggaagccgttaattatcttcacccccaaatccctgttgcgccaccccgaggccagatccagctttgatgagatgcttccaggaacccacttccagcgggtgatcccagaagatggccctgcagctcagaacccagaaaatgtcaaaaggcttctcttctgcaccggcaaagtgtattatgacctcacccgggagcgcaaagcacgcgacatggtggggcaggtggccatcacaaggattgagcagctgtcgccattcccctttgacctcctgctgaaggaggtgcagaagtaccccaatgctgagctggcctggtgccaggaggagcacaagaaccaaggctactatgactacgtgaagccaagacttcggaccaccatcagccgcgccaagcccgtctggtatgccggccgggacccagcggctgctccagccaccggcaacaagaagacccactgacggagctgcagcgcctcctggacacggccttcgacctggacgtcttcaagaacttctcgtagatgctgcctagggttgcttgggccactgccctctccacacccatgactgccccttgcttctcaactaaagaatagtgcctcagcgctgcccacaccaccgccctcctcgctgtgccaccacccctccctctgctctcataggagttaggctgtcgtccccctccagtgcttggctgccccacaggccacacgctgcccaggctctgctgacttctgagcagttttccaggaggccggggggagcaggaggaggaaaggtagcccccgagggatgtccttggggaggggtcagctctggccacaatcctccccaccagtctcacccactaggataggaactgggccttgtgtgctggcttccgctgtcacccagcaaggcacaggctcctgtatttgagactaggatagcttcatcttgagcctgagccttagaatctgtagaggagcctggagtcggatctagccatggctggcagaggtttctagggtgggccccagccgtggcgtgaactgaggatgacccggggcagctggcaggagagagccttggcctgacctggcacagaaagggcagcttcagtctctgcagtgtccattatctgctgttccttcgagggttccaggctgtgtgtggggcccaagcatgccccacccacccctcctgggcccaggcagcacctggagcccacagagtctgtgtgtagccaggaagccccgctcaggtagccaccaccggggcactggctgctctgtcttggtcctgttaaccctccacctcctctcttggactccctccccaccccaaccactctttctttctcctttaacccaatggagactttctgatgcatcgttttctttgctgtgccaaagcaggtcagaagagggagaggaggggctgggggtgaggggccaggccatggccaaggggccagctgcccctcatttatcactctgaccttcacagggacagatctgatttatttattttggtt

SEQ ID NO: 163099 - DNA, 2285 bp, Homo sapiens
  Payload ID: 12143
  Gene Symbol: OXGR1
  Gene Name: oxoglutarate (alpha-ketoglutarate) receptor 1
  Uniprot ID: Q96P68
  ENST ID: ENST00000298440
  CDS Start-End: 245-1258
aactaggctgcacaggcacgctgggcgcatgtccgcctcgccggggctgccagaatcttggaatcccaatccgtgaggttcctgggtgtgctggcatcaggacagcggtccacgaacgggtaatcctgatgaaaatcaacaaaatacacatgaagagacagcactgagagcgagttactgctcatttgattcatattgccaaactgaactctcttgttttcttgcaagatgaaaggagacaaccatgaatgagccactagactatttagcaaatgcttctgatttccccgattatgcagctgcttttggaaattgcactgatgaaaacatcccactcaagatgcactacctccctgttatttatggcattatcttcctcgtgggatttccaggcaatgcagtagtgatatccacttacattttcaaaatgagaccttggaagagcagcaccatcattatgctgaacctggcctgcacagatctgctgtatctgaccagcctccccttcctgattcactactatgccagtggcgaaaactggatctttggagatttcatgtgtaagtttatccgcttcagcttccatttcaacctgtatagcagcatcctcttcctcacctgtttcagcatcttccgctactgtgtgatcattcacccaatgagctgcttttccattcacaaaactcgatgtgcagttgtagcctgtgctgtggtgtggatcatttcactggtagctgtcattccgatgaccttcttgatcacatcaaccaacaggaccaacagatcagcctgtctcgacctcaccagttcggatgaactcaatactattaagtggtacaacctgattttgactgcaactactttctgcctccccttggtgatagtgacactttgctataccacgattatccacactctgacccatggactgcaaactgacagctgccttaagcagaaagcacgaaggctaaccattctgctactccttgcattttacgtatgttttttacccttccatatcttgagggtcattcggatcgaatctcgcctgctttcaatcagttgttccattgagaatcagatccatgaagcttacatcgtttctagaccattagctgctctgaacacctttggtaacctgttactatatgtggtggtcagcgacaactttcagcaggctgtctgctcaacagtgagatgcaaagtaagcgggaaccttgagcaagcaaagaaaattagttactcaaacaacccttgaaatatttcatttacttaaccaaaaacaaatacttgctgatactttacctagcatcctaagatgttcaggatgtctccctcaatggaactcctggtaaatactgtgtattcaagtaatcatgtgccaaagccagggcagagcttctagttctttgcaatccctttattgagctcctccactggggagatataagaatgggatgcatgtatatcagcaaagtattcagacatagtattacaagctattggaactcagaggcatcttagagaacatctgttcccaccaacttactatatatacacggaaaccaatttcttacccttgccctagattgctcagtaaatttgtgccaagataggagaaaaccaatcttttcactcatcatttcatgcttctctgcactctgggcctatttgtattgaaccattagacaattcaaaccactacttgtatctttcttaatatttattttttacatctcagagctctacaatttgtttccttcaagcttaactttgagattataaaactgggtttagccagttctgtatattacttcaagccagtaagatacccttgaaataatccaaggacgtccatgcaaatagttgaaattagtacctgcaatatatttggagtattatgtctttattgttgttaaaaagtttttattgaatgtatgaaaattatcaaattgtattcatcattattaacatgtcctggggaaggaagggaaactttctaggacagaagtcactttcagatgtcatgtatgtattgggtgttcaatcatatctaacactgttttgatttttgtgggaaaatattccaggaaacgctaattctctttagactccttgttcttttatgactacaatgaacatatgtctatgtgatagctaaagatatttttgaattgtatgtgtgcttaattatcggtaagtataaatatttgagaaaacacatggtctggatatttaaaaccctcataaacatgttggtacagttaataaacttatttataatt

SEQ ID NO: 163100 - DNA, 643 bp, Homo sapiens
  Payload ID: 12143
  Gene Symbol: OXGR1
  Gene Name: oxoglutarate (alpha-ketoglutarate) receptor 1
  ENST ID: ENST00000541038
  CDS Start-End: 457-643
ggatgctgctggccaggctgctcggggcgaggacccgagaacacgcacttgctcgctgggcctcggaggggtgggaggggcggggcggtgcgcagcctccccgggacaggtctgcggtccgggaccaactaggctgcacaggcacgctgggcgcatgtccgcctcgccggggctgccagaatcttggaatcccaatccgtgaggttcctgggtgtgctggcatcaggacagcggtccacgaacggtgtgttacccaaatattgacatcctgcagctagcctcaaacaatcacagctactttccaatttcagagaaaaaaaggctaaaattggtaatcctgatgaaaatcaacaaaatacacatgaagagacagcactgagagcgagttactgctcatttgattcatattgccaaactgaactctcttgttttcttgcaagatgaaaggagacaaccatgaatgagccactagactatttagcaaatgcttctgatttccccgattatgcagctgcttttggaaattgcactgatgaaaacatcccactcaagatgcactacctccctgttatttatggcattatcttcctcgtgggatttccaggcaatgcagtagtgatatccacttacattttcaaaatga

SEQ ID NO: 163101 - DNA, 1305 bp, Homo sapiens
  Payload ID: 12143
  Gene Symbol: OXGR1
  Gene Name: oxoglutarate (alpha-ketoglutarate) receptor 1
  Uniprot ID: Q96P68
  ENST ID: ENST00000543457
  CDS Start-End: 292-1305
aggtctgcggtccgggaccaactaggctgcacaggcacgctgggcgcatgtccgcctcgccggggctgccagaatcttggaatcccaatccgtgaggttcctgggtgtgctggcatcaggacagcggtccacgaacggtgtgttacccaaatattgacatcctgcagctagcctcaaacaatcacagctactttccaatttcagagaaaaaaaggctaaaattggtaatcctgatgaaaatcaacaaaatacacatgaagagacagcactgagagatgaaaggagacaaccatgaatgagccactagactatttagcaaatgcttctgatttccccgattatgcagctgcttttggaaattgcactgatgaaaacatcccactcaagatgcactacctccctgttatttatggcattatcttcctcgtgggatttccaggcaatgcagtagtgatatccacttacattttcaaaatgagaccttggaagagcagcaccatcattatgctgaacctggcctgcacagatctgctgtatctgaccagcctccccttcctgattcactactatgccagtggcgaaaactggatctttggagatttcatgtgtaagtttatccgcttcagcttccatttcaacctgtatagcagcatcctcttcctcacctgtttcagcatcttccgctactgtgtgatcattcacccaatgagctgcttttccattcacaaaactcgatgtgcagttgtagcctgtgctgtggtgtggatcatttcactggtagctgtcattccgatgaccttcttgatcacatcaaccaacaggaccaacagatcagcctgtctcgacctcaccagttcggatgaactcaatactattaagtggtacaacctgattttgactgcaactactttctgcctccccttggtgatagtgacactttgctataccacgattatccacactctgacccatggactgcaaactgacagctgccttaagcagaaagcacgaaggctaaccattctgctactccttgcattttacgtatgttttttacccttccatatcttgagggtcattcggatcgaatctcgcctgctttcaatcagttgttccattgagaatcagatccatgaagcttacatcgtttctagaccattagctgctctgaacacctttggtaacctgttactatatgtggtggtcagcgacaactttcagcaggctgtctgctcaacagtgagatgcaaagtaagcgggaaccttgagcaagcaaagaaaattagttactcaaacaacccttga

SEQ ID NO: 163102 - DNA, 588 bp, Homo sapiens
  Payload ID: 12143
  Gene Symbol: OXGR1
  Gene Name: oxoglutarate (alpha-ketoglutarate) receptor 1
  ENST ID: ENST00000541518
  CDS Start-End: 382-588
agagcgagactccttctcaaaagaaaaaaaaaaaaaagaggcactgggctgtaggagagtggtgaaatttctggaccaagacaaggcggccacaaccctcctggggcaacaaccctcccgccgggctggttttttggaacctctgcaaacactttctcctggaatcttggaatcccaatccgtgaggttcctgggtgtgctggcatcaggacagcggtccacgaacggtgtgttacccaaatattgacatcctgcagctagcctcaaacaatcacagctactttccaatttcagagaaaaaaaggctaaaattggtaatcctgatgaaaatcaacaaaatacacatgaagagacagcactgagagatgaaaggagacaaccatgaatgagccactagactatttagcaaatgcttctgatttccccgattatgcagctgcttttggaaattgcactgatgaaaacatcccactcaagatgcactacctccctgttatttatggcattatcttcctcgtgggatttccaggcaatgcagtagtgatatccacttacattttcaaaatgagaccttggaagagcagcacc

SEQ ID NO: 163103 - DNA, 3704 bp, Homo sapiens
  Payload ID: 12144
  Gene Symbol: OGDHL
  Gene Name: oxoglutarate dehydrogenase-like
  Uniprot ID: Q9ULD0
  ENST ID: ENST00000374103
  CDS Start-End: 87-3119
acggcgcgcgcgcaccccttccgcgcagccccctgacctgcagcctccggacctcgctgcagcgcggacccggcccgcccgcccgaatgagtcagctgaggctgctgccgtcccgtcttggggtacaggctgcgaggctcctggctgcacatgacgtcccggtgtttggctggcgcagcaggtcctccgggccaccggccaccttcccaagcagcaaaggtggaggcggctccagttacatggaggagatgtacttcgcctggttggaaaacccccagagtgtccacaagtcctgggacagcttcttcagggaagccagcgaggaagccttttctggctctgctcagccacggcccccttctgttgtccatgagagcaggtctgcagtctcaagtcggaccaagaccagcaaattggtggaggaccacctggctgtgcagtccctgatccgggcctaccagatccggggtcaccatgtggcccagctggaccccctgggcattctggatgcagacctggactcctttgtgccctcagacttgatcacaaccattgataaactggccttctatgaccttcaggaggctgaccttgataaggagttccagctgccgacaaccaccttcattgggggctctgaaaacaccctctctctgcgggagatcattcggcgcctggagaacacctactgccagcacattggcctggagttcatgttcatcaacgatgtggagcagtgccagtggatccggcagaagtttgagacccctggtgtgatgcagttctccagcgaggagaagcggaccctgctggcccggctagtgcgctccatgaggtttgaagacttcctggcccggaaatggtcctcagagaagcggtttggcctggagggctgtgaagtgatgattcctgccctcaagaccatcatcgacaaatccagcgagatggggattgagaatgtcatcttggggatgccacacaggggaaggctgaacgtgctggccaacgtgatccgcaaggacctggagcagatcttctgccagtttgaccccaagctggaggcggcggacgagggctccggggatgtcaagtaccacctgggcatgtaccatgagaggatcaaccgcgtcaccaaccggaacatcactctgtcgctggttgccaacccctcccacctggaggcagtggaccctgtggtgcaggggaagacaaaggcagagcagttctaccgtggagatgcccagggcaagaaggtcatgtccatcctggttcatggggacgccgcctttgctggccagggcgtggtatatgagaccttccacctgagcgacctgccctcctacacgaccaatggtaccgtgcacgtcgtcgtcaacaaccagattggattcaccacagacccccgaatggcccgctcctcaccatacccgaccgacgtggcccgggtggtcaatgcgcctatcttccatgtgaatgccgatgacccagaggctgtgatatatgtgtgcagtgtggcagccgaatggagaaacactttcaacaaagatgttgtcgtggacctggtctgttaccgccggcgtggccacaatgagatggacgagcccatgttcacccagccgctcatgtacaagcagatccacagacaggtgcctgtgctgaagaagtacgcagacaagctgattgccgagggcacagtcaccctgcaggagtttgaggaagaaattgccaaatacgaccggatctgtgaggaggcttatggcaggtccaaggataaaaagattctgcatataaagcactggttggactccccctggcctggcttcttcaacgtagatggggagcccaagagcatgacatgcccagccacggggatccctgaggacatgctcacccacatcggcagtgtggccagctctgtgcccctggaggactttaagatccacactggcctctctcgcattctgcggggccgtgcggacatgaccaagaaccggacggtggactgggcgttggcagagtacatggcctttggctccctgctgaaggaaggcatccacgtgcggctcagcgggcaggatgtggagaggggcacattcagtcaccggcaccatgttctccatgaccaggaggttgaccgcaggacgtgtgtgcctatgaatcatctctggcctgaccaggccccgtacaccgtgtgcaacagctccctctcggagtacggagtcctgggctttgagctgggctatgccatggccagccccaatgccctggtcctctgggaggcccagtttggggacttccacaacacggcccagtgcatcatcgaccagttcatcagcaccggccaggccaagtgggtgcggcataatggcattgtgctgctgctgccccatggcatggaaggcatgggcccagagcactcgtcagcgaggcccgaaaggttcctgcagatgagcaatgatgactcggatgcctaccctgcattcaccaaggacttcgaggtgagccagctctatgactgcaactggatcgtggtcaactgctccacaccggccaactacttccacgtgctgcgccggcagatcctgctgcccttccgcaagccgctgattatcttcacacctaaatctctgctgaggcacccagaggccaagtccagctttgaccaaatggtatccgggaccagcttccagcgggtgattcctgaagatggggccgcagcacgggcccctgagcaggtgcagcggctcatcttctgcacgggaaaggtgtactatgacctggtgaaggagcggagcagccaggacctggaggagaaagtggccatcacgcgcctggagcagatctctccattccccttcgacctgatcaagcaggaggcagagaagtacccaggtgcggagctggcctggtgtcaggaggagcacaagaacatgggctactatgactacatcagcccacgcttcatgaccatcctgaggcgcgcacggcccatatggtatgttggccgggacccagcggctgcaccagccacaggaaacaggaacactcacctggtgtcactgaagaagtttctggatactgccttcaatctccaggcctttgagggcaagacattttagagctgggcaaaacctgtgtaggtctcgctgtgggtttgctggggaccaagggggtgatgaaaaggggaggggcggagctcctgcccaggagaggggctgtggggccccaggataaaacagacacagtgacagggccaagagccagcactgctggccttggtgtcatgccagaatctaccaggactgagggagccagaggagtcctataggcaggctactgtgctggagcatcccccagctgctcccatcttgctggaatttcttgggcggcttctccacctgtatctcaagacagacacccgggggcctgtgtctgtggccgctcccatcccggcagccctggctgctgctcgccccaccctcgcttatctgtagattcaaagcgatgttctcttctgtgctcttagaagtagggagttcagcagtaacagccaggtgaagcgaacctgctgggtgatttgtttgcgctctgttttatggggcattcctgcgagatgtgtcagcttctgtgtgaaatgcagccacagctcatgtgtaccaaagtagaaaaccaaatcacagagaaataaaaacatgcttcagaga

SEQ ID NO: 163104 - DNA, 3383 bp, Homo sapiens
  Payload ID: 12144
  Gene Symbol: OGDHL
  Gene Name: oxoglutarate dehydrogenase-like
  Uniprot ID: Q9ULD0
  ENST ID: ENST00000432695
  CDS Start-End: 394-2799
gagtctcaggggcgcgcgcccgtgggcggctgcgtcacgtgacccaggtaattggcacggcgcgcgcgcaccccttccgcgcagccccctgacctgcagcctccggacctcgctgcagcgcggacccggcccgcccgcccgatccggggtcaccatgtggcccagctggaccccctgggcattctggatgcagacctggactcctttgtgccctcagacttgatcacaaccattgataaactggccttctatgaccttcaggaggctgaccttgataaggagttccagctgccgacaaccaccttcattgggggctctgaaaacaccctctctctgcgggagatcattcggcgcctggagaacacctactgccagcacattggcctggagttcatgttcatcaacgatgtggagcagtgccagtggatccggcagaagtttgagacccctggtgtgatgcagttctccagcgaggagaagcggaccctgctggcccggctagtgcgctccatgaggtttgaagacttcctggcccggaaatggtcctcagagaagcggtttggcctggagggctgtgaagtgatgattcctgccctcaagaccatcatcgacaaatccagcgagatggggattgagaatgtcatcttggggatgccacacaggggaaggctgaacgtgctggccaacgtgatccgcaaggacctggagcagatcttctgccagtttgaccccaagctggaggcggcggacgagggctccggggatgtcaagtaccacctgggcatgtaccatgagaggatcaaccgcgtcaccaaccggaacatcactctgtcgctggttgccaacccctcccacctggaggcagtggaccctgtggtgcaggggaagacaaaggcagagcagttctaccgtggagatgcccagggcaagaaggtcatgtccatcctggttcatggggacgccgcctttgctggccagggcgtggtatatgagaccttccacctgagcgacctgccctcctacacgaccaatggtaccgtgcacgtcgtcgtcaacaaccagattggattcaccacagacccccgaatggcccgctcctcaccatacccgaccgacgtggcccgggtggtcaatgcgcctatcttccatgtgaatgccgatgacccagaggctgtgatatatgtgtgcagtgtggcagccgaatggagaaacactttcaacaaagatgttgtcgtggacctggtctgttaccgccggcgtggccacaatgagatggacgagcccatgttcacccagccgctcatgtacaagcagatccacagacaggtgcctgtgctgaagaagtacgcagacaagctgattgccgagggcacagtcaccctgcaggagtttgaggaagaaattgccaaatacgaccggatctgtgaggaggcttatggcaggtccaaggataaaaagattctgcatataaagcactggttggactccccctggcctggcttcttcaacgtagatggggagcccaagagcatgacatgcccagccacggggatccctgaggacatgctcacccacatcggcagtgtggccagctctgtgcccctggaggactttaagatccacactggcctctctcgcattctgcggggccgtgcggacatgaccaagaaccggacggtggactgggcgttggcagagtacatggcctttggctccctgctgaaggaaggcatccacgtgcggctcagcgggcaggatgtggagaggggcacattcagtcaccggcaccatgttctccatgaccaggaggttgaccgcaggacgtgtgtgcctatgaatcatctctggcctgaccaggccccgtacaccgtgtgcaacagctccctctcggagtacggagtcctgggctttgagctgggctatgccatggccagccccaatgccctggtcctctgggaggcccagtttggggacttccacaacacggcccagtgcatcatcgaccagttcatcagcaccggccaggccaagtgggtgcggcataatggcattgtgctgctgctgccccatggcatggaaggcatgggcccagagcactcgtcagcgaggcccgaaaggttcctgcagatgagcaatgatgactcggatgcctaccctgcattcaccaaggacttcgaggtgagccagctctatgactgcaactggatcgtggtcaactgctccacaccggccaactacttccacgtgctgcgccggcagatcctgctgcccttccgcaagccgctgattatcttcacacctaaatctctgctgaggcacccagaggccaagtccagctttgaccaaatggtatccgggaccagcttccagcgggtgattcctgaagatggggccgcagcacgggcccctgagcaggtgcagcggctcatcttctgcacgggaaaggtgtactatgacctggtgaaggagcggagcagccaggacctggaggagaaagtggccatcacgcgcctggagcagatctctccattccccttcgacctgatcaagcaggaggcagagaagtacccaggtgcggagctggcctggtgtcaggaggagcacaagaacatgggctactatgactacatcagcccacgcttcatgaccatcctgaggcgcgcacggcccatatggtatgttggccgggacccagcggctgcaccagccacaggaaacaggaacactcacctggtgtcactgaagaagtttctggatactgccttcaatctccaggcctttgagggcaagacattttagagctgggcaaaacctgtgtaggtctcgctgtgggtttgctggggaccaagggggtgatgaaaaggggaggggcggagctcctgcccaggagaggggctgtggggccccaggataaaacagacacagtgacagggccaagagccagcactgctggccttggtgtcatgccagaatctaccaggactgagggagccagaggagtcctataggcaggctactgtgctggagcatcccccagctgctcccatcttgctggaatttcttgggcggcttctccacctgtatctcaagacagacacccgggggcctgtgtctgtggccgctcccatcccggcagccctggctgctgctcgccccaccctcgcttatctgtagattcaaagcgatgttctcttctgtgctcttagaagtagggagttcagcagtaacagccaggtgaagcgaacctgctgggtgatttgtttgcgctctgttttatggggcattcctgcgagatgtgtcagcttctgtgtgaaatgcagccacagctcatgtgtaccaaagtagaaaaccaaatcacagagaaataaaaacatgcttcagag

SEQ ID NO: 163105 - DNA, 3588 bp, Homo sapiens
  Payload ID: 12144
  Gene Symbol: OGDHL
  Gene Name: oxoglutarate dehydrogenase-like
  Uniprot ID: Q9ULD0
  ENST ID: ENST00000419399
  CDS Start-End: 143-3004
gagtctcaggggcgcgcgcccgtgggcggctgcgtcacgtgacccaggtaattggcacggcgcgcgcgcaccccttccgcgcagccccctgacctgcagcctccggacctcgctgcagcgcggacccggcccgcccgcccgaatgagtcagctgaggctgctgccgtcccgtcttggggtacaggctgcgaggctcctggctgcacatgacgtcccggtgtttggctggcgcagcaggtcctccgggccaccggccaccttcccaagcagcaaaggtggaggcggctccagttacatggaggagatgtacttcgcctggttggaaaacccccagagtgtccacaagatccggggtcaccatgtggcccagctggaccccctgggcattctggatgcagacctggactcctttgtgccctcagacttgatcacaaccattgataaactggccttctatgaccttcaggaggctgaccttgataaggagttccagctgccgacaaccaccttcattgggggctctgaaaacaccctctctctgcgggagatcattcggcgcctggagaacacctactgccagcacattggcctggagttcatgttcatcaacgatgtggagcagtgccagtggatccggcagaagtttgagacccctggtgtgatgcagttctccagcgaggagaagcggaccctgctggcccggctagtgcgctccatgaggtttgaagacttcctggcccggaaatggtcctcagagaagcggtttggcctggagggctgtgaagtgatgattcctgccctcaagaccatcatcgacaaatccagcgagatggggattgagaatgtcatcttggggatgccacacaggggaaggctgaacgtgctggccaacgtgatccgcaaggacctggagcagatcttctgccagtttgaccccaagctggaggcggcggacgagggctccggggatgtcaagtaccacctgggcatgtaccatgagaggatcaaccgcgtcaccaaccggaacatcactctgtcgctggttgccaacccctcccacctggaggcagtggaccctgtggtgcaggggaagacaaaggcagagcagttctaccgtggagatgcccagggcaagaaggtcatgtccatcctggttcatggggacgccgcctttgctggccagggcgtggtatatgagaccttccacctgagcgacctgccctcctacacgaccaatggtaccgtgcacgtcgtcgtcaacaaccagattggattcaccacagacccccgaatggcccgctcctcaccatacccgaccgacgtggcccgggtggtcaatgcgcctatcttccatgtgaatgccgatgacccagaggctgtgatatatgtgtgcagtgtggcagccgaatggagaaacactttcaacaaagatgttgtcgtggacctggtctgttaccgccggcgtggccacaatgagatggacgagcccatgttcacccagccgctcatgtacaagcagatccacagacaggtgcctgtgctgaagaagtacgcagacaagctgattgccgagggcacagtcaccctgcaggagtttgaggaagaaattgccaaatacgaccggatctgtgaggaggcttatggcaggtccaaggataaaaagattctgcatataaagcactggttggactccccctggcctggcttcttcaacgtagatggggagcccaagagcatgacatgcccagccacggggatccctgaggacatgctcacccacatcggcagtgtggccagctctgtgcccctggaggactttaagatccacactggcctctctcgcattctgcggggccgtgcggacatgaccaagaaccggacggtggactgggcgttggcagagtacatggcctttggctccctgctgaaggaaggcatccacgtgcggctcagcgggcaggatgtggagaggggcacattcagtcaccggcaccatgttctccatgaccaggaggttgaccgcaggacgtgtgtgcctatgaatcatctctggcctgaccaggccccgtacaccgtgtgcaacagctccctctcggagtacggagtcctgggctttgagctgggctatgccatggccagccccaatgccctggtcctctgggaggcccagtttggggacttccacaacacggcccagtgcatcatcgaccagttcatcagcaccggccaggccaagtgggtgcggcataatggcattgtgctgctgctgccccatggcatggaaggcatgggcccagagcactcgtcagcgaggcccgaaaggttcctgcagatgagcaatgatgactcggatgcctaccctgcattcaccaaggacttcgaggtgagccagctctatgactgcaactggatcgtggtcaactgctccacaccggccaactacttccacgtgctgcgccggcagatcctgctgcccttccgcaagccgctgattatcttcacacctaaatctctgctgaggcacccagaggccaagtccagctttgaccaaatggtatccgggaccagcttccagcgggtgattcctgaagatggggccgcagcacgggcccctgagcaggtgcagcggctcatcttctgcacgggaaaggtgtactatgacctggtgaaggagcggagcagccaggacctggaggagaaagtggccatcacgcgcctggagcagatctctccattccccttcgacctgatcaagcaggaggcagagaagtacccaggtgcggagctggcctggtgtcaggaggagcacaagaacatgggctactatgactacatcagcccacgcttcatgaccatcctgaggcgcgcacggcccatatggtatgttggccgggacccagcggctgcaccagccacaggaaacaggaacactcacctggtgtcactgaagaagtttctggatactgccttcaatctccaggcctttgagggcaagacattttagagctgggcaaaacctgtgtaggtctcgctgtgggtttgctggggaccaagggggtgatgaaaaggggaggggcggagctcctgcccaggagaggggctgtggggccccaggataaaacagacacagtgacagggccaagagccagcactgctggccttggtgtcatgccagaatctaccaggactgagggagccagaggagtcctataggcaggctactgtgctggagcatcccccagctgctcccatcttgctggaatttcttgggcggcttctccacctgtatctcaagacagacacccgggggcctgtgtctgtggccgctcccatcccggcagccctggctgctgctcgccccaccctcgcttatctgtagattcaaagcgatgttctcttctgtgctcttagaagtagggagttcagcagtaacagccaggtgaagcgaacctgctgggtgatttgtttgcgctctgttttatggggcattcctgcgagatgtgtcagcttctgtgtgaaatgcagccacagctcatgtgtaccaaagtagaaaaccaaatcacagagaaataaaaacatgcttcagag

SEQ ID NO: 163106 - DNA, 5083 bp, Homo sapiens
  Payload ID: 12145
  Gene Symbol: OSBP
  Gene Name: oxysterol binding protein
  Uniprot ID: P22059
  ENST ID: ENST00000263847
  CDS Start-End: 481-2904
agaagagcgatgggagggggtgacgtggcagtgacaggcgcataaactgaaatgaatggcggaaacagcagccaatcggcgatcagattggccgggcattccgcattctcccgtcctccctgagcgctggaaacttcaggaaagcaccaatgagcttccccaaaagtctgattggcctttatctgaaccaatcaaaggtgggtctggcggacgcgtcccaccccaggctctcactgggcgctgtagaatgacaggcccgagagaaatgccaatatccgcggggtcttcctcaagtgacactcagcggcaccaatcgacgtccttcttcccggcggccgagccctcctccccgcggctggccgggcggggcggggacgctgcgcggcggtggctgatgcggtagccgtgtggggcgctccgggcggcgacggcggctctcgtaggcggttccggtcttgtatctccaggcggcggcggctcatggcggcgacggagctgagaggagtggtggggccaggcccggcagccattgcagcacttggcggcggcggcgccggtcccccagtggtgggaggaggcggcggccgcggagatgcggggccaggctccggggccgcgtcagggacggtggtcgcggcggcggcgggaggcccgggcccgggggccgggggagtggcggcggctggcccggcccctgcgccgccgactgggggctcgggcggctcgggcgctgggggttcgggctcggctcgagagggctggctcttcaaatggaccaattatatcaaaggctaccagcggcgatggttcgtgctgagcaacgggctcctgagctactacagatcaaaggcagaaatgagacatacctgccgtggtaccatcaacctcgccacagccaacatcaccgtggaggactcctgcaacttcatcatttccaatgggggtgctcagacctaccatctgaaagctagttcagaagttgagcggcagcgctgggtgacggccctggaactggccaaggccaaagctgtgaagatgctggcagagtcagatgaatcaggagatgaagagtctgtctcacaaactgacaagactgagctgcagaatacccttcggaccctctctagcaaagtagaggacttgagcacgtgcaatgacttgatagctaagcatggcacagctctgcagcgttctctcagtgagctggagtccctgaagttgcctgctgagagcaatgaaaagatcaaacaggtcaacgaacgagccacactctttaggataacatccaatgccatgatcaacgcctgcagagatttcctcatgttagcccagacccatagtaaaaaatggcaaaagtcactacagtatgaaagagaccagcgtatccgactggaagaaaccctcgagcagctggcgaagcagcataatcacctggagagggccttccgaggagccacggtgctgccggcaaacactcctggcaatgtgggttctggtaaagatcagtgctgctctggcaaaggggacatgagcgatgaagatgatgagaatgaattttttgatgcacctgagatcatcaccatgcctgaaaatttgggccacaaacgtactggcagcaatatcagtggagccagcagtgacatcagccttgatgaacagtacaagcatcagctggaggagaccaaaaaggaaaagagaaccagaataccatacaagccaaactatagcctcaatttatggagcatcatgaagaactgcattggaaaagaactctctaagatccccatgccggtaaactttaatgagcccttgtccatgcttcagcgccttactgaagatctggaataccatgagctgttagaccgagctgcaaaatgtgagaattctctagaacagctctgttatgttgcagctttcaccgtgtcctcctactccactactgtcttccgcaccagtaagccattcaacccactgcttggggagacctttgagctggaccgattagaggagaatgggtaccgatccctctgtgaacaggtgagtcatcatccccctgctgctgcgcaccatgctgagtccaaaaatggctggacattgcgtcaggaaatcaaaatcaccagcaagtttcgaggcaaatacctctccattatgcccctcggtaccattcattgtattttccatgcaactgggcaccactacacttggaagaaagttaccacaactgtacacaacattattgtgggcaagttgtggatagatcagtctggcgaaattgatattgtgaatcacaagacaggagacaagtgtaatcttaaatttgttccttatagctacttctctcgggatgtagcaagaaaggtgacgggggaagtgacagatccatcaggaaaagtccactttgctcttctggggacgtgggatgagaaaatggaatgtttcaaagtacagccagtcattggggaaaatgggggtgatgctcgacagagaggccatgaagcagaggaaagcagggtcatgctgtggaaaaggaatcctttaccgaagaatgcagaaaacatgtactacttctcagagcttgctctgactctcaatgcttgggaaagtggcactgcccccacagacagccggttacgacctgaccagagactgatggaaaatggacgctgggatgaagcaaatgcggagaagcagcgcctggaggaaaaacaaagactttccagaaagaagagagaagcggaagctatgaaagccacagaggatggcacaccatatgatccctataaggcactgtggtttgagcggaagaaggaccctgttaccaaggagttaacccatatttataggggagaatactgggagtgtaaagaaaaacaggactggagctcatgcccggacattttctgaaacggcagtaacaaaaaagaggagcatataatggagaagaggacagaggatgtgtgggaaagctggaagttgtgactctcttaccaagtgctttcctcaagtttgtctctcttgaccaatcattttttccaaatcaatcaccagaaggagacaccagtggtggtgattggctggttgccttagctgattgaaactgaaatcgacataggagatactatgtctgtaagggagaggtttagtggccgaaggttagtgttattccacatccacgaagtcaagtattcttggctcttctttctccctctgcccccatttaagacaatgtcactcaccctccccttgtagtatcctgctcagccaagatctgcctaagattatgattcaggggcattttggtgctgttaaaagcaagagccgaatttagaagttcccttaaaaagaaacacataagacttaccaatggaggcattgtgaatggttgcagtggagcttaggtataacatcatcaagtgtgttcacacgcggggtcggtttaatggagtgtccacgcggagataactgcgatattggaacacctgtgagagagattgttctatagggctggaatattcagagttacattcttggaagtttctgtttttacttgcatcaaacacccctctgttgttctccatcatctttaatagcaactggagaccactttggtcattggtaagggggtgcattctcctcacaaaggggttttatggacttcctcaggcggagagcttctgagaacacaggcaggatggaaaaagactactagccacttttgctttcccaaccccccttaatgccatccttcattgtctttctggcttctcttcttctggcacagtaccattttgggtctgtgccccagtgtggagcaaaacattgcctgtcccattctgatatacttcagaatttgagagcagaagttaatgtggaacaaaagttttcaccatctctcaagccccaaggactggagccacctctggaataatgtgttaaatatctgtatattatatatatgtagagaaaaatctaattttttggtttgatttccttcccattaagaatcttgttttttgatacccttgtctccctgagactctttcttggacacgtgttgatgtggatggcactcctgctctccatcttttatgggcagagagatttcaaaacctgagcaggatcatgtctggcagttactaaacagggactttgtccatggtttgtatcatggggtgcctactgctgtctaaactctgctctcctaattagctgactcttgaaaatgaaatcctaacctctttcctgcctcttttctttctcttttcaggaagagtgtgggtagaaagtccggagggcaacttccaatttaattctgctctgtccggcgcataggctgaattccaaaagaactttcttcctaggatgtggggcttaaagcaccgtcatgtggggtggatcagataattgctcctgtggggccctggcttccttctctgtttgtgcagtatttgtttttgttgtcttgttgagaaatatcccctgtgcaacccacccttggttgaggatcacaaattgaggtgccttccttgtatgctttttgttagtattttttgtttttgttccttaactgctgagcctcagccagcgtgggtcctgggggaaataccattccaaaggaagccatccctatggggaaattggttttactgggtaaattaatacttttatttcttcccctatcccttccttcctagttgtgataaacatgggagaggagtgactttgactgctggggaatttcctcctaagaaccttattcccaaaataagccagggattatgtcaaggcttctttcaaggaggctcataaaagcagtgacctcatccggggctttggatagagtgagaattccccaactaaattggacttctctgctttatccccttctcttccttcaccatctgcactacatttctggctgatcccaatcagattcccgctaatggaagaagtttagaatctttcaggtggaataaagtcacatgaaaacaaaacacaactatatatattttcagtttttttgccttattgatttttttccaaaaaaaaaaaactactaaattaaataattttttaaaagtca

SEQ ID NO: 163107 - DNA, 991 bp, Homo sapiens
  Payload ID: 12145
  Gene Symbol: OSBP
  Gene Name: oxysterol binding protein
  ENST ID: ENST00000525357
  CDS Start-End: 1-515
tcagtggagccagcagtgacatcagccttgatgaacagtacaagcatcagctggaggagaccaaaaaggaaaagagaaccagaataccatacaagccaaactatagcctcaatttatggagcatcatgaagaactgcattggaaaagaactctctaagatccccatgccggtaaactttaatgagcccttgtccatgcttcagcgccttactgaagatctggaataccatgagctgttagaccgagctgcaaaatgtgagaattctctagaacagctctgttatgttgcagctttcaccgtgtcctcctactccactactgtcttccgcaccagtaagccattcaacccactgcttggggagacctttgagctggaccgattagaggagaatgggtaccgatccctctgtgaacaggtaccattcattgtattttccatgcaactgggcaccactacacttggaagaaagttaccacaactgtacacaacattattgtgggcaagttgtggatagatcagtctggcgaaattgatattgtgaatcacaagacaggagacaagtgtaatcttaaatttgttccttatagctacttctctcgggatgtagcaagaaaggtgacgggggaagtgacagatccatcaggaaaagtccactttgctcttctggggacgtgggatgagaaaatggaatgtttcaaagtacagccagtcattggggaaaatgggggtgatgctcgacagagaggccatgaagcagaggaaagcagggtcatgctgtggaaaaggaatcctttaccgaagaatgcagaaaacatgtactacttctcagagcttgctctgactctcaatgcttgggaaagtggcactgcccccacagacagccggttacgacctgaccagagactgatggaaaatggacgctgggatgaagcaaatgcggagaagcagcgcctggaggaaaaacaaagactttccagaaagaagagagaa

SEQ ID NO: 163108 - DNA, 4340 bp, Homo sapiens
  Payload ID: 12146
  Gene Symbol: OSBP2
  Gene Name: oxysterol binding protein 2
  Uniprot ID: Q969R2
  ENST ID: ENST00000332585
  CDS Start-End: 105-2855
gcccccgcctcgcgccgcgcgcacgtgactgcgcccccggccccgcccccggcctgccccccgcccccactggccgctcggccgcgcgcgggtcggccggctctatggggaaagcggcggctccgagccgaggcggcggctgtggcggccgctcccgcgggctctcgtcgctgttcacggttgtcccctgcctgtcgtgccacacggcggcgccgggcatgagcgcttccacgtccggctccgggccggagcccaagccccagccccagcccgtgcccgaaccggagcggggaccgctgtcagaacaggtgtcggaggcagtttcggaggcagtgccaagatcggaacctgtgtccgagacgacgtctgagccggagccaggggctgggcagccatcggaactgctgcaggggtcgcggccggggtcagagtcaagctcaggtgtaggggctgggcccttcactaaggccgcatcggagccgctctcccgggcggtggggagcgcgacctttctcagacccgagtcaggatcgctgccagcgttaaagcccctgcctcttctgcgaccaggacaggcgaagactcctcttggggttccaatgtcggggactggcacgacctccagtgccccactggccttactgcctctggacagcttcgagggctggcttctcaagtggaccaactatctgaagggctaccagcgccgctggttcgtgctgggcaatggtttgctctcttactacagaaatcagggtgaaatggcccacacgtgccgtggaaccatcaacctgtccaccgcgcacattgacacggaggactcttgtggtatcttgctgaccagtggggccaggagctaccacctcaaggccagctcagaggtggaccggcagcagtggatcaccgccctggagctggccaaggccaaggctgtccgcgtgatgaacactcattcagatgactctggggacgacgacgaggctaccaccccagccgacaagagcgagctgcaccacaccctgaagaatctttccctgaagttagatgacctcagcacgtgcaatgacctcatcgccaagcacggcgctgcactccagcgctccctgacagagctggacggcctcaagatcccatctgagagtggggagaagctgaaggtggtgaatgagcgggccaccctcttccgcatcacatccaatgctatgatcaacgcctgcagggacttcttggaactagcagagatacacagtcggaaatggcagcgggcactgcagtatgagcaggagcagcgcgtgcacttggaggaaaccattgagcagctggcgaagcagcacaacagcctcgagcgggccttccacagtgcccctggccggccggccaacccctccaagagcttcattgagggaagcctcttgactcccaaaggagaggacagtgaggaagatgaagataccgagtactttgatgccatggaagactccacatccttcatcaccgtgatcaccgaggccaaggaagacagcagaaaagctgaaggtagcaccgggacaagttccgtggactggagctcagcagacaatgtactagatggtgcctcgctcgtgcccaagggttcatccaaagtcaagaggcgagtccgcattcccaacaagcccaactacagccttaacctctggagcatcatgaagaactgcatcggccgggagctctccaggatccccatgccggtgaacttcaatgagcccctgtccatgctccagcggctgacagaggacctggagtaccaccacctgctggacaaggcagtgcactgcaccagctcagtggagcagatgtgcctggtggccgccttctctgtgtcctcctactccaccacagtgcaccgcatcgccaagcccttcaaccccatgctgggggagaccttcgagctggaccgcctcgacgacatgggcctgcgctccctctgtgagcaggtgagccaccaccccccctcagctgcgcactacgtgttctccaagcatggctggagcctctggcaggagatcaccatctccagcaagttccggggaaaatacatctccatcatgccgctaggtgccatccacttagaattccaggccagtgggaatcactacgtgtggaggaagagcacctcaactgttcacaacatcatcgtgggcaagctctggatcgaccagtcaggggacatcgagattgtgaaccataagaccaatgaccggtgccagctgaagttcctgccctacagctacttctccaaagaggcagcccggaaggtgacaggagtggtgagtgacagccagggcaaggcccattacgtgctgtccggctcgtgggatgaacaaatggagtgctccaaggtcatgcatagcagtcccagcagccccagctctgacgggaagcagaagacagtgtaccagaccctgtcagccaagctgctgtggaagaagtacccgctgccggagaacgcggagaacatgtactacttctcagagctggccctgaccctcaacgagcacgaggagggcgtagcgccaaccgacagccgcctgcggcccgaccagcggctgatggagaagggccgttgggacgaggccaataccgagaagcagcggctggaggagaagcagcgcctgtcgcggcgccggcggctggaggcctgcgggccgggcagcagctgcagctcggaggaagagaaggaggcggatgcctacacgccactgtggtttgagaagaggctggatccgctgaccggggagatggcctgtgtgtacaagggcggctactgggaggccaaggagaagcaagactggcatatgtgccccaacatcttctgagcgccacccttgcaacaaatacaggcgcctgcacagcctggcccacctgttcattaatgcactcaatttagtactgaatggtctttctcccagcccattcccagcccttcctatttcctttcctattttttttttctccccacactttcttgggactcccaccttggaaggaggaagggctgacctgggttctctccagcccccaggtgcgccgggtcacccgtgccccttcattatggacctgggccctaccggaacccctgccccagttaccacaactcaggccggctggcccgggccatgggctgcgcaaatcaccagcccccaacccagggaggaactggcccctcctagggagcctcttcgacttttttagaaaaatgatctccatttctttccagccatgatgtttagtaaatatttttagtaccgcacttagcagacagctttccaagtgtgctttcttgccacaaaagtgtcctggcaagagccccttatttttaagacatcaggaagccagaccgctttgagttgggagaattttgtagctcaacatatcaagtcctcgatggtatctgagctgcccacacccccacctgccaaggccccacagagcccaaaacagaagggggctgccccagcccagcagagcacagagtttctggagctcccatccacagatgcaggagggggtactgatggtaacccccatgtggatttgagggcagcagtccctggcctcaccctagccagcctgggtggctccctagccccaagaggccaggaagggctggaaggcagggcctgcaggtgctccccgccctgagacccaggccccaaatcagcaataatgaacaaacccttggcccagcctgggctggtgacctgggcaccagagaccttgcatccctcctcatcctaggaggcccctaggggtgccccatctcagtgtcccctgaactctttatttgcctaatttatatatatatatatgagatatataaatatatataaaatagctattttgcttaaatttctacagtatgtaaaagtgaaaaaatgatgaagacgggtgcacctgtctgagtttggccctcatgtgagctgtgcccttccctctcctcatgcccccttccagcggcttctgccaaccatggggggctggaccaccatggccactgacccagcccctcagaatcccacactccaatcctttccatttcagtttagtcctaaaagttcatcacagggtctttctttctactccaggactggttttgtttttatatatataaaaaaaaaaagtgaaaacaccaatgtgtgaaatgccttacaatgcccactggagaggcggggcggggtggggcaggatggccccactggggctcctacagagctgtggaatgtacctctccccaacactgttttgttagcgagcaccttttgaccagtaataaaaaaccttggctttggagttttccactg

SEQ ID NO: 163109 - DNA, 3728 bp, Homo sapiens
  Payload ID: 12146
  Gene Symbol: OSBP2
  Gene Name: oxysterol binding protein 2
  ENST ID: ENST00000403222
  CDS Start-End: 333-2243
agagaacccgaacgatgtcgtcactggcagcgaagcgccttggcatgaaccgtaggccagctggctcaggaggtggaggcggtgaggcggccacttggggccaccgcttctggcggccgcaggagcgacccacagacagaaatcagggtgaaatggcccacacgtgccgtggaaccatcaacctgtccaccgcgcacattgacacggaggactcttgtggtatcttgctgaccagtggggccaggagctaccacctcaaggccagctcagaggtggaccggcagcagtggatcaccgccctggagctggccaaggccaaggctgtccgcgtgatgaacactcattcagatgactctggggacgacgacgaggctaccaccccagccgacaagagcgagctgcaccacaccctgaagaatctttccctgaagttagatgacctcagcacgtgcaatgacctcatcgccaagcacggcgctgcactccagcgctccctgacagagctggacggcctcaagatcccatctgagagtggggagaagctgaaggtggtgaatgagcgggccaccctcttccgcatcacatccaatgctatgatcaacgcctgcagggacttcttggaactagcagagatacacagtcggaaatggcagcgggcactgcagtatgagcaggagcagcgcgtgcacttggaggaaaccattgagcagctggcgaagcagcacaacagcctcgagcgggccttccacagtgcccctggccggccggccaacccctccaagagcttcattgagggtgacctcttgactcccaaaggagaggacagtgaggaagatgaagataccgagtactttgatgccatggaagactccacatccttcatcaccgtgatcaccgaggccaaggaagacagaaaagctgaaggtagcaccgggacaagttccgtggactggagctcagcagacaatgtactagatggtgcctcgctcgtgcccaagggttcatccaaagtcaagaggcgagtccgcattcccaacaagcccaactacagccttaacctctggagcatcatgaagaactgcatcggccgggagctctccaggatccccatgccggtgaacttcaatgagcccctgtccatgctccagcggctgacagaggacctggagtaccaccacctgctggacaaggcagtgcactgcaccagctcagtggagcagatgtgcctggtggccgccttctctgtgtcctcctactccaccacagtgcaccgcatcgccaagcccttcaaccccatgctgggggagaccttcgagctggaccgcctcgacgacatgggcctgcgctccctctgtgagcaggtgagccaccaccccccctcagctgcgcactacgtgttctccaagcatggctggagcctctggcaggagatcaccatctccagcaagttccggggaaaatacatctccatcatgccgctaggtgccatccacttagaattccaggccagtgggaatcactacgtgtggaggaagagcacctcaactgttcacaacatcatcgtgggcaagctctggatcgaccagtcaggggacatcgagattgtgaaccataagaccaatgaccggtgccagctgaagttcctgccctacagctacttctccaaagaggcagcccggaaggtgacaggagtggtgagtgacagccagggcaaggcccattacgtgctgtccggctcgtgggatgaacaaatggagtgctccaaggtcatgcatagcagtcccagcagccccagctctgacgggaagcagaagacagtgtaccagaccctgtcagccaagctgctgtggaagaagtacccgctgccggagaacgcggagaacatgtactacttctcagagctggccctgaccctcaacgagcacgaggagggcgtagcgccaaccgacagccgcctgcggcccgaccagcggctgatggagaagggccgttgggacgaggccaataccgagaagcagcggctggaggagaagcagcgcctgtcgcggcgccggcggctggaggcctgcgggccgggcagcagctgcagctcggaggaagagaaggaggcggatgcctacacgccactgtggtttgagaagaggctggatccgctgaccggggagatggcctgtgtgtacaagggcggctactgggaggccaaggagaagcaagactggcatatgtgccccaacatcttctgagcgccacccttgcaacaaatacaggcgcctgcacagcctggcccacctgttcattaatgcactcaatttagtactgaatggtctttctcccagcccattcccagcccttcctatttcctttcctattttttttttctccccacactttcttgggactcccaccttggaaggaggaagggctgacctgggttctctccagcccccaggtgcgccgggtcacccgtgccccttcattatggacctgggccctaccggaacccctgccccagttaccacaactcaggccggctggcccgggccatgggctgcgcaaatcaccagcccccaacccagggaggaactggcccctcctagggagcctcttcgacttttttagaaaaatgatctccatttctttccagccatgatgtttagtaaatatttttagtaccgcacttagcagacagctttccaagtgtgctttcttgccacaaaagtgtcctggcaagagccccttatttttaagacatcaggaagccagaccgctttgagttgggagaattttgtagctcaacatatcaagtcctcgatggtatctgagctgcccacacccccacctgccaaggccccacagagcccaaaacagaagggggctgccccagcccagcagagcacagagtttctggagctcccatccacagatgcaggagggggtactgatggtaacccccatgtggatttgagggcagcagtccctggcctcaccctagccagcctgggtggctccctagccccaagaggccaggaagggctggaaggcagggcctgcaggtgctccccgccctgagacccaggccccaaatcagcaataatgaacaaacccttggcccagcctgggctggtgacctgggcaccagagaccttgcatccctcctcatcctaggaggcccctaggggtgccccatctcagtgtcccctgaactctttatttgcctaatttatatatatatatatgagatatataaatatatataaaatagctattttgcttaaatttctacagtatgtaaaagtgaaaaaatgatgaagacgggtgcacctgtctgagtttggccctcatgtgagctgtgcccttccctctcctcatgcccccttccagcggcttctgccaaccatggggggctggaccaccatggccactgacccagcccctcagaatcccacactccaatcctttccatttcagtttagtcctaaaagttcatcacagggtctttctttctactccaggactggttttgtttttatatatataaaaaaaaaaagtgaaaacaccaatgtgtgaaatgccttacaatgcccactggagaggcggggcggggtggggcaggatggccccactggggctcctacagagctgtggaatgtacctctccccaacactgttttgttagcgagcaccttttgaccagtaataaaaaaccttggctttggagttttccactg

SEQ ID NO: 163110 - DNA, 3669 bp, Homo sapiens
  Payload ID: 12146
  Gene Symbol: OSBP2
  Gene Name: oxysterol binding protein 2
  ENST ID: ENST00000407373
  CDS Start-End: 145-2376
aacctctgcggaagcctcacagactgccagcctacccagggatcccgggaggtccaagttcagaatcccactttgagatgtttcttgtactaaaacgcttggtttacaaaaagtcttcccctatttgtttagagaacccgaacgatgtcgtcactggcagcgaagcgccttggcatgaaccgtaggccagctggctcaggaggtggaggcggtgaggcggccacttggggccaccgcttctggcggccgcaggagcgacccacagacagaaatcagggtgaaatggcccacacgtgccgtggaaccatcaacctgtccaccgcgcacattgacacggaggactcttgtggtatcttgctgaccagtggggccaggagctaccacctcaaggccagctcagaggtggaccggcagcagtggatcaccgccctggagctggccaaggccaaggctgtccgcgtgatgaacactcattcagatgactctggggacgacgacgaggctaccaccccagccgacaagagcgagctgcaccacaccctgaagaatctttccctgaagttagatgacctcagcacgtgcaatgacctcatcgccaagcacggcgctgcactccagcgctccctgacagagctggacggcctcaagatcccatctgagagtggggagaagctgaaggtggtgaatgagcgggccaccctcttccgcatcacatccaatgctatgatcaacgcctgcagggacttcttggaactagcagagatacacagtcggaaatggcagcgggcactgcagtatgagcaggagcagcgcgtgcacttggaggaaaccattgagcagctggcgaagcagcacaacagcctcgagcgggccttccacagtgcccctggccggccggccaacccctccaagagcttcattgagggaagcctcttgactcccaaaggagaggacagtgaggaagatgaagataccgagtactttgatgccatggaagactccacatccttcatcaccgtgatcaccgaggccaaggaagacagcagaaaagctgaaggtagcaccgggacaagttccgtggactggagctcagcagacaatgtactagatggtgcctcgctcgtgcccaagggttcatccaaagtcaagaggcgagtccgcattcccaacaagcccaactacagccttaacctctggagcatcatgaagaactgcatcggccgggagctctccaggatccccatgccggtgaacttcaatgagcccctgtccatgctccagcggctgacagaggacctggagtaccaccacctgctggacaaggcagtgcactgcaccagctcagtggagcagatgtgcctggtggccgccttctctgtgtcctcctactccaccacagtgcaccgcatcgccaagcccttcaaccccatgctgggggagaccttcgagctggaccgcctcgacgacatgggcctgcgctccctctgtgagcaggtgagccaccaccccccctcagctgcgcactacgtgttctccaagcatggctggagcctctggcaggagatcaccatctccagcaagttccggggaaaatacatctccatcatgccgctaggtgccatccacttagaattccaggccagtgggaatcactacgtgtggaggaagagcacctcaactgttcacaacatcatcgtgggcaagctctggatcgaccagtcaggggacatcgagattgtgaaccataagaccaatgaccggtgccagctgaagttcctgccctacagctacttctccaaagaggcagcccggaaggtgacaggagtggtgagtgacagccagggcaaggcccattacgtgctgtccggctcgtgggatgaacaaatggagtgctccaaggtcatgcatagcagtcccagcagccccagctctgacgggaagcagaagacagtgtaccagaccctgtcagccaagctgctgtggaagaagtacccgctgccggagaacgcggagaacatgtactacttctcagagctggccctgaccctcaacgagcacgaggagggcgtagcgccaaccgacagccgcctgcggcccgaccagcggctgatggagaagggccgttgggacgaggccaataccgagaagcagcggctggaggagaagcagcgcctgtcgcggcgccggcggctggaggcctgcgggccgggcagcagctgcagctcggaggaagagaaggaggcggatgcctacacgccactgtggtttgagaagaggctggatccgctgaccggggagatggcctgtgtgtacaagggcggctactgggaggccaaggagaagcaagactggcatatgtgccccaacatcttctgagcgccacccttgcaacaaatacaggcgcctgcacagcctggcccacctgttcattaatgcactcaatttagtactgaatggtctttctcccagcccattcccagcccttcctatttcctttcctattttttttttctccccacactttcttgggactcccaccttggaaggaggaagggctgacctgggttctctccagcccccaggtgcgccgggtcacccgtgccccttcattatggacctgggccctaccggaacccctgccccagttaccacaactcaggccggctggcccgggccatgggctgcgcaaatcaccagcccccaacccagggaggaactggcccctcctagggagcctcttcgacttttttagaaaaatgatctccatttctttccagccatgatgtttagtaaatatttttagtaccgcacttagcagacagctttccaagtgtgctttcttgccacaaaagtgtcctggcaagagccccttatttttaagacatcaggaagccagaccgctttgagttgggagaattttgtagctcaacatatcaagtcctcgatggtatctgagctgcccacacccccacctgccaaggccccacagagcccaaaacagaagggggctgccccagcccagcagagcacagagtttctggagctcccatccacagatgcaggagggggtactgatggtaacccccatgtggatttgagggcagcagtccctggcctcaccctagccagcctgggtggctccctagccccaagaggccaggaagggctggaaggcagggcctgcaggtgctccccgccctgagacccaggccccaaatcagcaataatgaacaaacccttggcccagcctgggctggtgacctgggcaccagagaccttgcatccctcctcatcctaggaggcccctaggggtgccccatctcagtgtcccctgaactctttatttgcctaatttatatatatatatatgagatatataaatatatataaaatagctattttgcttaaatttctacagtatgtaaaagtgaaaaaatgatgaagacgggtgcacctgtctgagtttggccctcatgtgagctgtgcccttccctctcctcatgcccccttccagcggcttctgccaaccatggggggctggaccaccatggccactgacccagcccctcagaatcccacactccaatcctttccatttcagtttagtcctaaaagttcatcacagggtctttctttctactccaggactggttttgtttttatatatat

SEQ ID NO: 163111 - DNA, 2468 bp, Homo sapiens
  Payload ID: 12146
  Gene Symbol: OSBP2
  Gene Name: oxysterol binding protein 2
  Uniprot ID: Q969R2
  ENST ID: ENST00000401475
  CDS Start-End: 386-2035
agagcaactagagcaggcagtagagtggggtgggcggggatgaggagggggttgggtggctggtggccctagaggctggccctaaagaatacctggacagcctgccaccctattgctccaaaatgaaaatcctctaacagatgactctggggacgacgacgaggctaccaccccagccgacaagagcgagctgcaccacaccctgaagaatctttccctgaagttagatgacctcagcacgtgcaatgacctcatcgccaagcacggcgctgcactccagcgctccctgacagagctggacggcctcaagatcccatctgagagtggggagaagctgaaggtggtgaatgagcgggccaccctcttccgcatcacatccaatgctatgatcaacgcctgcagggacttcttggaactagcagagatacacagtcggaaatggcagcgggcactgcagtatgagcaggagcagcgcgtgcacttggaggaaaccattgagcagctggcgaagcagcacaacagcctcgagcgggccttccacagtgcccctggccggccggccaacccctccaagagcttcattgagggaagcctcttgactcccaaaggagaggacagtgaggaagatgaagataccgagtactttgatgccatggaagactccacatccttcatcaccgtgatcaccgaggccaaggaagacagaaaagctgaaggtagcaccgggacaagttccgtggactggagctcagcagacaatgtactagatggtgcctcgctcgtgcccaagggttcatccaaagtcaagaggcgagtccgcattcccaacaagcccaactacagccttaacctctggagcatcatgaagaactgcatcggccgggagctctccaggatccccatgccggtgaacttcaatgagcccctgtccatgctccagcggctgacagaggacctggagtaccaccacctgctggacaaggcagtgcactgcaccagctcagtggagcagatgtgcctggtggccgccttctctgtgtcctcctactccaccacagtgcaccgcatcgccaagcccttcaaccccatgctgggggagaccttcgagctggaccgcctcgacgacatgggcctgcgctccctctgtgagcaggtgagccaccaccccccctcagctgcgcactacgtgttctccaagcatggctggagcctctggcaggagatcaccatctccagcaagttccggggaaaatacatctccatcatgccgctaggtgccatccacttagaattccaggccagtgggaatcactacgtgtggaggaagagcacctcaactgttcacaacatcatcgtgggcaagctctggatcgaccagtcaggggacatcgagattgtgaaccataagaccaatgaccggtgccagctgaagttcctgccctacagctacttctccaaagaggcagcccggaaggtgacaggagtggtgagtgacagccagggcaaggcccattacgtgctgtccggctcgtgggatgaacaaatggagtgctccaaggtcatgcatagcagtcccagcagccccagctctgacgggaagcagaagacagtgtaccagaccctgtcagccaagctgctgtggaagaagtacccgctgccggagaacgcggagaacatgtactacttctcagagctggccctgaccctcaacgagcacgaggagggcgtagcgccaaccgacagccgcctgcggcccgaccagcggctgatggagaagggccgttgggacgaggccaataccgagaagcagcggctggaggagaagcagcgcctgtcgcggcgccggcggctggaggcctgcgggccgggcagcagctgcagctcggaggaagagaaggaggcggatgcctacacgccactgtggtttgagaagaggctggatccgctgaccggggagatggcctgtgtgtacaagggcggctactgggaggccaaggagaagcaagactggcatatgtgccccaacatcttctgagcgccacccttgcaacaaatacaggcgcctgcacagcctggcccacctgttcattaatgcactcaatttagtactgaatggtctttctcccagcccattcccagcccttcctatttcctttcctattttttttttctccccacactttcttgggactcccaccttggaaggaggaagggctgacctgggttctctccagcccccaggtgcgccgggtcacccgtgccccttcattatggacctgggccctaccggaacccctgccccagttaccacaactcaggccggctggcccgggccatgggctgcgcaaatcaccagcccccaacccagggaggaactggcccctcctagggagcctcttcgacttttttagaaaaatgatctccatttctttccagccatgatgtttagtaaatatttttagtaccgc

SEQ ID NO: 163112 - DNA, 861 bp, Homo sapiens
  Payload ID: 12146
  Gene Symbol: OSBP2
  Gene Name: oxysterol binding protein 2
  ENST ID: ENST00000424224
  CDS Start-End: 338-861
ggcggcggcggcggcggcagcagcagcagctgcaagagccctcgcagcctcggggcaggacccacgtccacacccgagagcccctccctgggatgactctggggacgacgacgaggctaccaccccagccgacaagagcgagctgcaccacaccctgaagaatctttccctgaagttagatgacctcagcacgtgcaatgacctcatcgccaagcacggcgctgcactccagcgctccctgacagagctggacggcctcaagatcccatctgagagtggggagaagctgaaggtggtgaatgagcgggccaccctcttccgcatcacatccaatgctatgatcaacgcctgcagggacttcttggaactagcagagatacacagtcggaaatggcagcgggcactgcagtatgagcaggagcagcgcgtgcacttggaggaaaccattgagcagctggcgaagcagcacaacagcctcgagcgggccttccacagtgcccctggccggccggccaacccctccaagagcttcattgagggaagcctcttgactcccaaaggagaggacagtgaggaagatgaagataccgagtactttgatgccatggaagactccacatccttcatcaccgtgatcaccgaggccaaggaagacagcagaaaagctgaaggtagcaccgggacaagttccgtggactggagctcagcagacaatgtactagatggtgcctcgctcgtgcccaagggttcatccaaagtcaagaggcgagtccgcattcccaacaagcccaactacagccttaacctctggagcatcatgaagaactgcatcggccgggagctctccaggatccccatgcc

SEQ ID NO: 163113 - DNA, 3580 bp, Homo sapiens
  Payload ID: 12146
  Gene Symbol: OSBP2
  Gene Name: oxysterol binding protein 2
  Uniprot ID: Q969R2
  ENST ID: ENST00000437268
  CDS Start-End: 116-2095
gagtgtccgccgcctccgccgggcggcccaccgagctgtgcacgcgtccgtgcaagcccccgggacccggcgccatgtagcgccccgccgattggaggctgccccgccgcgggaaatgaagggacgcggctgctgggacacggcctccgtgcgctccttctgcagctccggctgcctgaataaatttaagaaggatgactctggggacgacgacgaggctaccaccccagccgacaagagcgagctgcaccacaccctgaagaatctttccctgaagttagatgacctcagcacgtgcaatgacctcatcgccaagcacggcgctgcactccagcgctccctgacagagctggacggcctcaagatcccatctgagagtggggagaagctgaaggtggtgaatgagcgggccaccctcttccgcatcacatccaatgctatgatcaacgcctgcagggacttcttggaactagcagagatacacagtcggaaatggcagcgggcactgcagtatgagcaggagcagcgcgtgcacttggaggaaaccattgagcagctggcgaagcagcacaacagcctcgagcgggccttccacagtgcccctggccggccggccaacccctccaagagcttcattgagggaagcctcttgactcccaaaggagaggacagtgaggaagatgaagataccgagtactttgatgccatggaagactccacatccttcatcaccgtgatcaccgaggccaaggaagacagcagaaaagctgaaggtagcaccgggacaagttccgtggactggagctcagcagacaatgtactagatggtgcctcgctcgtgcccaagggttcatccaaagtcaagaggcgagtccgcattcccaacaagcccaactacagccttaacctctggagcatcatgaagaactgcatcggccgggagctctccaggatccccatgccggtgaacttcaatgagcccctgtccatgctccagcggctgacagaggacctggagtaccaccacctgctggacaaggcagtgcactgcaccagctcagtggagcagatgtgcctggtggccgccttctctgtgtcctcctactccaccacagtgcaccgcatcgccaagcccttcaaccccatgctgggggagaccttcgagctggaccgcctcgacgacatgggcctgcgctccctctgtgagcaggtgagccaccaccccccctcagctgcgcactacgtgttctccaagcatggctggagcctctggcaggagatcaccatctccagcaagttccggggaaaatacatctccatcatgccgctaggtgccatccacttagaattccaggccagtgggaatcactacgtgtggaggaagagcacctcaactgttcacaacatcatcgtgggcaagctctggatcgaccagtcaggggacatcgagattgtgaaccataagaccaatgaccggtgccagctgaagttcctgccctacagctacttctccaaagaggcagcccggaaggtgacaggagtggtgagtgacagccagggcaaggcccattacgtgctgtccggctcgtgggatgaacaaatggagtgctccaaggtcatgcatagcagtcccagcagccccagctctgacgggaagcagaagacagtgtaccagaccctgtcagccaagctgctgtggaagaagtacccgctgccggagaacgcggagaacatgtactacttctcagagctggccctgaccctcaacgagcacgaggagggcgtagcgccaaccgacagccgcctgcggcccgaccagcggctgatggagaagggccgttgggacgaggccaataccgagaagcagcggctggaggagaagcagcgcctgtcgcggcgccggcggctggaggcctgcgggccgggcagcagctgcagctcggaggaagcagagaaggaggcggatgcctacacgccactgtggtttgagaagaggctggatccgctgaccggggagatggcctgtgtgtacaagggcggctactgggaggccaaggagaagcaagactggcatatgtgccccaacatcttctgagcgccacccttgcaacaaatacaggcgcctgcacagcctggcccacctgttcattaatgcactcaatttagtactgaatggtctttctcccagcccattcccagcccttcctatttcctttcctattttttttttctccccacactttcttgggactcccaccttggaaggaggaagggctgacctgggttctctccagcccccaggtgcgccgggtcacccgtgccccttcattatggacctgggccctaccggaacccctgccccagttaccacaactcaggccggctggcccgggccatgggctgcgcaaatcaccagcccccaacccagggaggaactggcccctcctagggagcctcttcgacttttttagaaaaatgatctccatttctttccagccatgatgtttagtaaatatttttagtaccgcacttagcagacagctttccaagtgtgctttcttgccacaaaagtgtcctggcaagagccccttatttttaagacatcaggaagccagaccgctttgagttgggagaattttgtagctcaacatatcaagtcctcgatggtatctgagctgcccacacccccacctgccaaggccccacagagcccaaaacagaagggggctgccccagcccagcagagcacagagtttctggagctcccatccacagatgcaggagggggtactgatggtaacccccatgtggatttgagggcagcagtccctggcctcaccctagccagcctgggtggctccctagccccaagaggccaggaagggctggaaggcagggcctgcaggtgctccccgccctgagacccaggccccaaatcagcaataatgaacaaacccttggcccagcctgggctggtgacctgggcaccagagaccttgcatccctcctcatcctaggaggcccctaggggtgccccatctcagtgtcccctgaactctttatttgcctaatttatatatatatatatgagatatataaatatatataaaatagctattttgcttaaatttctacagtatgtaaaagtgaaaaaatgatgaagacgggtgcacctgtctgagtttggccctcatgtgagctgtgcccttccctctcctcatgcccccttccagcggcttctgccaaccatggggggctggaccaccatggccactgacccagcccctcagaatcccacactccaatcctttccatttcagtttagtcctaaaagttcatcacagggtctttctttctactccaggactggttttgtttttatatatataaaaaaaaaaagtgaaaacaccaatgtgtgaaatgccttacaatgcccactggagaggcggggcggggtggggcaggatggccccactggggctcctacagagctgtggaatgtacctctccccaacactgttttgttagcgagcaccttttgaccagtaataaaaaaccttggctttggagttttccactg

SEQ ID NO: 163114 - DNA, 2836 bp, Homo sapiens
  Payload ID: 12146
  Gene Symbol: OSBP2
  Gene Name: oxysterol binding protein 2
  Uniprot ID: Q969R2
  ENST ID: ENST00000446658
  CDS Start-End: 22-2769
gcgcgcgggtcggccggctctatggggaaagcggcggctccgagccgaggcggcggctgtggcggccgctcccgcgggctctcgtcgctgttcacggttgtcccctgcctgtcgtgccacacggcggcgccgggcatgagcgcttccacgtccggctccgggccggagcccaagccccagccccagcccgtgcccgaaccggagcggggaccgctgtcagaacaggtgtcggaggcagtttcggaggcagtgccaagatcggaacctgtgtccgagacgacgtctgagccggagccaggggctgggcagccatcggaactgctgcaggggtcgcggccggggtcagagtcaagctcaggtgtaggggctgggcccttcactaaggccgcatcggagccgctctcccgggcggtggggagcgcgacctttctcagacccgagtcaggatcgctgccagcgttaaagcccctgcctcttctgcgaccaggacaggcgaagactcctcttggggttccaatgtcggggactggcacgacctccagtgccccactggccttactgcctctggacagcttcgagggctggcttctcaagtggaccaactatctgaagggctaccagcgccgctggttcgtgctgggcaatggtttgctctcttactacagaaatcagggtgaaatggcccacacgtgccgtggaaccatcaacctgtccaccgcgcacattgacacggaggactcttgtggtatcttgctgaccagtggggccaggagctaccacctcaaggccagctcagaggtggaccggcagcagtggatcaccgccctggagctggccaaggccaaggctgtccgcgtgatgaacactcattcagatgactctggggacgacgacgaggctaccaccccagccgacaagagcgagctgcaccacaccctgaagaatctttccctgaagttagatgacctcagcacgtgcaatgacctcatcgccaagcacggcgctgcactccagcgctccctgacagagctggacggcctcaagatcccatctgagagtggggagaagctgaaggtggtgaatgagcgggccaccctcttccgcatcacatccaatgctatgatcaacgcctgcagggacttcttggaactagcagagatacacagtcggaaatggcagcgggcactgcagtatgagcaggagcagcgcgtgcacttggaggaaaccattgagcagctggcgaagcagcacaacagcctcgagcgggccttccacagtgcccctggccggccggccaacccctccaagagcttcattgagggaagcctcttgactcccaaaggagaggacagtgaggaagatgaagataccgagtactttgatgccatggaagactccacatccttcatcaccgtgatcaccgaggccaaggaagacagaaaagctgaaggtagcaccgggacaagttccgtggactggagctcagcagacaatgtactagatggtgcctcgctcgtgcccaagggttcatccaaagtcaagaggcgagtccgcattcccaacaagcccaactacagccttaacctctggagcatcatgaagaactgcatcggccgggagctctccaggatccccatgccggtgaacttcaatgagcccctgtccatgctccagcggctgacagaggacctggagtaccaccacctgctggacaaggcagtgcactgcaccagctcagtggagcagatgtgcctggtggccgccttctctgtgtcctcctactccaccacagtgcaccgcatcgccaagcccttcaaccccatgctgggggagaccttcgagctggaccgcctcgacgacatgggcctgcgctccctctgtgagcaggtgagccaccaccccccctcagctgcgcactacgtgttctccaagcatggctggagcctctggcaggagatcaccatctccagcaagttccggggaaaatacatctccatcatgccgctaggtgccatccacttagaattccaggccagtgggaatcactacgtgtggaggaagagcacctcaactgttcacaacatcatcgtgggcaagctctggatcgaccagtcaggggacatcgagattgtgaaccataagaccaatgaccggtgccagctgaagttcctgccctacagctacttctccaaagaggcagcccggaaggtgacaggagtggtgagtgacagccagggcaaggcccattacgtgctgtccggctcgtgggatgaacaaatggagtgctccaaggtcatgcatagcagtcccagcagccccagctctgacgggaagcagaagacagtgtaccagaccctgtcagccaagctgctgtggaagaagtacccgctgccggagaacgcggagaacatgtactacttctcagagctggccctgaccctcaacgagcacgaggagggcgtagcgccaaccgacagccgcctgcggcccgaccagcggctgatggagaagggccgttgggacgaggccaataccgagaagcagcggctggaggagaagcagcgcctgtcgcggcgccggcggctggaggcctgcgggccgggcagcagctgcagctcggaggaagagaaggaggcggatgcctacacgccactgtggtttgagaagaggctggatccgctgaccggggagatggcctgtgtgtacaagggcggctactgggaggccaaggagaagcaagactggcatatgtgccccaacatcttctgagcgccacccttgcaacaaatacaggcgcctgcacagcctggcccacctgttcattaatgcactcaat

SEQ ID NO: 163115 - DNA, 930 bp, Homo sapiens
  Payload ID: 12146
  Gene Symbol: OSBP2
  Gene Name: oxysterol binding protein 2
  ENST ID: ENST00000433183
  CDS Start-End: 1-224
gtgccatccacttagaattccaggccagtgggaatcactacgtgtggaggaagagcacctcaactgttcacaacatcatcgtgggcaagctctggatcgaccagtcaggggacatcgagattgtgaaccataagaccaatgaccggtgccagctgaagttcctgccctacagctacttctccaaagaggcagcccggaaggtaagcaggaccagccacctctaagcaccccagggggcccagggcagagtctgcacctacgctggtcctgccaatgtccacaggtgacaggagtggtgagtgacagccagggcaaggcccattacgtgctgtccggctcgtgggatgaacaaatggagtgctccaaggtcatgcatagcagtcccagcagccccagctctgacgggaagcagaagacagtgtaccagaccctgtcagccaagctgctgtggaagaagtacccgctgccgtgagtagggctggcaggggccccgccacaggcaaaggagagggaaggaggacagtggacagaaagcaactgacaggcacaggaggtcgggagggttcagtccacacatgggcagagaacagtattatgcagccgacatcccagtgtgaaggcagacaccgaacagtaaataaatgtgaaactatcaaacactatgcacagactttaagcgaggtgataggacagagcccctccctgttcctccctacaagaaataaaaaacatacttgaaaataaccacaggaaatagaaaactataaaatgtggcataggaaagtccaaagagaacaaatagaaattcgacaaagggaaaaaaaaatgactgacattgagaaccctgtggaatggtttagtagctagaatctatcacctgaacacaggtcagaagaagtgacagaactgcatttaaagagacaaaaccca

SEQ ID NO: 163116 - DNA, 895 bp, Homo sapiens
  Payload ID: 12146
  Gene Symbol: OSBP2
  Gene Name: oxysterol binding protein 2
  ENST ID: ENST00000453621
  CDS Start-End: 1-895
agcattctgagaacagcagggccacgccaggcgcctgcctctccccacagcacagccaggatggggcctggagaaggccggcagcagcagaggagaccctgggagtcagggatggacaccaggcctgcagggacttcttggaactagcagagatacacagtcggaaatggcagcgggcactgcagtatgagcaggagcagcgcgtgcacttggaggaaaccattgagcagctggcgaagcagcacaacagcctcgagcgggccttccacagtgcccctggccggccggccaacccctccaagagcttcattgagggaagcctcttgactcccaaaggagaggacagtgaggaagatgaagataccgagtactttgatgccatggaagactccacatccttcatcaccgtgatcaccgaggccaaggaagacagaaaagctgaaggtagcaccgggacaagttccgtggactggagctcagcagacaatgtactagatggtgcctcgctcgtgcccaagggttcatccaaagtcaagaggcgagtccgcattcccaacaagcccaactacagccttaacctctggagcatcatgaagaactgcatcggccgggagctctccaggatccccatgccggtgaacttcaatgagcccctgtccatgctccagcggctgacagaggacctggagtaccaccacctgctggacaaggcagtgcactgcaccagctcagtggagcagatgtgcctggtggccgccttctctgtgtcctcctactccaccacagtgcaccgcatcgccaagcccttcaaccccatgctgggggagaccttcgagctggaccgcctcgacgacatgggcctgcgctccctctgtgagcaggtgagccaccaccc

SEQ ID NO: 163117 - DNA, 589 bp, Homo sapiens
  Payload ID: 12146
  Gene Symbol: OSBP2
  Gene Name: oxysterol binding protein 2
  ENST ID: ENST00000454145
  CDS Start-End: 1-589
agcattctgagaacagcagggccacgccaggcgcctgcctctccccacagcacagccaggatggggcctggagaaggccggcagcagcagaggagaccctgggagtcagggatggacaccaggcctgcagggacttcttggaactagcagagatacacagtcggaaatggcagcgggcactgcagtatgagcaggagcagcgcgtgcacttggaggaaaccattgagcagctggcgaagcagcacaacagcctcgagcgggccttccacagtgcccctggccggccggccaacccctccaagagcttcattgagggaagcctcttgactcccaaaggagaggacagtgaggaagatgaagataccgagtactttgatgccatggaagactccacatccttcatcaccgtgatcaccgaggccaaggaagacagcagaaaagctgaaggtagcaccgggacaagttccgtggactggagctcagcagacaatggttcatccaaagtcaagaggcgagtccgcattcccaacaagcccaactacagccttaacctctggagcatcatgaagaactgcatcggccgggagct

SEQ ID NO: 163118 - DNA, 2763 bp, Homo sapiens
  Payload ID: 12146
  Gene Symbol: OSBP2
  Gene Name: oxysterol binding protein 2
  ENST ID: ENST00000452656
  CDS Start-End: 1-1353
gcctgcagggacttcttggaactagcagagatacacagtcggaaatggcagcgggcactgcagtatgagcaggagcagcgcgtgcacttggaggaaaccattgagcagctggcgaagcagcacaacagcctcgagcgggccttccacagtgcccctggccggccggccaacccctccaagagcttcattgagggaagcctcttgactcccaaaggagaggacagtgaggaagatgaagataccgagtactttgatgccatggaagactccacatccttcatcaccgtgatcaccgaggccaaggaagacagcagaaaagctgaaggtagcaccgggacaagttccgtggactggagctcagcagacaatgtactagatggtgcctcgctcgtgcccaagggttcatccaaagtcaagaggcgagtccgcattcccaacaagcccaactacagccttaacctctggagcatcatgaagaactgcatcggccgggagctctccaggatccccatgccggtgaacttcaatgagcccctgtccatgctccagcggctgacagaggacctggagtaccaccacctgctggacaaggcagtgcactgcaccagctcagtggagcagatgtgcctggtggccgccttctctgtgtcctcctactccaccacagtgcaccgcatcgccaagcccttcaaccccatgctgggggagaccttcgagctggaccgcctcgacgacatgggcctgcgctccctctgtgagcaggtgagccaccaccccccctcagctgcgcactacgtgttctccaagcatggctggagcctctggcaggagatcaccatctccagcaagttccggggaaaatacatctccatcatgccgctaggtgccatccacttagaattccaggccagtgggaatcactacgtgtggaggaagagcacctcaactgttcacaacatcatcgtgggcaagctctggatcgaccagtcaggggacatcgagattgtgaaccataagaccaatgaccggtgccagctgaagttcctgccctacagctacttctccaaagaggcagcccggaagggagaacgcggagaacatgtactacttctcagagctggccctgaccctcaacgagcacgaggagggcgtagcgccaaccgacagccgcctgcggcccgaccagcggctgatggagaagggccgttgggacgaggccaataccgagaagcagcggctggaggagaagcagcgcctgtcgcggcgccggcggctggaggcctgcgggccgggcagcagctgcagctcggaggaagagaaggaggcggatgcctacacgccactgtggtttgagaagaggctggatccgctgaccggggagatggcctgtgtgtacaagggcggctactgggaggccaaggagaagcaagactggcatatgtgccccaacatcttctgagcgccacccttgcaacaaatacaggcgcctgcacagcctggcccacctgttcattaatgcactcaatttagtactgaatggtctttctcccagcccattcccagcccttcctatttcctttcctattttttttttctccccacactttcttgggactcccaccttggaaggaggaagggctgacctgggttctctccagcccccaggtgcgccgggtcacccgtgccccttcattatggacctgggccctaccggaacccctgccccagttaccacaactcaggccggctggcccgggccatgggctgcgcaaatcaccagcccccaacccagggaggaactggcccctcctagggagcctcttcgacttttttagaaaaatgatctccatttctttccagccatgatgtttagtaaatatttttagtaccgcacttagcagacagctttccaagtgtgctttcttgccacaaaagtgtcctggcaagagccccttatttttaagacatcaggaagccagaccgctttgagttgggagaattttgtagctcaacatatcaagtcctcgatggtatctgagctgcccacacccccacctgccaaggccccacagagcccaaaacagaagggggctgccccagcccagcagagcacagagtttctggagctcccatccacagatgcaggagggggtactgatggtaacccccatgtggatttgagggcagcagtccctggcctcaccctagccagcctgggtggctccctagccccaagaggccaggaagggctggaaggcagggcctgcaggtgctccccgccctgagacccaggccccaaatcagcaataatgaacaaacccttggcccagcctgggctggtgacctgggcaccagagaccttgcatccctcctcatcctaggaggcccctaggggtgccccatctcagtgtcccctgaactctttatttgcctaatttatatatatatatatgagatatataaatatatataaaatagctattttgcttaaatttctacagtatgtaaaagtgaaaaaatgatgaagacgggtgcacctgtctgagtttggccctcatgtgagctgtgcccttccctctcctcatgcccccttccagcggcttctgccaaccatggggggctggaccaccatggccactgacccagcccctcagaatcccacactccaatcctttccatttcagtttagtcctaaaagttcatcacagggtctttctttctactccaggactggttttgtttttatatatataaaaaaaaaaa

SEQ ID NO: 163119 - DNA, 2747 bp, Homo sapiens
  Payload ID: 12146
  Gene Symbol: OSBP2
  Gene Name: oxysterol binding protein 2
  Uniprot ID: Q969R2
  ENST ID: ENST00000438716
  CDS Start-End: 280-2532
catggtgaaaccccgtttctactaaaaatacaaaatttagctgggcatggtgcgggccgtggaattccagctactagggaggccaaggcaggagaatcgcttgaacctgggaagcggaggctgcagtgaaccaagatcacgccactgcattccagcctgggctaccgagtgagactcagtctcaaaaaggaaaaaaaaaaaaagcggaaaaaaaaattcgctgatgttttaaccattctggggtcacagcctcctttgttatggacctactctggaaaaatgcacagacagagaacccgaacgatgtcgtcactggcagcgaagcgccttggcatgaaccgtaggccagctggctcaggaggtggaggcggtgaggcggccacttggggccaccgcttctggcggccgcaggagcgacccacagacagaaatcagggtgaaatggcccacacgtgccgtggaaccatcaacctgtccaccgcgcacattgacacggaggactcttgtggtatcttgctgaccagtggggccaggagctaccacctcaaggccagctcagaggtggaccggcagcagtggatcaccgccctggagctggccaaggccaaggctgtccgcgtgatgaacactcattcagatgactctggggacgacgacgaggctaccaccccagccgacaagagcgagctgcaccacaccctgaagaatctttccctgaagttagatgacctcagcacgtgcaatgacctcatcgccaagcacggcgctgcactccagcgctccctgacagagctggacggcctcaagatcccatctgagagtggggagaagctgaaggtggtgaatgagcgggccaccctcttccgcatcacatccaatgctatgatcaacgcctgcagggacttcttggaactagcagagatacacagtcggaaatggcagcgggcactgcagtatgagcaggagcagcgcgtgcacttggaggaaaccattgagcagctggcgaagcagcacaacagcctcgagcgggccttccacagtgcccctggccggccggccaacccctccaagagcttcattgagggaagcctcttgactcccaaaggagaggacagtgaggaagatgaagataccgagtactttgatgccatggaagactccacatccttcatcaccgtgatcaccgaggccaaggaagacagaaaagctgaaggtagcaccgggacaagttccgtggactggagctcagcagacaatgtactagatggtgcctcgctcgtgcccaagggttcatccaaagtcaagaggcgagtccgcattcccaacaagcccaactacagccttaacctctggagcatcatgaagaactgcatcggccgggagctctccaggatccccatgccggtgaacttcaatgagcccctgtccatgctccagcggctgacagaggacctggagtaccaccacctgctggacaaggcagtgcactgcaccagctcagtggagcagatgtgcctggtggccgccttctctgtgtcctcctactccaccacagtgcaccgcatcgccaagcccttcaaccccatgctgggggagaccttcgagctggaccgcctcgacgacatgggcctgcgctccctctgtgagcaggtgagccaccaccccccctcagctgcgcactacgtgttctccaagcatggctggagcctctggcaggagatcaccatctccagcaagttccggggaaaatacatctccatcatgccgctaggtgccatccacttagaattccaggccagtgggaatcactacgtgtggaggaagagcacctcaactgttcacaacatcatcgtgggcaagctctggatcgaccagtcaggggacatcgagattgtgaaccataagaccaatgaccggtgccagctgaagttcctgccctacagctacttctccaaagaggcagcccggaaggtgacaggagtggtgagtgacagccagggcaaggcccattacgtgctgtccggctcgtgggatgaacaaatggagtgctccaaggtcatgcatagcagtcccagcagccccagctctgacgggaagcagaagacagtgtaccagaccctgtcagccaagctgctgtggaagaagtacccgctgccggagaacgcggagaacatgtactacttctcagagctggccctgaccctcaacgagcacgaggagggcgtagcgccaaccgacagccgcctgcggcccgaccagcggctgatggagaagggccgttgggacgaggccaataccgagaagcagcggctggaggagaagcagcgcctgtcgcggcgccggcggctggaggcctgcgggccgggcagcagctgcagctcggaggaagagaaggaggcggatgcctacacgccactgtggtttgagaagaggctggatccgctgaccggggagatggcctgtgtgtacaagggcggctactgggaggccaaggagaagcaagactggcatatgtgccccaacatcttctgagcgccacccttgcaacaaatacaggcgcctgcacagcctggcccacctgttcattaatgcactcaatttagtactgaatggtctttctcccagcccattcccagcccttcctatttcctttcctattttttttttctccccacactttcttgggactcccaccttggaaggaggaagggctgacctgggttctctccagcccccaggtgcgccgg

SEQ ID NO: 163120 - DNA, 559 bp, Homo sapiens
  Payload ID: 12146
  Gene Symbol: OSBP2
  Gene Name: oxysterol binding protein 2
  ENST ID: ENST00000445781
  CDS Start-End: 485-559
agagcaactagagcaggcagtagagtggggtgggcggggatgaggagggggttgggtggctggtggccctagaggctggccctaaagaatacctggacagcctgccaccctattgctccaaaatgaaaatcctctaacagggtcaactggtggcagggaacaaaaccccgctgagactggctgaaacacaagtggggcctgtgctcagggtgcaggaagtggagcatccaaggggagagatgactctggggacgacgacgaggctaccaccccagccgacaagagcgagctgcaccacaccctgaagaatctttccctgaagttagatgacctcagcacgtgcaatgacctcatcgccaagcacggcgctgcactccagcgctccctgacagagctggacggcctcaagatcccatctgagagtggggagaagctgaaggtggtgaatgagcgggccaccctcttccgcatcacatccaatgctatgatcaacgcctgcagggacttcttggaactagcagagatacacagtcggaaatggcagcgggcactgcagtat

SEQ ID NO: 163121 - DNA, 3050 bp, Homo sapiens
  Payload ID: 12146
  Gene Symbol: OSBP2
  Gene Name: oxysterol binding protein 2
  ENST ID: ENST00000431368
  CDS Start-End: 1-1766
agcattctgagaacagcagggccacgccaggcgcctgcctctccccacagcacagccaggatggggcctggagaaggccggcagcagcagaggagaccctgggagtcagggatggacaccaggcctgcagggacttcttggaactagcagagatacacagtcggaaatggcagcgggcactgcagtatgagcaggagcagcgcgtgcacttggaggaaaccattgagcagctggcgaagcagcacaacagcctcgagcgggccttccacagtgcccctggccggccggccaacccctccaagagcttcattgagggaagcctcttgactcccaaaggagaggacagtgaggaagatgaagataccgagtactttgatgccatggaagactccacatccttcatcaccgtgatcaccgaggccaaggaagacagcagaaaagctgaaggtagcaccgggacaagttccgtggactggagctcagcagacaatgtactagatggtgcctcgctcgtgcccaagggttcatccaaagtcaagaggcgagtccgcattcccaacaagcccaactacagccttaacctctggagcatcatgaagaactgcatcggccgggagctctccaggatccccatgccggtgaacttcaatgagcccctgtccatgctccagcggctgacagaggacctggagtaccaccacctgctggacaaggcagtgcactgcaccagctcagtggagcagatgtgcctggtggccgccttctctgtgtcctcctactccaccacagtgcaccgcatcgccaagcccttcaaccccatgctgggggagaccttcgagctggaccgcctcgacgacatgggcctgcgctccctctgtgagcaggtgagccaccaccccccctcagctgcgcactacgtgttctccaagcatggctggagcctctggcaggagatcaccatctccagcaagttccggggaaaatacatctccatcatgccgctaggtgccatccacttagaattccaggccagtgggaatcactacgtgtggaggaagagcacctcaactgttcacaacatcatcgtgggcaagctctggatcgaccagtcaggggacatcgagattgtgaaccataagaccaatgaccggtgccagctgaagttcctgccctacagctacttctccaaagaggcagcccggaaggtgacaggagtggtgagtgacagccagggcaaggcccattacgtgctgtccggctcgtgggatgaacaaatggagtgctccaaggtcatgcatagcagtcccagcagccccagctctgacgggaagcagaagacagtgtaccagaccctgtcagccaagctgctgtggaagaagtacccgctgccggagaacgcggagaacatgtactacttctcagagctggccctgaccctcaacgagcacgaggagggcgtagcgccaaccgacagccgcctgcggcccgaccagcggctgatggagaagggccgttgggacgaggccaataccgagaagcagcggctggaggagaagcagcgcctgtcgcggcgccggcggctggaggcctgcgggccgggcagcagctgcagctcggaggaagagaaggaggcggatgcctacacgccactgtggtttgagaagaggctggatccgctgaccggggagatggcctgtgtgtacaagggcggctactgggaggccaaggagaagcaagactggcatatgtgccccaacatcttctgagcgccacccttgcaacaaatacaggcgcctgcacagcctggcccacctgttcattaatgcactcaatttagtactgaatggtctttctcccagcccattcccagcccttcctatttcctttcctattttttttttctccccacactttcttgggactcccaccttggaaggaggaagggctgacctgggttctctccagcccccaggtgcgccgggtcacccgtgccccttcattatggacctgggccctaccggaacccctgccccagttaccacaactcaggccggctggcccgggccatgggctgcgcaaatcaccagcccccaacccagggaggaactggcccctcctagggagcctcttcgacttttttagaaaaatgatctccatttctttccagccatgatgtttagtaaatatttttagtaccgcacttagcagacagctttccaagtgtgctttcttgccacaaaagtgtcctggcaagagccccttatttttaagacatcaggaagccagaccgctttgagttgggagaattttgtagctcaacatatcaagtcctcgatggtatctgagctgcccacacccccacctgccaaggccccacagagcccaaaacagaagggggctgccccagcccagcagagcacagagtttctggagctcccatccacagatgcaggagggggtactgatggtaacccccatgtggatttgagggcagcagtccctggcctcaccctagccagcctgggtggctccctagccccaagaggccaggaagggctggaaggcagggcctgcaggtgctccccgccctgagacccaggccccaaatcagcaataatgaacaaacccttggcccagcctgggctggtgacctgggcaccagagaccttgcatccctcctcatcctaggaggcccctaggggtgccccatctcagtgtcccctgaactctttatttgcctaatttatatatatatatatgagatatataaatatatataaaatagctattttgcttaaatttctacagtatgtaaaagtgaaaaaatgatgaagacgggtgcacctgtctgagtttggccctcatgtgagctgtgcccttccctctcctcatgcccccttccagcggcttctgccaaccatggggggctggaccaccatggccactgacccagcccctcagaatcccacactccaatcctttccatttcagtttagtcctaaaagttcatcacagggtctttctttctactccaggactggttttgtttt

SEQ ID NO: 163122 - DNA, 3248 bp, Homo sapiens
  Payload ID: 12146
  Gene Symbol: OSBP2
  Gene Name: oxysterol binding protein 2
  Uniprot ID: Q969R2
  ENST ID: ENST00000535268
  CDS Start-End: 381-1763
agcattctgagaacagcagggccacgccaggcgcctgcctctccccacagcacagccaggatggggcctggagaaggccggcagcagcagaggagaccctgggagtcagggatggacaccaggcctgcagggacttcttggaactagcagagatacacagtcggaaatggcagcgggcactgcagtatgagcaggagcagcgcgtgcacttggaggaaaccattgagcagctggcgaagcagcacaacagcctcgagcgggccttccacagtgcccctggccggccggccaacccctccaagagcttcattgagggaagcctcttgactcccaaaggagaggacagtgaggaagatgaagataccgagtactttgatgccatggaagactccacatccttcatcaccgtgatcaccgaggccaaggaagacagaaaagctgaaggtagcaccgggacaagttccgtggactggagctcagcagacaatgtactagatggtgcctcgctcgtgcccaagggttcatccaaagtcaagaggcgagtccgcattcccaacaagcccaactacagccttaacctctggagcatcatgaagaactgcatcggccgggagctctccaggatccccatgccggtgaacttcaatgagcccctgtccatgctccagcggctgacagaggacctggagtaccaccacctgctggacaaggcagtgcactgcaccagctcagtggagcagatgtgcctggtggccgccttctctgtgtcctcctactccaccacagtgcaccgcatcgccaagcccttcaaccccatgctgggggagaccttcgagctggaccgcctcgacgacatgggcctgcgctccctctgtgagcaggtgagccaccaccccccctcagctgcgcactacgtgttctccaagcatggctggagcctctggcaggagatcaccatctccagcaagttccggggaaaatacatctccatcatgccgctaggtgccatccacttagaattccaggccagtgggaatcactacgtgtggaggaagagcacctcaactgttcacaacatcatcgtgggcaagctctggatcgaccagtcaggggacatcgagattgtgaaccataagaccaatgaccggtgccagctgaagttcctgccctacagctacttctccaaagaggcagcccggaaggtgacaggagtggtgagtgacagccagggcaaggcccattacgtgctgtccggctcgtgggatgaacaaatggagtgctccaaggtcatgcatagcagtcccagcagccccagctctgacgggaagcagaagacagtgtaccagaccctgtcagccaagctgctgtggaagaagtacccgctgccggagaacgcggagaacatgtactacttctcagagctggccctgaccctcaacgagcacgaggagggcgtagcgccaaccgacagccgcctgcggcccgaccagcggctgatggagaagggccgttgggacgaggccaataccgagaagcagcggctggaggagaagcagcgcctgtcgcggcgccggcggctggaggcctgcgggccgggcagcagctgcagctcggaggaagagaaggaggcggatgcctacacgccactgtggtttgagaagaggctggatccgctgaccggggagatggcctgtgtgtacaagggcggctactgggaggccaaggagaagcaagactggcatatgtgccccaacatcttctgagcgccacccttgcaacaaatacaggcgcctgcacagcctggcccacctgttcattaatgcactcaatttagtactgaatggtctttctcccagcccattcccagcccttcctatttcctttcctattttttttttctccccacactttcttgggactcccaccttggaaggaggaagggctgacctgggttctctccagcccccaggtgcgccgggtcacccgtgccccttcattatggacctgggccctaccggaacccctgccccagttaccacaactcaggccggctggcccgggccatgggctgcgcaaatcaccagcccccaacccagggaggaactggcccctcctagggagcctcttcgacttttttagaaaaatgatctccatttctttccagccatgatgtttagtaaatatttttagtaccgcacttagcagacagctttccaagtgtgctttcttgccacaaaagtgtcctggcaagagccccttatttttaagacatcaggaagccagaccgctttgagttgggagaattttgtagctcaacatatcaagtcctcgatggtatctgagctgcccacacccccacctgccaaggccccacagagcccaaaacagaagggggctgccccagcccagcagagcacagagtttctggagctcccatccacagatgcaggagggggtactgatggtaacccccatgtggatttgagggcagcagtccctggcctcaccctagccagcctgggtggctccctagccccaagaggccaggaagggctggaaggcagggcctgcaggtgctccccgccctgagacccaggccccaaatcagcaataatgaacaaacccttggcccagcctgggctggtgacctgggcaccagagaccttgcatccctcctcatcctaggaggcccctaggggtgccccatctcagtgtcccctgaactctttatttgcctaatttatatatatatatatgagatatataaatatatataaaatagctattttgcttaaatttctacagtatgtaaaagtgaaaaaatgatgaagacgggtgcacctgtctgagtttggccctcatgtgagctgtgcccttccctctcctcatgcccccttccagcggcttctgccaaccatggggggctggaccaccatggccactgacccagcccctcagaatcccacactccaatcctttccatttcagtttagtcctaaaagttcatcacagggtctttctttctactccaggactggttttgtttttatatatataaaaaaaaaaagtgaaaacaccaatgtgtgaaatgccttacaatgcccactggagaggcggggcggggtggggcaggatggccccactggggctcctacagagctgtggaatgtacctctccccaacactgttttgttagcgagcaccttttgaccagtaataaaaaaccttggctttggagttttccactg

SEQ ID NO: 163123 - DNA, 6600 bp, Homo sapiens
  Payload ID: 12147
  Gene Symbol: OSBPL10
  Gene Name: oxysterol binding protein-like 10
  Uniprot ID: Q9BXB5
  ENST ID: ENST00000396556
  CDS Start-End: 124-2418
catttcccggggatttggagcaggcacgcgcggcccgggcgtccggagctgtagcagcagcagcagccgccgtgccggggccgccaccgcggcgggcacccgcgtcccgggcgcccacggaccatggagagggcagtccagggcacagacggcggcgggggtagcaacagcagcagccgcagcagcagccgtgctacctcggcgggctcctcgccctcctgctctctggcgggccggggggtctccagccggtcggcggcggccgggctcggcggcgggggaagccgcagcagcccgggctctgtggccgctagcccgtccgggggaggcggccgcaggagggagccggcgctcgagggcgtgctcagcaaatacaccaacctcctccagggctggcagaacaggtacttcgtactggatttcgaggctggcatcctgcagtattttgtgaatgagcaaagcaaacaccagaagcctcgaggagtcctgtctttatctggagccatagtgtccctgagcgatgaagctccccacatgctggtggtgtactctgctaatggagagatgtttaaactgagagctgctgatgcaaaagagaaacaattctgggtgactcagcttcgagcttgtgccaaataccacatggaaatgaattctaagagtgctccaagctcccgaagccgaagtctcactttgctcccacatggaacacccaattctgcgtctccctgtagccagagacacctcagtgtgggggcccccggtgttgtcacaatcacgcatcacaagtcgcctgcagccgcccgaagagccaagagtcagtattccggccagcttcacgaagtcagagagatgatgaaccaggtggaagggcagcagaagaaccttgtgcacgccattgagtccctgccagggtccggccccctcactgccttggaccaggacctgctgctcctgaaagctacctctgctgccaccctcagctgccttggggagtgcctcaacttgttacagcagagtgtgcaccaggcgggccagcccagccagaagccaggagcctcggaaaacatcctgggatggcacgggtccaagtcacattccacagagcagctgaaaaatgggacacttggctctttgccatcagccagtgccaacataacctgggcaattttaccaaactctgctgaagacgaacaaacctcacagccagagccagagccaaactcaggctctgaattggttttgtctgaagatgaaaaaagtgacaatgaagataaggaagagacggaattgggcgtcatggaggatcagcgtagtataattcttcatctcatttcacaactcaaacttggaatggatttgaccaaggtggtgcttcccacctttatcctggagaagcgatctttgctggagatgtatgcagatttcatggcgcacccagacctactgctggccatcaccgctggggccacaccagaggagagagtcatttgcttcgttgagtattatctcacagcctttcacgagggccgcaagggcgctttagccaagaagccctacaaccccatcataggcgagacatttcactgctcctgggaagttcccaaggacagggtcaagcctaagaggactgcttcccgctctcctgccagctgtcacgaacacccaatggccgatgacccttccaaaagctacaaactaaggtttgtggctgagcaagtgtcccatcacccacccatctcctgcttctactgtgagtgcgaggagaagagactgtgcgtcaacactcatgtatggaccaaaagcaagttcatgggcatgtccgtgggggtctctatgataggggaaggtgtgttgaggctcctggaacacggggaggagtacgtattcaccctgcctagtgcctacgcccggtccattctcaccatcccgtgggtggagctcggaggaaaagtcagcatcaactgtgccaagactgggtactcagcgacagtgatattccacacgaagcctttctatggagggaaagtccacagggttaccgcagaagtgaagcacaacccaaccaacaccattgtttgtaaagcccatggggaatggaatggtactttagagttcacctacaacaatggagaaaccaaagtcatcgacacaaccacactgccagtgtatcccaagaagatcagacctcttgagaagcagggacccatggagtccaggaacctctggcgggaggtgacccgatacctgcggctgggggacattgacgcagccaccgagcagaagcggcacctggaggagaagcaacgggtggaggaacggaagcgcgagaacctccgcacaccatggaagcccaaatattttatccaggagggcgatggctgggtatacttcaatcccctctggaaagcacactgatggggtggaggtgcagagctttccagtatagccctgtttttgtaggaatattaaagtagtagagtatcagggttttgttggcattcactgagaccttgtattagcatccaagaaatgatgagagagagagaaattatatactatgaaaagtgcacccccacactctgctagaggaatgaatttattcaagagccattcggggcacgtgtgtgtacacaccgtatacgttcacacacatgcactatgtaaacatctgagtatgattacacatttaaatactgcactcaccaaggttaaagtgggtaatcataagctcctttttatcaatgaagtttgaagtttttctatttttcactttgccaaaaatgttttacactcacaaagatattctcacttagtcaactcctgtcaaaatgaaggtgaactggcatggcccgatcactgtccataagggagaaagtggctcattcctggtagaagtatgggtggttatcatttcaaaattattgtgattctcacctccctccccacctcagtgttttgtctgtccgcgcccaagaaagataagcaagtatttcctgctggatgggggttggcaggaagctgttaaagatttatgccagagccttgcaggatggagcacctctgggacaactaagagccaaggcccaccaaggagttttccacccgtctctcatggtcacagcgctagtcattcatttttgagaagttgcttcttttacatcagaaaaccagtcaatcatatggagacttcttttgtgatgaaaaagggctttagaagttaaatacatgcatgcacatgaaaacatgcacaaccacagcctcaatcttgtatttagtttggggaaagagaagagaatttcctgtggattattttttcctcaagtgcacctctctggttaacccaaactctgcaagaaagcactgtgactaaaacatacataacgcctgcataaatattccatggtttcagttaaatttcagtttttagcctttacacatgaggtcaaaggagtgacgaaaatacaaagcaaggaaaaaatgaaatatctggtttttgctgaatgcttaatttattttttactgtgccactccaatatttatcaaatccaaatagcatgaatgcttctctgtagtaatactaattttgtgccttttgtctgctttcttaagaccagttgttcacactttgtagatattagacaaatatatttcgattgaatacatatctgtgtctgtgttttattttcagggattcaacagttctattaaattggtggctctaagtgagctcaacttttcctggttaaatatttctagttattgatatgaagagcaatcatatctatatggaaaaagtatttaacacatttaaaaatgtaccagataaacatttatgaatattttctggtaagtccataagaacatttaactcctacccagtgagtgttgtttcacgagaagagtcactgccagaagtcacaatagaagcctacttaggtccacagtctttaaagcatctgggtgaatcaagtatctggaaccatcttatttctgacagagaaagtggaacaaatgctattttgagaaaaagaagaaaactcaactcaatgagactgaaaagtaatcactgtgttgttggattttccagtctgactacaaagcataaaccatctgggaagtaaaacatggagagggctcacttttcttttgaggccaggggtacatttaaaattgtgaaatgttatgtgtcaggagatttacataaaacatatgtactccaggaataattataaatacccttgtagccactgcttaagcaaagaaacctgtttaccagtaccttaaaagccactattgtgcccctatacaattgtatccctctccatgccttcctggaataaccatccccttatgggttttttgttgttcttttagactatacacactatgtgtgtatttctaaacagtgtgattggttttacccatttttgtaaaaattgaatcataccctagtttgcctatttgagccaatattttctttctagttcaatccttgttgctctatttgttcattttcttgctgagttcatattatgttttattgtggtaaaatatatgtaacaaaatctaccattttaactattttttttttcccagatggagtctcactctgtcacccaggctggagtgcaatggcgcgcaatctctgctcactgcaacctctgccttccgggttcaagcgattctcctgcttcagcctcccgagtagctgggattacaggcgtgtgccaccatgcccagctaatttttgtatttttagtagagatggggtttcaccatgttggccaggctggtctcaaactcctgacctcaggtgattcacccacctgagcctcccaaagtgctgggattacaggtgtgagccactgtgcccagcctggcattttaaaaatatactgagaagtggaattgctatatcatatgaaaattctggtttaagttttaaggaattgccacacagtttctcacaagagctggctgccacattttgcaatgccactagcaatgcacaagggatccaatttctccacatcctcaccaatacctattattttgtttttacttttgttgtttctttaaccccatcctaatggctatgaagtgccatctcaatgtggttttgatttatatttccctaatgattagtgatgttgagcatgtgtttttgtggttttggccatttgtaaatctttggagaaatgtttattcaaatccttttgcccattttaaaattaggttctttttgttgagttttaggagtcctttatgggtattaatcctttctggatattaatcctttatcagatatgatgtgcaaatattttcttctgactctttggttgcctcttcactgttaatggtgtcctctgatgtacaaaagtatttaattttgataatgtctaatttatttttctttgtacttgtgcttttgatgtcatatccaagaaatcattgacaaatacaatgctgtgaagtttttgtcctatgatttcttctaagagttttatagttttaggtcttactggggggtagggggtactttgatccattttgagttggtttttatatatggtgttagataagggtccaacttcattcttttgcatgtggatatccagtttccccaacaccatttgttgaaaagactctgcattccccattgagtgatcttggtaccttgttgaaaatcactggctatatacacgaatgtttatttatggcctattcttttccaatggtcgatgtcagtctttatgccagtaccacactcttttagttactgtagctttgtagcaagttacaagattaggaagtatgagacctccaacttttttattcttttttcaatattgtttcgtctgtacagggtcatttaagattccatgtgaattttaggatgaaattttctatttttgcaaaaaactctgggattttgatagggattgcattgaatctgtagatccctttgagtagcattgtcttaacagtaagtcttccaatctgttaaccagaatatctttccatttatttatctgtcttaatttctttcagcatgttttgtagttttcactgggcaagtcttcctcagttaagtttaattcttaagtattttactctttttggtactactgtaagtagatctttctcagtttcctttttggattgttcaatgttggcatataaaagtgtaagtgccaggcacagtgtcacatgcctatagttccagctactcaggaggctgagacaggaggattgcttgggcccaggagtttgagatttcagcatgctatgattgctcctgtgaatagccactgcactccagcctgggcaacataacaagacctcatttcgtaaaaaacacataatactgatttttgtgcattggttttgtatcctttgctgaatttgtttattctaacagttttttggggggtgtgtgggatctaggattttctagatacaatcatgtcatttgctaacagattttacttcttccaaatttggatgtcttttatttcttgttcttgcctaattgctgtacctagaacttcaaatactgtgttgaaggaaggaggcaaaaaaaaaaaaaaaaaaaaa

SEQ ID NO: 163124 - DNA, 519 bp, Homo sapiens
  Payload ID: 12147
  Gene Symbol: OSBPL10
  Gene Name: oxysterol binding protein-like 10
  ENST ID: ENST00000428241
  CDS Start-End: 1-519
aagtcgcctgcagccgcccgaagagccaagagtcagtattccggccagcttcacgaagtcagagaggtgaaggcttgtatgctcaacaacatgtgtgaggtcacacagagagtcattggcatcgtcaagactcaaacccagttgatctttctgatgatgaaccaggtggaagggcagcagaagaaccttgtgcacgccattgagtccctgccagggtccggccccctcactgccttggaccaggacctgctgctcctgaaagctacctctgctgccaccctcagctgccttggggagtgcctcaacttgttacagcagagtgtgcaccaggcgggccagcccagccagaagccaggagcctcggaaaacatcctgggatggcacgggtccaagtcacattccacagagcagctgaaaaatgggacacttggctctttgccatcagccagtgccaacataacctgggcaattttaccaaactctgctgaagacgaacaaacctcacagccagagccagag

SEQ ID NO: 163125 - DNA, 2624 bp, Homo sapiens
  Payload ID: 12147
  Gene Symbol: OSBPL10
  Gene Name: oxysterol binding protein-like 10
  Uniprot ID: Q9BXB5
  ENST ID: ENST00000438237
  CDS Start-End: 122-2224
tttcccggggatttggagcaggcacgcgcggcccgggcgtccggagctgtagcagcagcagcagccgccgtgccggggccgccaccgcggcgggcacccgcgtcccgggcgcccacggaccatggagagggcagtccagggcacagacggcggcgggggtagcaacagcagcagccgcagcagcagccgtgctacctcggcgggctcctcgccctcctgctctctggcgggccggggggtctccagccggtcggcggcggccgggctcggcggcgggggaagccgcagcagcccgggctctgtggccgctagcccgtccgggggaggcggccgcaggagggagccggcgctcgagggcgtgctcagcaaatacaccaacctcctccagggctggcagaacaggtacttcgtactggatttcgaggctggcatcctgcagtattttgtgaatgagcaaagcaaacaccagaagcctcgaggagtcctgtctttatctggagccatagtgtccctgagcgatgaagctccccacatgctggtggtgtactctgctaatggagagatgtttaaactgagagctgctgatgcaaaagagaaacaattctgggtgactcagcttcgagcttgtgccaaataccacatggaaatgaattctaagatgatgaaccaggtggaagggcagcagaagaaccttgtgcacgccattgagtccctgccagggtccggccccctcactgccttggaccaggacctgctgctcctgaaagctacctctgctgccaccctcagctgccttggggagtgcctcaacttgttacagcagagtgtgcaccaggcgggccagcccagccagaagccaggagcctcggaaaacatcctgggatggcacgggtccaagtcacattccacagagcagctgaaaaatgggacacttggctctttgccatcagccagtgccaacataacctgggcaattttaccaaactctgctgaagacgaacaaacctcacagccagagccagagccaaactcaggctctgaattggttttgtctgaagatgaaaaaagtgacaatgaagataaggaagagacggaattgggcgtcatggaggatcagcgtagtataattcttcatctcatttcacaactcaaacttggaatggatttgaccaaggtggtgcttcccacctttatcctggagaagcgatctttgctggagatgtatgcagatttcatggcgcacccagacctactgctggccatcaccgctggggccacaccagaggagagagtcatttgcttcgttgagtattatctcacagcctttcacgagggccgcaagggcgctttagccaagaagccctacaaccccatcataggcgagacatttcactgctcctgggaagttcccaaggacagggtcaagcctaagaggactgcttcccgctctcctgccagctgtcacgaacacccaatggccgatgacccttccaaaagctacaaactaaggtttgtggctgagcaagtgtcccatcacccacccatctcctgcttctactgtgagtgcgaggagaagagactgtgcgtcaacactcatgtatggaccaaaagcaagttcatgggcatgtccgtgggggtctctatgataggggaaggtgtgttgaggctcctggaacacggggaggagtacgtattcaccctgcctagtgcctacgcccggtccattctcaccatcccgtgggtggagctcggaggaaaagtcagcatcaactgtgccaagactgggtactcagcgacagtgatattccacacgaagcctttctatggagggaaagtccacagggttaccgcagaagtgaagcacaacccaaccaacaccattgtttgtaaagcccatggggaatggaatggtactttagagttcacctacaacaatggagaaaccaaagtcatcgacacaaccacactgccagtgtatcccaagaagatcagacctcttgagaagcagggacccatggagtccaggaacctctggcgggaggtgacccgatacctgcggctgggggacattgacgcagccaccgagcagaagcggcacctggaggagaagcaacgggtggaggaacggaagcgcgagaacctccgcacaccatggaagcccaaatattttatccaggagggcgatggctgggtatacttcaatcccctctggaaagcacactgatggggtggaggtgcagagctttccagtatagccctgtttttgtaggaatattaaagtagtagagtatcagggttttgttggcattcactgagaccttgtattagcatccaagaaatgatgagagagagagaaattatatactatgaaaagtgcacccccacactctgctagaggaatgaatttattcaagagccattcggggcacgtgtgtgtacacaccgtatacgttcacacacatgcactatgtaaacatctgagtatgattacacatttaaatactgcactcaccaaggttaaagtgggtaatcataagctcctttttatcaatgaagtttgaagtttttctatttttcactttgccaaaaatgttttacactcacaaagatattctcacttagtc

SEQ ID NO: 163126 - DNA, 7723 bp, Homo sapiens
  Payload ID: 12147
  Gene Symbol: OSBPL10
  Gene Name: oxysterol binding protein-like 10
  ENST ID: ENST00000429492
  CDS Start-End: 1-1616
gtcagtattccggccagcttcacgaagtcagagagatgatgaaccaggtggaagggcagcagaagaaccttgtgcacgccattgagtccctgccagggtccggccccctcactgccttggaccaggacctgctgctcctgaaagctacctctgctgccaccctcagctgccttggggagtgcctcaacttgttacagcagagtgtgcaccaggcgggccagcccagccagaagccaggagcctcggaaaacatcctgggatggcacgggtccaagtcacattccacagagcagctgaaaaatgggacacttggctctttgccatcagccagtgccaacataacctgggcaattttaccaaactctgctgaagacgaacaaacctcacagccagagccagagccaaactcaggctctgaattggttttgtctgaagatgaaaaaagtgacaatgaagataaggaagagacggaattgggcgtcatggaggatcagcgtagtataattcttcatctcatttcacaactcaaacttggaatggatttgaccaaggtggtgcttcccacctttatcctggagaagcgatctttgctggagatgtatgcagatttcatggcgcacccagacctactgctggccatcaccgctggggccacaccagaggagagagtcatttgcttcgttgagtattatctcacagcctttcacgagggccgcaagggcgctttagccaagaagccctacaaccccatcataggcgagacatttcactgctcctgggaagttcccaaggacagggtcaagcctaagaggactgcttcccgctctcctgccagctgtcacgaacacccaatggccgatgacccttccaaaagctacaaactaaggtttgtggctgagcaagtgtcccatcacccacccatctcctgcttctactgtgagtgcgaggagaagagactgtgcgtcaacactcatgtatggaccaaaagcaagttcatgggcatgtccgtgggggtctctatgataggggaaggtgtgttgaggctcctggaacacggggaggagtacgtattcaccctgcctagtgcctacgcccggtccattctcaccatcccgtgggtggagctcggaggaaaagtcagcatcaactgtgccaagactgggtactcagcgacagtgatattccacacgaagcctttctatggagggaaagtccacagggttaccgcagaagtgaagcacaacccaaccaacaccattgtttgtaaagcccatggggaatggaatggtactttagagttcacctacaacaatggagaaaccaaagtcatcgacacaaccacactgccagtgtatcccaagaagatcagacctcttgagaagcagggacccatggagtccaggaacctctggcgggaggtgacccgatacctgcggctgggggacattgacgcagccaccgagcagaagcggcacctggaggagaagcaacgggtggaggaacggaagcgcgagaacctccgcacaccatggaagcccaaatattttatccaggaggtaactctgccgcctgtcattggtcccttgcccaggagagaacttgtcctgagagggtagatgggtttttcttgctgagcccccaagactggataaataccaggcaggggaagggatggactagggcagctcggttctgactccagctttggacaaggcttcaggacaggttttctgccacaatattcatgaaaccttctggagggcagaactgagcaactgacacttcccctccagtatccctatgtcagaaaagcatgtcagcctgcctgtgagggatcgcgatgggactgcagactggatactgttctatttttaaaaagaaaatcatcatggcacctgttagatcatctttagtaacaaattagttgaggagtgcctcacaggccatctcaacacctgggtgggctggagccctcactgatgaagaattgcctttcagagctttgcctcctgtgggccacaagggctagtcatgcaggggaaggccagcctgagtcctgtgcctaaaatgctgttgctgtcacctgcaaatgtgacactagaagctagaaataatatctgggcaagtgggcagggcactgtgtgcccagctgaagcccttatgctcttgaagttgtggagggattgggaagcactctgagaacagaattggaaattatgaaaatgtaggagccacacgtcttaaagcaggcccacaggaacccagcaacatcaatgaagagcaggccggtgagggctggggcagatgccactcatcttccagtgataaaacagattgtctagttgttcatgaggagccagaaatctaaatttttatgagaaatctcatatttgcatggtcaaagatttaaaaaaatttaaataccagtaggcaatcaaaatgtatctgtgggctttccttagcccaggtgctggtaacccctgacttctgctacaaagagggattattctgtctatatacgaggctgagaagtgagttagggcaacatagtaggtaactggggtggattcatggttaagagcaggaagagcaggaagccaccactgttctccccagagtcaggctgtggactgaaggagatttcaaggttggattctggttcagacaggaaagctgcctggagaagactttgcctttatgggtcactgagtggggaccctgtgtgggagccctgcccaggtgaggtaaaaccttgaaagatccttctgtgaggttagctcccttttctcttgagggagctagtagcttgagagagctagtttgtctggcttctgtggaaggctgtgcattaaacagcaacaacaacaagaaaaaacatttacagttcttcctgagtttaagaaaagccagtatgcccataacagaagggctgggaacatgtaaggaataagagtcatctgaacaccagcacagttattcagtatagtgccttctagtcataactagatggtattaataccattttaattcttgcctttttctcacttgatatttgattgatggtgtttcttgtgtgtgctgatttgtttgtgactactgcctgctggagagagcctttgttgggtgttcccctgtgggctggaagtcactggtatgcacacccttgccttttctttcccctggccattcatctagctactctccttttctcttgtcccactgtcaaagtgcttcttttttttggccaagtaatcagtctcgatggaagccaaccaagctccccttttattttgctcatttcttggggtttcctcctgccatgccagggtaggaaggtcaaggtcatctagatctccaaagagcagctgggctgaggaggggtactgaggccagcagcctggcctgcgtgtgaggtattaagacacggcagacacacagagtggctgcggttatccttgcttccccttttccctgttgagaggtctccatgtaataatgcctcctttcttctcttgcagggcgatggctgggtatacttcaatcccctctggaaagcacactgatggggtggaggtgcagagctttccagtatagccctgtttttgtaggaatattaaagtagtagagtatcagggttttgttggcattcactgagaccttgtattagcatccaagaaatgatgagagagagagaaattatatactatgaaaagtgcacccccacactctgctagaggaatgaatttattcaagagccattcggggcacgtgtgtgtacacaccgtatacgttcacacacatgcactatgtaaacatctgagtatgattacacatttaaatactgcactcaccaaggttaaagtgggtaatcataagctcctttttatcaatgaagtttgaagtttttctatttttcactttgccaaaaatgttttacactcacaaagatattctcacttagtcaactcctgtcaaaatgaaggtgaactggcatggcccgatcactgtccataagggagaaagtggctcattcctggtagaagtatgggtggttatcatttcaaaattattgtgattctcacctccctccccacctcagtgttttgtctgtccgcgcccaagaaagataagcaagtatttcctgctggatgggggttggcaggaagctgttaaagatttatgccagagccttgcaggatggagcacctctgggacaactaagagccaaggcccaccaaggagttttccacccgtctctcatggtcacagcgctagtcattcatttttgagaagttgcttcttttacatcagaaaaccagtcaatcatatggagacttcttttgtgatgaaaaagggctttagaagttaaatacatgcatgcacatgaaaacatgcacaaccacagcctcaatcttgtatttagtttggggaaagagaagagaatttcctgtggattattttttcctcaagtgcacctctctggttaacccaaactctgcaagaaagcactgtgactaaaacatacataacgcctgcataaatattccatggtttcagttaaatttcagtttttagcctttacacatgaggtcaaaggagtgacgaaaatacaaagcaaggaaaaaatgaaatatctggtttttgctgaatgcttaatttattttttactgtgccactccaatatttatcaaatccaaatagcatgaatgcttctctgtagtaatactaattttgtgccttttgtctgctttcttaagaccagttgttcacactttgtagatattagacaaatatatttcgattgaatacatatctgtgtctgtgttttattttcagggattcaacagttctattaaattggtggctctaagtgagctcaacttttcctggttaaatatttctagttattgatatgaagagcaatcatatctatatggaaaaagtatttaacacatttaaaaatgtaccagataaacatttatgaatattttctggtaagtccataagaacatttaactcctacccagtgagtgttgtttcacgagaagagtcactgccagaagtcacaatagaagcctacttaggtccacagtctttaaagcatctgggtgaatcaagtatctggaaccatcttatttctgacagagaaagtggaacaaatgctattttgagaaaaagaagaaaactcaactcaatgagactgaaaagtaatcactgtgttgttggattttccagtctgactacaaagcataaaccatctgggaagtaaaacatggagagggctcacttttcttttgaggccaggggtacatttaaaattgtgaaatgttatgtgtcaggagatttacataaaacatatgtactccaggaataattataaatacccttgtagccactgcttaagcaaagaaacctgtttaccagtaccttaaaagccactattgtgcccctatacaattgtatccctctccatgccttcctggaataaccatccccttatgggttttttgttgttcttttagactatacacactatgtgtgtatttctaaacagtgtgattggttttacccatttttgtaaaaattgaatcataccctagtttgcctatttgagccaatattttctttctagttcaatccttgttgctctatttgttcattttcttgctgagttcatattatgttttattgtggtaaaatatatgtaacaaaatctaccattttaactattttttttttcccagatggagtctcactctgtcacccaggctggagtgcaatggcgcgcaatctctgctcactgcaacctctgccttccgggttcaagcgattctcctgcttcagcctcccgagtagctgggattacaggcgtgtgccaccatgcccagctaatttttgtatttttagtagagatggggtttcaccatgttggccaggctggtctcaaactcctgacctcaggtgattcacccacctgagcctcccaaagtgctgggattacaggtgtgagccactgtgcccagcctggcattttaaaaatatactgagaagtggaattgctatatcatatgaaaattctggtttaagttttaaggaattgccacacagtttctcacaagagctggctgccacattttgcaatgccactagcaatgcacaagggatccaatttctccacatcctcaccaatacctattattttgtttttacttttgttgtttctttaaccccatcctaatggctatgaagtgccatctcaatgtggttttgatttatatttccctaatgattagtgatgttgagcatgtgtttttgtggttttggccatttgtaaatctttggagaaatgtttattcaaatccttttgcccattttaaaattaggttctttttgttgagttttaggagtcctttatgggtattaatcctttctggatattaatcctttatcagatatgatgtgcaaatattttcttctgactctttggttgcctcttcactgttaatggtgtcctctgatgtacaaaagtatttaattttgataatgtctaatttatttttctttgtacttgtgcttttgatgtcatatccaagaaatcattgacaaatacaatgctgtgaagtttttgtcctatgatttcttctaagagttttatagttttaggtcttactggggggtagggggtactttgatccattttgagttggtttttatatatggtgttagataagggtccaacttcattcttttgcatgtggatatccagtttccccaacaccatttgttgaaaagactctgcattccccattgagtgatcttggtaccttgttgaaaatcactggctatatacacgaatgtttatttatggcctattcttttccaatggtcgatgtcagtctttatgccagtaccacactcttttagttactgtagctttgtagcaagttacaagattaggaagtatgagacctccaacttttttattcttttttcaatattgtttcgtctgtacagggtcatttaagattccatgtgaattttaggatgaaattttctatttttgcaaaaaactctgggattttgatagggattgcattgaatctgtagatccctttgagtagcattgtcttaacagtaagtcttccaatctgttaaccagaatatctttccatttatttatctgtcttaatttctttcagcatgttttgtagttttcactgggcaagtcttcctcagttaagtttaattcttaagtattttactctttttggtactactgtaagtagatctttctcagtttcctttttggattgttcaatgttggcatataaaagtgtaagtgccaggcacagtgtcacatgcctatagttccagctactcaggaggctgagacaggaggattgcttgggcccaggagtttgagatttcagcatgctatgattgctcctgtgaatagccactgcactccagcctgggcaacataacaagacctcatttcgtaaaaaacacataatactgatttttgtgcattggttttgtatcctttgctgaatttgtttattctaacagttttttggggggtgtgtgggatctaggattttctagatacaatcatgtcatttgctaacagattttacttcttccaaatttggatgtcttttatttcttgttcttgcctaattgctgtacctagaacttcaaatactgtgttgaaggaaggagg

SEQ ID NO: 163127 - DNA, 4191 bp, Homo sapiens
  Payload ID: 12148
  Gene Symbol: OSBPL11
  Gene Name: oxysterol binding protein-like 11
  Uniprot ID: Q9BXB4
  ENST ID: ENST00000296220
  CDS Start-End: 291-2534
cacttaagtcttctcgccggatgctttttcctccttgcttttgccggaaaggagagagatacatgtgaaggatatctgtcctcgttgcttcccctgccctctcaaaagtttaacttctgtgggaatgtgtatcttccttttctggaccatttgacagtcccgccccagccgccgtgtgatttagcaaccggtatcatattcagatcaaatcttaaaaaaaaaaagtcacctacagaactacagaattgttctctcccgctcaagaagggcaagtggactttggcgttaagatgcaggggggtgaaccagtgtccacaatgaaagtctcggagagcgaaggaaagctggagggccaggccacagcggtgaccccgaacaagaacagcagctgtggaggtggaatcagtagcagcagcagcagccgcggtggcagtgcaaaaggctggcagtacagtgatcacatggaaaatgtgtatggctatttaatgaagtataccaaccttgtcactgggtggcagtacaggttttttgttttaaacaatgaagctgggctgttggagtactttgtgaatgaacagtctagaaatcagaaacctagaggaactttgcagcttgcaggagctgtaatatcacccagtgatgaggattctcacaccttcactgtaaacgctgccagtggggaacaatataaactcagagctacagatgcaaaagagcgacagcactgggttagcagacttcagatatgtacacagcatcatactgaagctattggaaagaataatcctcctctgaagtcacggagcttctcacttgcatctagtagtaattctcctatatcgcagaggagaccaagtcaaaatgccatttctttttttaatgttggacattccaaactgcaatcactgagcaaaagaactaatttacctccagaccatcttgtggaagtcagagaaatgatgtctcatgctgaaggacaacaaagagacttaattagacgaattgaatgccttcctacttctggccatcttagttccttggaccaggatctcttaatgctcaaagctacttccatggcaactatgaactgcttaaatgactgctttcatattctccagttacagcatgcatcacatcagaagggctcattgccttcaggaacgacaatcgagtggttagaaccaaagatatctttatcaaaccactataaaaatggagctgaccagccctttgcaactgatcagagtaagccggtggcagtcccagaagagcagcctgttgcagaatctggactattagcgagggagcctgaagaaataaatgcagatgatgagatagaggatacatgtgaccacaaagaggatgacctgggagctgtagaagaacaacgtagtgtcatcctacatctcttgtcacagcttaagctgggcatggatttaacaagagtggtgcttcctacatttatcctagagaagcgttccttgctggaaatgtatgcagactttatgtctcatccagacctatttatagccatcactaatggagccacagctgaggacagaatgattcgctttgttgagtactaccttacctcatttcatgaaggccgtaagggagccattgctaaaaaaccatacaatcctatcattggagaaacatttcactgttcctggaagatgccaaaaagcgaggtagcatccagtgtttttagcagttcttccacccagggagtcacaaatcatgctcctttatcgggggagtctttgacccaggtgggatcagactgttacacagtcagatttgttgctgagcaggtttctcatcatcctccagtctcaggattttatgcagaatgtacagagaggaagatgtgtgtaaatgcgcatgtctggactaagagcaagttcttaggcatgtcaataggcgtgacaatggttggagaaggtatccttagtctgttggagcatggagaagagtacacattttctctaccctgtgcatatgctcggtcaattttgactgttccttgggtagaactgggtggcaaagtcagtgtcaactgtgcaaaaactggatattcagccagcatcacttttcataccaagccattttatggtggcaaactgcatcgggttacagctgaagtaaagcacaacatcaccaacactgtggtatgcagagtgcaaggggaatggaatagtgttcttgagttcacatatagcaatggagagacaaagtatgtggacttgactaaattggcagtgacgaagaaaagagtgagacctctggagaagcaggatccatttgaatccaggcgattgtggaaaaatgtgacagactcgctgagagaatctgaaattgataaggccacagagcataagcataccctggaagaacgtcagaggactgaagaaaggcatcgtactgaaacaggcacaccttggaaaaccaaatattttattaaagagggagatggctgggtttatcataaaccactttggaaaataattccaacaacacaaccagcagagtgacacatactatctaaaactcgaccaaatgaggttcttctctgtttaccctaaatcctcccagaatggagtcattgcactgagtgacctgcttcctgattgcgcagactgaaactagctaaacctgaatgtacctactagggcaccataatactgcagcaagaccaaagtggtaaagaaacacagtggaccttttaccaacctgttcatgtgatgtgagcaataccatcttaaaacttgttacctgaatcagtagatgaatcttttatccagttcttgctcctaaagttaagtttgaatcccctatttttgcacaggggcagcagatacacacaacaatgagaactcagtgactttgatttctttgtagtgaaaagtgaagtctccgtttcagagtttgtgtctttctttctgtccataactgaagtattcactactcttgtaaaccaaccaagaggaggagaaagatgacccagaagtggattcagccattgtgcctgaaatcagtgtttaaaaaaaaaaatcaaccaggttgtggtaacaaggcattctatttcttcaaaaagactgtatgcctgtgtctgaggaacttacctattatccacctctgttggaactctcttttaaaaagtacatttatagattgatcagaattataaccatggagaattttttcttctgagcattttaatatacttgaaaacaacattgacttgaaaaatttcagaacatttttcagtacctagttttattaaatattacacttgagagacactttttaaaaatgtgttaatgtcaatatgatgagattttagcctttctccagaactaaggcattaaagaaaatagcaaatattaaaaaataaaactgttacttttttccttctttcttttcacctttaggttaatatccagtattatgtgttatccctttggataagtatgctttattttacctctgttaaaaattaaaataaatgattctattcatatttgtcagtaattcaaaacttatatgtgtaactgaacgcgcatgtaaggtatggttttatttattttttttttttttgaggaaatttaaatgctaaagaaacaacgaaatgaaaaggtatcaggaaaaaaagatcaggaagttgtattcaggtacaaatctttttttaaataagtattttgttgaggttgaagaattgctggcaattaaaagaatagagctaattatggctttcatcattcattcatgtatttattgagcacctacttattatggtgctcaacacttgttactgcaagctaccttaatttcccaagagtggtgccttactctgttttttctgatatggtcttccaatcagtgtgtgtaacatacctgttgtttatcagccattgtaggtggctgtgtctgttgcatcatcataagaagtttaagctttgtgctctgataaattgtgttctgttaaagaggttagtaggatgaaaacagcaaaacaataattttttcaacaaattgtaaattataagaaaaagagttggtttgtgtacaacaattttaatgattcccttgttcatttttgctgtgaaatgcactgaaaaaaatcctcaaaatgagttatagttcctgtgttgggaaaattgacaaataataaaactagagaacaaacaa

SEQ ID NO: 163128 - DNA, 4195 bp, Homo sapiens
  Payload ID: 12149
  Gene Symbol: OSBPL1A
  Gene Name: oxysterol binding protein-like 1A
  Uniprot ID: Q9BXW6
  ENST ID: ENST00000319481
  CDS Start-End: 208-3060
ctgcggggaggggcggcgccacctcgcgctccgccgtggtcccggcgccgggtcccggagacagacgttacgcgggctcgagcgtcctcggggagtgccagccagagttggtgacgaccacttcctcgacgtggggcgggcggacgggaagcctggggtcgtggccaccgcctcgggagctctgggagcccgggtgaccgcgtagaaatgaacacagaagcggagcaacagcttctccatcacgccagaaatggcaatgctgaagaagtaagacaactattagagaccatggcgaggaatgaagtgattgctgacattaattgcaaaggaagaagtaagtctaacttgggctggacacctctacatctggcatgctattttggacacagacaagtggtccaggatctgttgaaggctggtgcagaagtgaatgtgttgaatgacatgggagacacgccgcttcatcgagctgcctttacaggacgaaaggagttggtaatgcttctcttagaatataatgctgatactactattgttaatgggagtggacagacagcaaaagaagttactcatgctgaagaaatcagaagcatgcttgaagctgtagaaaggactcaacaaagaaagcttgaagaattacttttagcagcagcaagagaaggcaaaacaacagaactcacagctctgctcaacaggcccaatcctcctgatgttaactgttcggatcagttaggaaatacacccttgcattgtgcagcttaccgggcccataaacaatgtgccttaaagcttctaagaagtggagcagaccctaatctgaagaacaaaaatgatcagaaacctcttgaccttgcccagggtgctgaaatgaaacacattcttgttggtaataaggtcatctacaaagcattgaaacgatatgagggccctctctggaagagttcaagattttttggctggagattattctgggtagtgttagagcatggagtcctttcatggtataggaaacagcctgatgcagttcataatatttatcgccagggatgcaaacacctgactcaagcagtatgcacggtaaaatccactgatagctgcctcttctttattaaatgctttgatgacaccattcatggcttccgggttcctaagaatagccttcagcagtcaagagaggactggctggaagcaatagaagaacattctgcttacagcactcactactgttcccaggaccagctgactgatgaggaggaggaagatacggtttctgctgcagacctgaagaaatcattagagaaagcacagtcatgccaacagcgactagatagggaaatttccaactttctcaaaatgattaaggagtgtgacatggctaaagaaatgcttccatcatttcttcagaaagttgaagttgtctcagaagcttctagagaaacttgtgtagctttgactgattgccttaatctcttcaccaaacaagaaggggtgaggaattttaaattggaacaagagcaagaaaaaaacaaaatcttgtcagaagcactggagacgctggccactgaacatcatgaattagagcagtctctggtgaaaggctctccacccgccagcatccttagcgaggacgagttctatgatgcgctgtcagattccgagtccgaaaggtccctgagtagattggaagcagtgacagcacgctcctttgaagaggaaggagagcatttgggcagtagaaaacacagaatgtccgaagaaaaagactgtggtggcggagatgctctctccaatggcatcaagaaacacagaacaagtttgccttctcctatgttttccagaaatgacttcagtatctggagcatcctcagaaaatgtattggaatggaactatccaagatcacgatgccagttatatttaatgagcctctgagcttcctacagcgcctaactgaatacatggagcatacttacctcatccacaaggccagttcactctctgatcctgtggaaaggatgcagtgtgtagctgcgtttgctgtatctgctgttgcttctcagtgggaacggactggaaaacctttcaacccactgctgggagagacttatgaattagtgcgagatgaccttggatttagactcatctccgaacaggtcagccatcacccaccaatcagtgcatttcatgctgaaggattaaacaatgacttcatctttcatggctctatctatcccaaactgaaattctgggggaagagtgtagaagcagaacccaaaggaaccatcaccttggagctccttgaacacaatgaggcatatacatggacaaatcccacctgctgtgtgcataatatcattgtgggtaaactgtggatcgaacagtatggcaatgtggaaattataaaccacaagactggggacaaatgtgtgttgaattttaagccatgtggcctttttggtaaggaattacacaaagttgaaggctacattcaagataaaagcaaaaagaagctctgtgccctctatgggaagtggactgaatgtttatacagtgttgaccctgccacgtttgacgcttacaaaaaaaatgataagaaaaatacagaagagaagaagaacagcaaacagatgagcacctctgaggagttggatgaaatgccagtgccggattctgaaagtgtattcattatccctggaagcgttcttctatggcgaatagccccacggcctccaaattctgcccagatgtataattttactagttttgcaatggttttgaatgaagtagacaaagacatggagagtgtgattcccaagacagactgcaggttacggcctgacatcagagccatggaaaatggagagatagatcaagctagtgaagaaaaaaaacgacttgaggaaaaacaaagagcagcccgcaaaaacaggtccaagtcagaagaggactggaagacgaggtggttccatcaaggtcctaatccctacaatggagcacaggactggatttactctggcagctactgggacagaaattacttcaatttgcctgacatttattaaaatgcatacaagtcagggtgtttggctaatctacaaataagtcttaaacctatgtttttaaatttttttcccttggtttctacttatcttttaaaaaaaaaaatgaaaaaacactcatgagataactgcatttcacccaacaaaagcagggtataaggcgatattggtgatgaaagtcttaggaaaaatgcataattttgctataaaatgtacttatttggaatactattttatatagaggtaagagaacactgctggggaatatgctttttatggttgctgttgccatatttactgaaggtttatacctaaatgtaactttagctttatggaactatatagtaatcccaaatcaagttattttgaatatttttatgctgtcatgcttgaatgttttagatgtaacctttgacatatttagaactctcctcctatacaatgtttattctcagatatagaggttatgtcattttataaagacttcattgataagatggcttttattcatactaatcctcccaatgttaccccttccatcttccaagaagaaaaaaaatgcctgaatattcagaatagatatttctgatttgaaaattctaaagaattaaactggaaaagtatttcatttacttagtgctctgaatttacttttacagttttctgcagtcagtatcattaaaatggttaagtttacatttgaactgaaaatatgtataaaatctagcaattcacaaaaatgccctagaaatatagattttaatcaccattacataatgacaaaccttgttaaatgcttccacttccagtggcaaatgccactagggaaagtaagttgcactcatgtaagtatcaaactatataaaaggaggccttgtgcatttcaagtttgcaaagtacctgtgtacttaaaatatgtgtggagacctactgtacagtagttttgcccctttaattggggcacattcatcttaaatcttatagtatttatccacccaaaccccagactgagatactgctcccaggggcctaggtagctgccagtccgtgattttaattgctgtcttgaagttaacaagtgttataatgaaataatctacctgatgctaaataaaggctttagaatgttccccaaaag

SEQ ID NO: 163129 - DNA, 1869 bp, Homo sapiens
  Payload ID: 12149
  Gene Symbol: OSBPL1A
  Gene Name: oxysterol binding protein-like 1A
  Uniprot ID: Q9BXW6
  ENST ID: ENST00000357041
  CDS Start-End: 118-1824
aatgaatggagaagtcttctgaagtgacaccagtgccttatccctagaggaatatcagcatagaaagcacagtcatgccaacagcgactagatagggaaatttccaactttctcaaaatgattaaggagtgtgacatggctaaagaaatgcttccatcatttcttcagaaagttgaagttgtctcagaagcttctagagaaacttgtgtagctttgactgattgccttaatctcttcaccaaacaagaaggggtgaggaattttaaattggaacaagagcaagaaaaaaacaaaatcttgtcagaagcactggagacgctggccactgaacatcatgaattagagcagtctctggtgaaaggctctccacccgccagcatccttagcgaggacgagttctatgatgcgctgtcagattccgagtccgaaaggtccctgagtagattggaagcagtgacagcacgctcctttgaagaggaaggagagcatttgggcagtagaaaacacagaatgtccgaagaaaaagactgtggtggcggagatgctctctccaatggcatcaagaaacacagaacaagtttgccttctcctatgttttccagaaatgacttcagtatctggagcatcctcagaaaatgtattggaatggaactatccaagatcacgatgccagttatatttaatgagcctctgagcttcctacagcgcctaactgaatacatggagcatacttacctcatccacaaggccagttcactctctgatcctgtggaaaggatgcagtgtgtagctgcgtttgctgtatctgctgttgcttctcagtgggaacggactggaaaacctttcaacccactgctgggagagacttatgaattagtgcgagatgaccttggatttagactcatctccgaacaggtcagccatcacccaccaatcagtgcatttcatgctgaaggattaaacaatgacttcatctttcatggctctatctatcccaaactgaaattctgggggaagagtgtagaagcagaacccaaaggaaccatcaccttggagctccttgaacacaatgaggcatatacatggacaaatcccacctgctgtgtgcataatatcattgtgggtaaactgtggatcgaacagtatggcaatgtggaaattataaaccacaagactggggacaaatgtgtgttgaattttaagccatgtggcctttttggtaaggaattacacaaagttgaaggctacattcaagataaaagcaaaaagaagctctgtgccctctatgggaagtggactgaatgtttatacagtgttgaccctgccacgtttgacgcttacaaaaaaaatgataagaaaaatacagaagagaagaagaacagcaaacagatgagcacctctgaggagttggatgaaatgccagtgccggattctgaaagtgtattcattatccctggaagcgttcttctatggcgaatagccccacggcctccaaattctgcccagatgtataattttactagttttgcaatggttttgaatgaagtagacaaagacatggagagtgtgattcccaagacagactgcaggttacggcctgacatcagagccatggaaaatggagagatagatcaagctagtgaagaaaaaaaacgacttgaggaaaaacaaagagcagcccgcaaaaacaggtccaagtcagaagaggactggaagacgaggtggttccatcaaggtcctaatccctacaatggagcacaggactggatttactctggcagctactgggacagaaattacttcaatttgcctgacatttattaaaatgcatacaagtcagggtgtttggctaatctacaaataagtctt

SEQ ID NO: 163130 - DNA, 1887 bp, Homo sapiens
  Payload ID: 12149
  Gene Symbol: OSBPL1A
  Gene Name: oxysterol binding protein-like 1A
  ENST ID: ENST00000399441
  CDS Start-End: 219-521
gcgggctcgagcgtcctcggggagtgccagccagagttggtgacgaccacttcctcgacgtggggcgggcggacgggaagcctggggtcgtggccaccgcctcgggagctctgggagcccgggtgaccgcgtaggtcagtttctcgcggctgtccacgcctggagttcgaggccggttcccgcgctgacgggttcccgccgggctgcgctcgggagaaatgaacacagaagcggagcaacagcttctccatcacgccagaaatggcaatgctgaagaagtaagacaactattagagaccatggcgaggaatgaagtgattgctgacattaattgcaaaggaagaagtaagtctaacttgggctggacacctctacatctggcatgctattttggacacagacaagtggtccaggatctgttgaaggctggtgcagaagtgaatgtgttgaatgacatgggagacacgccgcttcatcgagctgcctttacaggacgaaagatctgttctcagggaagctgagatggagatgagtgggcagcaggtttatggagtgctcgtggcatcacacctgtgcacgagggtggggaagaagtggacaggagtggacaagtcaagtagtgctgccggctcaagcgatgcctcagcctttctgctgtgtgcgaagctttgcagaggagatgatgcttcaaagttgtccctgttggggatgagcagccaggcctttatacactgggacagtcagtcatggatacgtggatactctggaaaccctcatccctggaggtctgagcccctggataccatgcccttcttaggctggagttgctgcccttgtccatttaccataaaaattggacaagagaataccaggacacacctgagtttctcatcgtatgctaaacctgttcttccacgtacatccccaatgtgtacagccctacttttttctgctgatcaagttcaattacttctgctaagatggtgactattcttgcctgctggtccttggatgcaaggaccccaatgttcaggcagcctttggtgccttctagcatacgaatcagagcattatctttaggtgtggaataagctgccccaaaacctgttgaagccaaccaggcactgtgctcccttctgttatgggaagtgcaagatgcagtaatttattcttctgaggaagtgtcttgtcattgcccagaccagtgaacttctaaaaatttactgacatggaaaagctcctgaattcttcctaagttttacctcccacccactggatcagatatgtcttaccaaggctttgaacatcctagcctcgtggagaagaagcctcttctcctggttctgttagcatgatgttatgaaaggaaattaaattttgggaccccaaactcattttgccaaagggaaaaatcaagctgagaactgggtcatgcaaacctgcctcccccttttggttcctaaataaggtggctacaagaggaaaagctacatgcctcccccatattttgctcacaaggaaattcctagtgagcaatgcaaagtgatagcttatctttacaggtgcagtcacccaggcccaccacacgcaaatgcatatctaattgttcccctgccccattttgtctgtgttatgtagaatgcagattccctacgtttttcttctgccccgtttatgtcatcttatgtaaaaacatgcagattcatggagccagacaaaggcatgactatcttttcccacccacccccttacctgaaaattgtgtacttctcaatatcctgccctttcccctttaaatttgaagccctcaaaaatcatcttcagagaaagatgtctgtctcctgggtgcgtgtccttaactttggcaaataaatctaaaatgattga

SEQ ID NO: 163131 - DNA, 3317 bp, Homo sapiens
  Payload ID: 12149
  Gene Symbol: OSBPL1A
  Gene Name: oxysterol binding protein-like 1A
  Uniprot ID: Q9BXW6
  ENST ID: ENST00000399443
  CDS Start-End: 870-2183
ccagggccggtgtctccaggagagggccgagcgcacagcagctctaggacctcgcaggcgcctcggcgcggcactcacgtagagcccaaggagcagtccccgacctctcctcggagggccgtgcaggcttccccggcggtccctacctgcgcctccgcccgccagcggcgctggggaaggggaggagcggcccggacgctgcccgccgcgcgcagggagccgcccgccgcaggccttgccgccgcccgcccgcgctctccccgcgagccccggagggcgggtctgcggccgagccagcggcggcggaggggcagcgcagacctctgcggcccgggcgggcgcggcgcgggagtcctgggccgctggcgggcaacgcctctgcccgacctcgctggggaaggctggcgctgctgcccggccggagccaggggcaggctgcgcaaaggtgacttagggagaccttgcgggccgccctgggtcgcgcctcccggatcggctcgcctcggctcgactggaggggaggaggaggagcaggccgagcgcattcgcgctggagcttgcgaggagcgcagggtggagcgcgccagccggggtcctcggatctggcccaggtgaggaattttaaattggaacaagagcaagaaaaaaacaaaatcttgtcagaagcactggagacgctggccactgaacatcatgaattagagcagtctctggtgaaaggctctccacccgccagcatccttagcgaggacgagttctatgatgcgctgtcagattccgagtccgaaaggtccctgagtagattggaagcagtgacagcacgctcctttgaagaggaaggagagcatttgggcagtagaaaacacagaatgtccgaagaaaaagactgtggtggcggagatgctctctccaatggcatcaagaaacacagaacaagtttgccttctcctatgttttccagaaatgacttcagtatctggagcatcctcagaaaatgtattggaatggaactatccaagatcacgatgccagttatatttaatgagcctctgagcttcctacagcgcctaactgaatacatggagcatacttacctcatccacaaggccagttcactctctgatcctgtggaaaggatgcagtgtgtagctgcgtttgctgtatctgctgttgcttctcagtgggaacggactggaaaacctttcaacccactgctgggagagacttatgaattagtgcgagatgaccttggatttagactcatctccgaacaggtcagccatcacccaccaatcagtgcatttcatgctgaaggattaaacaatgacttcatctttcatggctctatctatcccaaactgaaattctgggggaagagtgtagaagcagaacccaaaggaaccatcaccttggagctccttgaacacaatgaggcatatacatggacaaatcccacctgctgtgtgcataatatcattgtgggtaaactgtggatcgaacagtatggcaatgtggaaattataaaccacaagactggggacaaatgtgtgttgaattttaagccatgtggcctttttggtaaggaattacacaaagttgaaggctacattcaagataaaagcaaaaagaagctctgtgccctctatgggaagtggactgaatgtttatacagtgttgaccctgccacgtttgacgcttacaaaaaaaatgataagaaaaatacagaagagaagaagaacagcaaacagatgagcacctctgaggagttggatgaaatgccagtgccggattctgaaagtgtattcattatccctggaagcgttcttctatggcgaatagccccacggcctccaaattctgcccagatgtataattttactagttttgcaatggttttgaatgaagtagacaaagacatggagagtgtgattcccaagacagactgcaggttacggcctgacatcagagccatggaaaatggagagatagatcaagctagtgaagaaaaaaaacgacttgaggaaaaacaaagagcagcccgcaaaaacaggtccaagtcagaagaggactggaagacgaggtggttccatcaaggtcctaatccctacaatggagcacaggactggatttactctggcagctactgggacagaaattacttcaatttgcctgacatttattaaaatgcatacaagtcagggtgtttggctaatctacaaataagtcttaaacctatgtttttaaatttttttcccttggtttctacttatcttttaaaaaaaaaaatgaaaaaacactcatgagataactgcatttcacccaacaaaagcagggtataaggcgatattggtgatgaaagtcttaggaaaaatgcataattttgctataaaatgtacttatttggaatactattttatatagaggtaagagaacactgctggggaatatgctttttatggttgctgttgccatatttactgaaggtttatacctaaatgtaactttagctttatggaactatatagtaatcccaaatcaagttattttgaatatttttatgctgtcatgcttgaatgttttagatgtaacctttgacatatttagaactctcctcctatacaatgtttattctcagatatagaggttatgtcattttataaagacttcattgataagatggcttttattcatactaatcctcccaatgttaccccttccatcttccaagaagaaaaaaaatgcctgaatattcagaatagatatttctgatttgaaaattctaaagaattaaactggaaaagtatttcatttacttagtgctctgaatttacttttacagttttctgcagtcagtatcattaaaatggttaagtttacatttgaactgaaaatatgtataaaatctagcaattcacaaaaatgccctagaaatatagattttaatcaccattacataatgacaaaccttgttaaatgcttccacttccagtggcaaatgccactagggaaagtaagttgcactcatgtaagtatcaaactatataaaaggaggccttgtgcatttcaagtttgcaaagtacctgtgtacttaaaatatgtgtggagacctactgtacagtagttttgcccctttaattggggcacattcatcttaaatcttatagtatttatccacccaaaccccagactgagatactgctcccaggggcctaggtagctgccagtccgtgattttaattgctgtcttgaagttaacaagtgttataatgaaataatctacctgatgctaaataaaggctttagaatgttccccaaaa

SEQ ID NO: 163132 - DNA, 587 bp, Homo sapiens
  Payload ID: 12149
  Gene Symbol: OSBPL1A
  Gene Name: oxysterol binding protein-like 1A
  ENST ID: ENST00000578055
  CDS Start-End: 323-469
gcgctggagcttgcgaggagcgcagggtggagcgcgccagccggggtcctcggatctggcccaggtgaggaattttaaattggaacaagagcaagaaaaaaacaaaatcttgtcagaagcactggagacgctggccactgaacatcatgaattagagcagtctctggtgaaaggctctccacccgccagcatccttagcgaggacgagttctatgatgcgctgtcagattccgagtccgaaaggtccctgagtagattggaagcagtgacagcacgctcctttgaagaggaaggagagcatttgggcagtagaaaacacagaatgtccgaagaaaaagactgtggtggcggagatgctctctccaatggcatcaagaaacacagaacaagtttgccttctcctatgttttccagaaatgacttcagtatctggagcatcctcagaaaatgtattggaatgacacaatgaggcatatacatggacaaatcccacctgctgtgtgcataatatcattgtgggtaaactgtggatcgaacagtatggcaatgtggaaattataaaccacaagactggggacaaatgtgtg

SEQ ID NO: 163133 - DNA, 690 bp, Homo sapiens
  Payload ID: 12149
  Gene Symbol: OSBPL1A
  Gene Name: oxysterol binding protein-like 1A
  ENST ID: ENST00000582645
  CDS Start-End: 204-359
ggggaggggcggcgccacctcgcgctccgccgtggtcccggcgccgggtcccggagacagacgttacgcgggctcgagcgtcctcggggagtgccagccagagttggtgacgaccacttcctcgacgtggggcgggcggacgggaagcctggggtcgtggccaccgcctcgggagctctgggagcccgggtgaccgcgtagaaatgaacacagaagcggagcaacagcttctccatcacgccagaaatggcaatgctgaagaagtaagacaactattagagaccatggcgaggaatgaagtgattgctgacattaattgcaaaggaagaagctggtgcagaagtgaatgtgttgaatgacatgggagacacgccgcttcatcgagctgcctttacaggacgaaagctgtagaaaggactcaacaaagaaagcttgaagaattacttttagcagcagcaagagaaggcaaaacaacagaactcacagctctgctcaacaggcccaatcctcctgatgttaactgttcggatcagttaggaaatacacccttgcattgtgcagcttaccgggcccataaacaatgtgccttaaagcttctaagaagtggagcagaccctaatctgaagaacaaaaatgatcagaaacctcttgaccttgcccagggtgctgaaatgaaacacattcttgttg

SEQ ID NO: 163134 - DNA, 1354 bp, Homo sapiens
  Payload ID: 12149
  Gene Symbol: OSBPL1A
  Gene Name: oxysterol binding protein-like 1A
  ENST ID: ENST00000578091
  CDS Start-End: 229-384
gatgcgcgttccaggggcgggctgcggggaggggcggcgccacctcgcgctccgccgtggtcccggcgccgggtcccggagacagacgttacgcgggctcgagcgtcctcggggagtgccagccagagttggtgacgaccacttcctcgacgtggggcgggcggacgggaagcctggggtcgtggccaccgcctcgggagctctgggagcccgggtgaccgcgtagaaatgaacacagaagcggagcaacagcttctccatcacgccagaaatggcaatgctgaagaagtaagacaactattagagaccatggcgaggaatgaagtgattgctgacattaattgcaaaggaagaagagttggtaatgcttctcttagaatataatgctgatactactattgttaatgggagtggacagacagcaaaagaagttactcatgctgaagaaatcagaagcatgcttgaagctgtagaaaggactcaacaaagaaagcttgaagaattacttttagcagcagcaagagaaggcaaaacaacagaactcacagctctgctcaacaggcccaatcctcctgatgttaactgttcggatcagttaggaaatacacccttgcattgtgcagcttaccgggcccataaacaatgtgccttaaagcttctaagaagtggagcagaccctaatctgaagaacaaaaatgatcagaaacctcttgaccttgcccagggtgctgaaatgaaacacattcttgttggtaataaggtcatctacaaagcattgaaacgatatgagggccctctctggaagagttcaagattttttggctggagattattctgggtagtgttagagcatggagtcctttcatggtataggaaacagcctgatgcagttcataatatttatcgccagggatgcaaacacctgactcaagcagtatgcacggtaaaatccactgatagctgcctcttctttattaaatgctttgatgacaccattcatggcttccgggttcctaagaatagccttcagcagtcaagagaggactggctggaagcaatagaagaacattctgcttacagcactcactactgttcccaggaccagctgactgatgaggaggaggaagatacggtttctgctgcagacctgaagaaatcattagagaaagcacagtcatgccaacagcgactagatagggaaatttccaactttctcaaaatgattaaggagtgtgacatggctaaagaaatgcttccatcatttcttcagaaagttgaagttgtctcagaagcttctagagaaacttgtgtagctttgactgattgccttaatctcttcaccaaacaagaaggg

SEQ ID NO: 163135 - DNA, 1291 bp, Homo sapiens
  Payload ID: 12149
  Gene Symbol: OSBPL1A
  Gene Name: oxysterol binding protein-like 1A
  ENST ID: ENST00000579851
  CDS Start-End: 172-321
tggtcccggcgccgggtcccggagacagacgttacgcgggctcgagcgtcctcggggagtgccagccagagttggtgacgaccacttcctcgacgtggggcgggcggacgggaagcctggggtcgtggccaccgcctcgggagctctgggagcccgggtgaccgcgtagaaatgaacacagaagcggagcaacagcttctccatcacgccagaaatggcaatgctgaagaagtaagacaactattagagaccatggcgaggaatgaagtgattgctgacattaattgcaaaggagttggtaatgcttctcttagaatataatgctgatactactattgttaatgggagtggacagacagcaaaagaagttactcatgctgaagaaatcagaagcatgcttgaagctgtagaaaggactcaacaaagaaagcttgaagaattacttttagcagcagcaagagaaggcaaaacaacagaactcacagctctgctcaacaggcccaatcctcctgatgttaactgttcggatcagttaggaaatacacccttgcattgtgcagcttaccgggcccataaacaatgtgccttaaagcttctaagaagtggagcagaccctaatctgaagaacaaaaatgatcagaaacctcttgaccttgcccagggtgctgaaatgaaacacattcttgttggtaataaggtcatctacaaagcattgaaacgatatgagggccctctctggaagagttcaagattttttggctggagattattctgggtagtgttagagcatggagtcctttcatggtataggaaacagcctgatgcagttcataatatttatcgccagggatgcaaacacctgactcaagcagtatgcacggtaaaatccactgatagctgcctcttctttattaaatgctttgatgacaccattcatggcttccgggttcctaagaatagccttcagcagtcaagagaggactggctggaagcaatagaagaacattctgcttacagcactcactactgttcccaggaccagctgactgatgaggaggaggaagatacggtttctgctgcagacctgaagaaatcattagagaaagcacagtcatgccaacagcgactagatagggaaatttccaactttctcaaaatgattaaggagtgtgacatggctaaagaaatgcttccatcatttcttcagaaagttgaagttgtctcagaagcttctagagaaacttgtgtagctttgactgattgccttaatctcttcaccaaacaagaaggg

SEQ ID NO: 163136 - DNA, 585 bp, Homo sapiens
  Payload ID: 12149
  Gene Symbol: OSBPL1A
  Gene Name: oxysterol binding protein-like 1A
  ENST ID: ENST00000584119
  CDS Start-End: 124-249
atcattaatgaatggagaagtcttctgaagtgacaccagtgccttatccctagaggaatatcagcatagaaagcacagtcatgccaacagcgactagatagggaaatttccaactttctcaaaatgattaaggagtgtgacatggctaaagattgcctgtatgacatgtcattcgtaatgatgaaatgcttccatcatttcttcagaaagttgaagttgtctcagaagcttctagagaaacttgtgtagctttgactgattgccttaatctcttcaccaaacaagaaggggtgaggaattttaaattggaacaagagcaagaaaaaaacaaaatcttgtcagaagcactggagacgctggccactgaacatcatgaattagagcagtctctggtgaaaggctctccacccgccagcatccttagcgaggacgagttctatgatgcgctgtcagattccgagtccgaaaggtccctgagtagattggaagcagtgacagcacgctcctttgaagaggaaggagagcatttgggcagtagaaaacacagaatgtccgaagaaaaagactgtggtggcggagatgctc

SEQ ID NO: 163137 - DNA, 880 bp, Homo sapiens
  Payload ID: 12149
  Gene Symbol: OSBPL1A
  Gene Name: oxysterol binding protein-like 1A
  ENST ID: ENST00000578013
  CDS Start-End: 1-858
tgtgtagctgcgtttgctgtatctgctgttgcttctcagtgggaacggactggaaaacctttcaacccactgctgggagagacttatgaattagtgcgacacaatgaggcatatacatggacaaatcccacctgctgtgtgcataatatcattgtgggtaaactgtggatcgaacagtatggcaatgtggaaattataaaccacaagactggggacaaatgtgtgttgaattttaagccatgtggcctttttggtaaggaattacacaaagttgaaggctacattcaagataaaagcaaaaagaagctctgtgccctctatgggaagtggactgaatgtttatacagtgttgaccctgccacgtttgacgcttacaaaaaaaatgataagaaaaatacagaagagaagaagaacagcaaacagatgagcacctctgaggagttggatgaaatgccagtgccggattctgaaagtgtattcattatccctggaagcgttcttctatggcgaatagccccacggcctccaaattctgcccagatgtataattttactagttttgcaatggttttgaatgaagtagacaaagacatggagagtgtgattcccaagacagactgcaggttacggcctgacatcagagccatggaaaatggagagatagatcaagctagtgaagaaaaaaaacgacttgaggaaaaacaaagagcagcccgcaaaaacaggtccaagtcagaagaggactggaagacgaggtggttccatcaaggtcctaatccctacaatggagcacaggactggatttactctggcagctactgggacagaaattacttcaatttgcctgacatttattaaaatgcatacaagtcagggtgtt

SEQ ID NO: 163138 - DNA, 4009 bp, Homo sapiens
  Payload ID: 12150
  Gene Symbol: OSBPL2
  Gene Name: oxysterol binding protein-like 2
  Uniprot ID: Q9H1P3
  ENST ID: ENST00000313733
  CDS Start-End: 242-1684
agtcggcgaggcggcgggccgcacttccgcctcggtgtcagtgggtcgcgggcctacggggcgggggcggggcggcagtgagctcggccggcaaccgagggacccgcgtccagatcttcagtgtctattggatttttccaagagaaagtttgtaaaattccttacactgtagatgtggatcagatacgatgattcagtagaagagcacatgtcaggggcagtggaggctggctgctgaaggatgaacggagaggaagaattctttgatgccgtcacaggctttgattctgataactcttctggggaattttcagaggcaaatcagaaagtcacgggaatgattgacttagacaccagcaaaaataataggattgggaaaactggggagaggccctctcaagagaacggaattcagaaacacaggacatcgctgccggctcccatgttcagcagaagcgacttcagcgtgtggaccatcctgaagaagtgtgttggcctggagctgtccaagatcacgatgccaatcgccttcaacgagcctctgagcttcttgcagcggatcacggagtacatggagcacgtgtacctcatccacagggcctcctgccagccccagcccctggagaggatgcagtctgtggctgcttttgctgtttcggctgtggcttcccagtgggagaggaccggcaaaccatttaatccactcttgggagaaacgtatgaattaatcagggaagatttaggattcagatttatatcggaacaggtcagtcaccacccccccatcagtgcgttccactcggaaggtctcaaccatgacttcctgttccatggctccatctaccccaagctcaagttctggggcaaaagcgtggaggcggagccccgaggcaccatcaccctggagctgctcaaacataatgaagcctacacctggaccaaccccacctgctgcgtccacaacgtcatcatcgggaagctgtggatagagcagtatgggacagtggagattttaaaccacagaactggacataagtgtgtgcttcactttaaaccgtgtggattatttggaaaagaacttcacaaggtggaaggacacattcaagacaaaaacaaaaagaagctctttatgatctatggcaaatggacggaatgtttgtggggcatagatcctgtttcgtatgaatccttcaagaagcaggagaggagaggtgaccacctgagaaaggccaagctggatgaagactccgggaaggctgacagcgacgtggctgacgacgtgcctgtggcccaggagaccgtgcaggtcattcctggcagcaagctgctctggaggatcaacacccggccccccaactctgcccagatgtataatttcaccagtttcactgtgagcctcaacgagctggagacaggcatggagaagaccctgccacccacggactgccgcctgcgccctgacatccgcggcatggagaatggcaacatggatctggccagccaggagaaggagcggctggaggagaagcagagagaagcacggagggagcgggccaaggaggaggcagagtggcagacgaggtggttctacccaggcaataacccctacactgggacccccgactggttgtatgcaggggattactttgagcggaatttctccgactgcccagatatctactgagggcctggaggggcctggggcccgggaccggaggctgacgaggctggacttcctcgagtggccactgtgagcctcgtcacagcagaaaccaacttttctaacgactgagttcgcggagatagcatcatccctgatcaaggatgtaattctaattaactgttgattgccaaacatttcactctgctgtgccgtctcttcataaagcttcacttgggatcatcgtcttcattaaggtttcaacagggaaattcttcacggcgcccttttatgtggcagaaatcagctggggcttgtttagcttccagcacactctcagtcatagcatgtgtagctaaaggaagtaatgggaaggggttcatgttctctttataatgcagtggcaaaaggttctgaaagccttttaaactcgaaccagtgggggaaagatggatcttgaagctaatcctgcagagagttttatagaggccagggattgccttctaaattatgataaaacagaagtgaagagtttcagagcatcagattgagtgaaaagttgtcagattctgtattttttaacaatcttcaataatgtaaagattacttttaaaatatttaagttaaaactacttgaatagtattttgctgaagagcaagatatgcattaatcaccggttttatactgtccaaaatgaagcatccccgtgacaaaccagagtgggcagaagcatcgagagcgtgacaggaaatcccaagactgcttccgcctcagaggcgtcccggctgcgattcgctgccctgttgtcagtgaggcctggctgtcaccgcacaccgcgtccgtgtctccagggggttcctttcttctcacacgtcgcgtgtacccatagcactcttgtgtttctgtttttcccagtatgcatgtttaaaatagaagtgacaagaatcacatccggttgtgtcctgtgggagggtcagaggcagaatctacttacagtggtgtaattaaagttatttaaccaaaaataggtatgtgtccatctcagcattcacctttatcaagtgactgatttttttttcttttctttccttttttttttttttttgagacggagtttcactcttgttgcccaggctggagtgcaatggcatgatctcggctcaccgcaacctccgcctcccgggttcaagcgattctcctgcctcagcctcccaagtagctgggattacaggcacgcgccaccacacctggctgattttgtatttttagtagacacgggttttcaccatgttggtcaggctggtctcaaactcccgacctcaagtagtctgcctgcctcaacctcccaaagtgctgggattacaggcgtgagccactgcgcctggccgtgactgattttttttcatgtagaattgtcaacacgagagatcacagtggagcactttgaaagaccgtcggttgtgtgcacgcacgcacacactcatgcacacgctgacacgcggttgcatggagtccaggttactcaggccggcacttctgagtgacaggtgccacctgcgtgtgtcttggcgtccacatcacacctgtgacggaagcacttctggaagtgaacactcgttttgaaagcttgattttgtagctttggaagctggaagcgatggtgtttggtgccgagtcctgtgtcatcctcggggcctatgagctccgtaccagccactcaaaagtgtctgaacagaaccgctccgtgactggtagctgggtctgaggattcaggattgtggcgttattcaaagaggagactttgaaattccccgatggctggaatgtggagcccaggtgcctctggtggagggtcatctgcttttccagactgtggttgtgaaccggctccttctccaagaaaggttgcaagctgagaacatccagaggtgagactcagacacattgaaagtgactgcatttagggaggtttaacgagttcttactgatcattccacttgttactggttaagataatttgcccacgggtttgtttccaagtcctcttctaggaccaggctcctggtatttcaggggctggttggctgcacagacagcccctcttctgctgtccttgaggacagacaccaaaccagaggtggaggaagaacggtaggaaggctgatggcaaaagcggctgtgtgtcgaggttattttaactttttactactttttgttactgtttctgcaaatgctaacacataaaccatgacctaacttttgtcaccttggatatctattgaatgttaaacatctctaataaagatggccaccacttaatgtgtggaaagtgatggccttctcgtggg

SEQ ID NO: 163139 - DNA, 3936 bp, Homo sapiens
  Payload ID: 12150
  Gene Symbol: OSBPL2
  Gene Name: oxysterol binding protein-like 2
  Uniprot ID: Q9H1P3
  ENST ID: ENST00000358053
  CDS Start-End: 206-1612
gtcagtgggtcgcgggcctacggggcgggggcggggcggcagtgagctcggccggcaaccgagggacccgcgtccagatcttcagtgtctattggatttttccaagagaaagtttgtaaaattccttacactgtagatgtggatcagatacgatgattcagtagaagagcacatgtcaggggcagtggaggctggctgctgaaggatgaacggagaggaagaattctttgatgccgtcacagaggcaaatcagaaagtcacgggaatgattgacttagacaccagcaaaaataataggattgggaaaactggggagaggccctctcaagagaacggaattcagaaacacaggacatcgctgccggctcccatgttcagcagaagcgacttcagcgtgtggaccatcctgaagaagtgtgttggcctggagctgtccaagatcacgatgccaatcgccttcaacgagcctctgagcttcttgcagcggatcacggagtacatggagcacgtgtacctcatccacagggcctcctgccagccccagcccctggagaggatgcagtctgtggctgcttttgctgtttcggctgtggcttcccagtgggagaggaccggcaaaccatttaatccactcttgggagaaacgtatgaattaatcagggaagatttaggattcagatttatatcggaacaggtcagtcaccacccccccatcagtgcgttccactcggaaggtctcaaccatgacttcctgttccatggctccatctaccccaagctcaagttctggggcaaaagcgtggaggcggagccccgaggcaccatcaccctggagctgctcaaacataatgaagcctacacctggaccaaccccacctgctgcgtccacaacgtcatcatcgggaagctgtggatagagcagtatgggacagtggagattttaaaccacagaactggacataagtgtgtgcttcactttaaaccgtgtggattatttggaaaagaacttcacaaggtggaaggacacattcaagacaaaaacaaaaagaagctctttatgatctatggcaaatggacggaatgtttgtggggcatagatcctgtttcgtatgaatccttcaagaagcaggagaggagaggtgaccacctgagaaaggccaagctggatgaagactccgggaaggctgacagcgacgtggctgacgacgtgcctgtggcccaggagaccgtgcaggtcattcctggcagcaagctgctctggaggatcaacacccggccccccaactctgcccagatgtataatttcaccagtttcactgtgagcctcaacgagctggagacaggcatggagaagaccctgccacccacggactgccgcctgcgccctgacatccgcggcatggagaatggcaacatggatctggccagccaggagaaggagcggctggaggagaagcagagagaagcacggagggagcgggccaaggaggaggcagagtggcagacgaggtggttctacccaggcaataacccctacactgggacccccgactggttgtatgcaggggattactttgagcggaatttctccgactgcccagatatctactgagggcctggaggggcctggggcccgggaccggaggctgacgaggctggacttcctcgagtggccactgtgagcctcgtcacagcagaaaccaacttttctaacgactgagttcgcggagatagcatcatccctgatcaaggatgtaattctaattaactgttgattgccaaacatttcactctgctgtgccgtctcttcataaagcttcacttgggatcatcgtcttcattaaggtttcaacagggaaattcttcacggcgcccttttatgtggcagaaatcagctggggcttgtttagcttccagcacactctcagtcatagcatgtgtagctaaaggaagtaatgggaaggggttcatgttctctttataatgcagtggcaaaaggttctgaaagccttttaaactcgaaccagtgggggaaagatggatcttgaagctaatcctgcagagagttttatagaggccagggattgccttctaaattatgataaaacagaagtgaagagtttcagagcatcagattgagtgaaaagttgtcagattctgtattttttaacaatcttcaataatgtaaagattacttttaaaatatttaagttaaaactacttgaatagtattttgctgaagagcaagatatgcattaatcaccggttttatactgtccaaaatgaagcatccccgtgacaaaccagagtgggcagaagcatcgagagcgtgacaggaaatcccaagactgcttccgcctcagaggcgtcccggctgcgattcgctgccctgttgtcagtgaggcctggctgtcaccgcacaccgcgtccgtgtctccagggggttcctttcttctcacacgtcgcgtgtacccatagcactcttgtgtttctgtttttcccagtatgcatgtttaaaatagaagtgacaagaatcacatccggttgtgtcctgtgggagggtcagaggcagaatctacttacagtggtgtaattaaagttatttaaccaaaaataggtatgtgtccatctcagcattcacctttatcaagtgactgatttttttttcttttctttccttttttttttttttttgagacggagtttcactcttgttgcccaggctggagtgcaatggcatgatctcggctcaccgcaacctccgcctcccgggttcaagcgattctcctgcctcagcctcccaagtagctgggattacaggcacgcgccaccacacctggctgattttgtatttttagtagacacgggttttcaccatgttggtcaggctggtctcaaactcccgacctcaagtagtctgcctgcctcaacctcccaaagtgctgggattacaggcgtgagccactgcgcctggccgtgactgattttttttcatgtagaattgtcaacacgagagatcacagtggagcactttgaaagaccgtcggttgtgtgcacgcacgcacacactcatgcacacgctgacacgcggttgcatggagtccaggttactcaggccggcacttctgagtgacaggtgccacctgcgtgtgtcttggcgtccacatcacacctgtgacggaagcacttctggaagtgaacactcgttttgaaagcttgattttgtagctttggaagctggaagcgatggtgtttggtgccgagtcctgtgtcatcctcggggcctatgagctccgtaccagccactcaaaagtgtctgaacagaaccgctccgtgactggtagctgggtctgaggattcaggattgtggcgttattcaaagaggagactttgaaattccccgatggctggaatgtggagcccaggtgcctctggtggagggtcatctgcttttccagactgtggttgtgaaccggctccttctccaagaaaggttgcaagctgagaacatccagaggtgagactcagacacattgaaagtgactgcatttagggaggtttaacgagttcttactgatcattccacttgttactggttaagataatttgcccacgggtttgtttccaagtcctcttctaggaccaggctcctggtatttcaggggctggttggctgcacagacagcccctcttctgctgtccttgaggacagacaccaaaccagaggtggaggaagaacggtaggaaggctgatggcaaaagcggctgtgtgtcgaggttattttaactttttactactttttgttactgtttctgcaaatgctaacacataaaccatgacctaacttttgtcaccttggatatctattgaatgttaaacatctctaataaagatggccaccacttaatgtgtggaaagtgatggccttctcgtgg

SEQ ID NO: 163140 - DNA, 3886 bp, Homo sapiens
  Payload ID: 12150
  Gene Symbol: OSBPL2
  Gene Name: oxysterol binding protein-like 2
  ENST ID: ENST00000439951
  CDS Start-End: 518-1630
agtcggcgaggcggcgggccgcacttccgcctcggtgtcagtgggtcgcgggcctacggggcgggggcggggcggcagtgagctcggccggcaaccgagggacccgcgtccagatcttcagtgtctattggatttttccaagagaaagtttgtaaaattccttacactgtagatgtggatcagatacgatgattcagtagaagagcacatgtcaggggcagtggaggctggctgctgaaggatgaacggagaggaagaattctttgatgccgtcacaggctttgattctgataactcttctggggaattttcagaggcaaatcagaaagtcacgggaatgattgacttagacaccagcaaaaataataggattgggaaaactggggagaggccctctcaagagaacggaattcagaaacacaggacatcgctgccggctcccatgttcagcagaagcgacttcagcgtgtggaccatcctgaagaagtgtgttggcctggagctgtccaagatcacgatgccaatcgccttcaacgagcctctgagcttcttgcagcggatcacggagtacatggagcacgtgtacctcatccacagggcctcctgccagccccagcccctggagaggatgcagtctgtggctgcttttgctgtttcggctgtggcttcccagtgggagaggaccggcaaaccatttaatccactcttgggagaaacgtatgaattaatcagggaagatttaggattcagatttatatcggaacaggtcagtcaccacccccccatcagtgcgttccactcggaaggtctcaaccatgacttcctgttccatggctccatctaccccaagctcaagttctggggcaaaagcgtggaggcggagccccgaggcaccatcaccctggagctgctcaaacataatgaagcctacacctggaccaaccccacctgctgcgtccacaacgtcatcatcgggaagctgtggatagagcagtatgggacagtggagattttaaaccacagaactggacataagtgtgtgcttcactttaaaccgtgtggattatttggaaaagaacttcacaaggtggaaggacacattcaagacaaaaacaaaaagaagctctttatgatctatggcaaatggacggaatgtttgtggggcatagatcctgtttcgtatgaatccttcaagaagcaggagaggagaggtgaccacctgagaaaggccaagctggatgaagactccgggaaggctgacagcgacgtggctgacgacgtgcctgtggcccaggagaccgtgcaggtcattcctggcagcaagctgctctggaggatcaacacccggccccccaactctgcccagatctggccagccaggagaaggagcggctggaggagaagcagagagaagcacggagggagcgggccaaggaggaggcagagtggcagacgaggtggttctacccaggcaataacccctacactgggacccccgactggttgtatgcaggggattactttgagcggaatttctccgactgcccagatatctactgagggcctggaggggcctggggcccgggaccggaggctgacgaggctggacttcctcgagtggccactgtgagcctcgtcacagcagaaaccaacttttctaacgactgagttcgcggagatagcatcatccctgatcaaggatgtaattctaattaactgttgattgccaaacatttcactctgctgtgccgtctcttcataaagcttcacttgggatcatcgtcttcattaaggtttcaacagggaaattcttcacggcgcccttttatgtggcagaaatcagctggggcttgtttagcttccagcacactctcagtcatagcatgtgtagctaaaggaagtaatgggaaggggttcatgttctctttataatgcagtggcaaaaggttctgaaagccttttaaactcgaaccagtgggggaaagatggatcttgaagctaatcctgcagagagttttatagaggccagggattgccttctaaattatgataaaacagaagtgaagagtttcagagcatcagattgagtgaaaagttgtcagattctgtattttttaacaatcttcaataatgtaaagattacttttaaaatatttaagttaaaactacttgaatagtattttgctgaagagcaagatatgcattaatcaccggttttatactgtccaaaatgaagcatccccgtgacaaaccagagtgggcagaagcatcgagagcgtgacaggaaatcccaagactgcttccgcctcagaggcgtcccggctgcgattcgctgccctgttgtcagtgaggcctggctgtcaccgcacaccgcgtccgtgtctccagggggttcctttcttctcacacgtcgcgtgtacccatagcactcttgtgtttctgtttttcccagtatgcatgtttaaaatagaagtgacaagaatcacatccggttgtgtcctgtgggagggtcagaggcagaatctacttacagtggtgtaattaaagttatttaaccaaaaataggtatgtgtccatctcagcattcacctttatcaagtgactgatttttttttcttttctttccttttttttttttttttgagacggagtttcactcttgttgcccaggctggagtgcaatggcatgatctcggctcaccgcaacctccgcctcccgggttcaagcgattctcctgcctcagcctcccaagtagctgggattacaggcacgcgccaccacacctggctgattttgtatttttagtagacacgggttttcaccatgttggtcaggctggtctcaaactcccgacctcaagtagtctgcctgcctcaacctcccaaagtgctgggattacaggcgtgagccactgcgcctggccgtgactgattttttttcatgtagaattgtcaacacgagagatcacagtggagcactttgaaagaccgtcggttgtgtgcacgcacgcacacactcatgcacacgctgacacgcggttgcatggagtccaggttactcaggccggcacttctgagtgacaggtgccacctgcgtgtgtcttggcgtccacatcacacctgtgacggaagcacttctggaagtgaacactcgttttgaaagcttgattttgtagctttggaagctggaagcgatggtgtttggtgccgagtcctgtgtcatcctcggggcctatgagctccgtaccagccactcaaaagtgtctgaacagaaccgctccgtgactggtagctgggtctgaggattcaggattgtggcgttattcaaagaggagactttgaaattccccgatggctggaatgtggagcccaggtgcctctggtggagggtcatctgcttttccagactgtggttgtgaaccggctccttctccaagaaaggttgcaagctgagaacatccagaggtgagactcagacacattgaaagtgactgcatttagggaggtttaacgagttcttactgatcattccacttgttactggttaagataatttgcccacgggtttgtttccaagtcctcttctaggaccaggctcctggtatttcaggggctggttggctgcacagacagcccctcttctgctgtccttgaggacagacaccaaaccagaggtggaggaagaacggtaggaaggctgatggcaaaagcggctgtgtgtcgaggttattttaactttttactactttttgttactgtttctgcaaatgctaacacataaaccatgacctaacttttgtcaccttggatatctattgaatgttaaacatctctaataaagatggccaccacttaatgtgtggaaagtgatggccttctcgtgggc

SEQ ID NO: 163141 - DNA, 450 bp, Homo sapiens
  Payload ID: 12150
  Gene Symbol: OSBPL2
  Gene Name: oxysterol binding protein-like 2
  ENST ID: ENST00000448156
  CDS Start-End: 1-231
aaaccatttaatccactcttgggagaaacgtatgaattaatcagggaagatttaggattcagatttatatcggaacaggtcagtcaccacccccccatcagtgcgttccactcggaaggtctcaaccatgacttcctgttccatggctccatctaccccaagctcaagttctggggcaaaagcgtggaggcggagccccgaggcaccatcaccctggagctgctcaagtgagtgtcgtgtcaaccaaagacacctcagagcaaaacacaagtctccaacaaatgccggccgctaagacccgacagacacagaccggatgctggcgtcctcctgggccaccagttctgagacgtgagtcttgccaagccactgcctgcagtcttgttgtaggcagcaggtcctaacaaatacatacagaaataagtaataaacgacaccttgcctgatgaa

SEQ ID NO: 163142 - DNA, 754 bp, Homo sapiens
  Payload ID: 12150
  Gene Symbol: OSBPL2
  Gene Name: oxysterol binding protein-like 2
  ENST ID: ENST00000622332
  CDS Start-End: 215-754
ccccgttctctcttcaggagaggctcagccagctccttcctggtcccggcacgtctctagtggcgccgactgacagtggcccaccaatcttcagtgtctattggatttttccaagagaaagtttgtaaaattccttacactgtagatgtggatcagatacgatgattcagtagaagagcacatgtcaggggcagtggaggctggctgctgaaggatgaacggagaggaagaattctttgatgccgtcacaggctttgattctgataactcttctggggaattttcagaggcaaatcagaaagtcacgggaatgattgacttagacaccagcaaaaataataggattgggaaaactggggagaggccctctcaagagaacggaattcagaaacacaggacatcgctgccggctcccatgttcagcagaagcgacttcagcgtgtggaccatcctgaagaagtgtgttggcctggagctgtccaagatcacgatgccaatcgccttcaacgagcctctgagcttcttgcagcggatcacggagtacatggagcacgtgtacctcatccacagggcctcctgccagccccagcccctggagaggatgcagtctgtggctgcttttgctgtttcggctgtggcttcccagtgggagaggaccggcaaaccatttaatccactcttgggagaaacgtatgaattaatcagggaagatttaggattcagatttatatcggaacaggtcagtcaccacccc

SEQ ID NO: 163143 - DNA, 582 bp, Homo sapiens
  Payload ID: 12150
  Gene Symbol: OSBPL2
  Gene Name: oxysterol binding protein-like 2
  ENST ID: ENST00000618509
  CDS Start-End: 515-582
aaaactaaaaatactctcctccccacagcagagaagccagggctgtcacgtcgcagaggagactggagagctgcggcggggaggggtcagctgcggccacgtgagggccaggcccctctctgactgcccaggctgcatccacacagaagattccatggctttccataaaagagagtgggagaatgtcctctctaaaggcctggggagtgcctggggagaggagacagcctcagctggggctcaccagccagcagctgccagccaggccagcaatgccaaggcacccggcgttcctggaagccaagccctgtttgatctaatggggcagctgtgggtgcagacccagataaagagataaacccagacccagaaacctgggggaggagatcttcagtgtctattggatttttccaagagaaagtttgtaaaattccttacactgtagatgtggatcagatacgatgattcagtagaagagcacatgtcaggggcagtggaggctggctgctgaaggatgaacggagaggaagaattctttgatgccgtcacaggctttgattctgataactcttctggggaatt

SEQ ID NO: 163144 - DNA, 6760 bp, Homo sapiens
  Payload ID: 12151
  Gene Symbol: OSBPL3
  Gene Name: oxysterol binding protein-like 3
  Uniprot ID: Q9H4L5
  ENST ID: ENST00000313367
  CDS Start-End: 453-3116
ggcgcgcgccgagaagttctgggcaaagtactcagaactggccgcgtgctggtggcgcccgccagccggcccgggagaggggacttgagcgcttcgcggccggtgcgcagcgcggctccggccccgcagtctgtctgcaagtggccatccccgcccccgactcctgcggccggtgcgggagctgtcagctgcacgttgcgggggtaccggagaagccggggttgccttctcccggttctgtgcgctaaccccggagcccggccccggggaactagggagcgtctccggctgcacagcgctcaggttttagggtttcctttgggccacccaaaatgttttttaaatactttggataagagctaaaccacctgccactggggacttccatactctcggctcccttgtcatctgatggcattttgattgtctcgaggccaagtgacttgctgtccatgatgagtgatgagaagaaccttggtgtgtcccaaaaattggtatcaccttcaaggagcacaagtagctgctcttccaagcaaggaagtcgacaggacagctgggaagtggtggaaggactgaggggggagatgaattacacccaggagccaccagttcagaaaggatttttgctgaaaaagaggaagtggcccttaaaaggctggcataagagattcttctatctggacaaaggaatcttgaaatatgccaagagccaaaccgatatagagagagagaagctgcatggctgcattgatgtcgggctctcagtgatgtctgtaaagaagtcatcaaaatgcatagaccttgacaccgaggagcacatctaccatctgaaggtcaagtcagaagaagtctttgatgagtgggtatcgaaacttcgccaccacagaatgtatcgtcagaatgaaattgccatgtttccacatgaagttaaccactttttctcagggtccaccatcacagactcttcatctggggtgtttgactccatttcaagtaggaagcgtagcagtatatcaaagcagaatttatttcaaactggaagcaatgtatcattttcttgtggtggtgagacacgagttccattatggttacagtcttcagaggacatggaaaaatgctccaaagacctggcgcactgtcatgcctacctggtagaaatgagccagctcctgcaaagcatggacgtcctgcatcggacatactcggcaccagctatcaacgccatccagggtggatcttttgaaagtcccaaaaaggaaaaaagatcgcacaggaggtggcggtccagagctattggcaaagatgctaaaggaacactgcaggtcccgaaacctttttctggcccagtaagactacactcctccaatcctaatttgtcaacactagattttggagaagagaaaaattattctgatggctctgaaacctcatcagagttttctaaaatgcaagaagatctgtgtcatattgcccataaagtttacttcactttaaggtcagcttttaatatcatgtcagcggagagagagaaactgaagcagctgatggagcaggatgcctcctcctccccgtctgctcaggtcattggtctgaagaacgccctgtcatccgccctagcacaaaacacagatcttaaagaacgcttacgcagaatccatgccgagtctctgctcctcgactcccccgctgtcgccaagtcgggtgacaatctggcagaggaaaactccagagatgaaaaccgagctctagttcatcagctttctaatgaaagtagactctccatcactgactccctttctgagttttttgatgctcaggaagttctgttatctccaagctcttcagaaaacgagatttctgatgatgactcatatgtcagtgacataagtgataatctttccttagataatctcagtaatgatttagataatgagagacagaccttggggcctgtccttgatagtggtcgggaagcgaagtcccggagaagaacgtgcctgccggcgccctgcccgagcagcagtaacatcagcctgtggaacatcctgaggaacaacatcgggaaggacctgtccaaggtggccatgccggtggagctgaacgagcccctgaacacgctgcagaggctctgcgaggagctggagtacagcgagctcctggacaaggccgcgcagattcccagccccctggaaaggatggtatatgtggcagcctttgccatatcagcgtatgcatctagctactaccgagctggaagcaagccatttaatccggttcttggagaaacatatgaatgtattcgggaggacaagggcttccagtttttttcagaacaggtcagccaccatccgcctatctctgcgtgtcatgctgagtctagaaattttgttttctggcaagatgtgagatggaaaaacaaattctggggcaaatccatggaaattgttccaattggcacaacccatgtgactctgccagtttttggggatcattttgagtggaacaaagtgacctcttgcatccataacatcttaagcgggcagaggtggattgagcactatggagagattgtcatcaagaacctgcatgatgattcctgctactgcaaagtgaattttataaaggcaaaatactggagcactaatgcccatgagattgaaggcacagtgtttgacaggagtggaaaagcggttcatcggctgtttgggaaatggcatgaaagcatctactgtggcggcggctcctcttctgcctgtgtatggagagcaaatcctatgccgaaaggctacgagcaatactatagcttcacacagtttgcgctggaattaaatgaaatggatccatcatcaaagtctttattgccacctactgacactcgatttaggccagaccagaggtttctagaggaagggaacttagaagaagctgaaatacaaaagcagaggattgaacaactgcagagagaaaggcggcgggtcttagaagaaaatcatgtggagcaccagcctcggtttttcaggaaatccgacgatgactcttgggtgagcaacggcacctatttggaacttagaaaagatcttggtttttccaaactggaccatcctgtcttatggtgaaaaagtaaagaagaaagataacattagtgtatttctcctgtgcttgccttctgaagtggcacaaacctgtgtttatatatttaaaagatactctaggatgatcacttgtgcttagcttagcattgtaactctttaagtctatattttcctcagtgcgtttctttacaatttcaaatgttaccctgattgtttatatgaatgtagaacaccttgacatttctttttatatataaactatttaataaaaatgaaagattgaatgttcatgtgtgggttaaaaaaagaagctttaacactaattttccaaaggttagggaagattccaattaaatttatgccttataaaattatgttgtagaaaaaaaatcaacctctcccaggtgcattaagaaataagaattcccagggttactcacccatgcgtaagctacccaagtttaatttggtagctgaaatatctttttgcctcagacagctcttgaattgctcatacagaacaattctgctggtgctggagtctgaagaatattttcatttgcattttagtggttagggagaggatataagattaatggaatgtatatttttatataagacgtatacggcaccttcttgaaaaggaagcatttgaacttgttcctccctatagttctattgccttatatgcaaaattgtaccctgttgctcagagaaattattcataagagaaaagaattccaattaattaaatatcacaatagcatcccagagagacagtaggaaatttctccttagtgagagctgagtccttgagaagttaagagactgtttcctgcttcccaccccaccccgttttttgtccctccgtttgatcacctccctgttgagtatggaatgtcccagtttaatataaaacatacagtttattccacacagcagtttgactttgtaaaagtttagcaaaataactgattgttttggataactcaacatgtttttcttaaatgctgttttagtattttctacctcttaataagcaccatattttagatcttgtataaaaagttgccatctgccttatagacaaatgtagagaattgatgttcttgctttgtgttgtgttctggtaaagctttaagtgagtgtcttacccctttcctatactttcttgttatccatatcattcttttgtgagttttgcagcagtcttgaataatacagattataactactgaaaggggaaccttcgtctttttaaatgtgttatttcacattacaataatatgtgtagtagttgaattgtgttatcaaagcatgtccaacttctgtccagatgacattaaaaccaaagcctaattgttaagcctcttattctaaagtccatagcaatgctatggaatatcaagtataatgatgtagtaaaaagatttctccagaaaacactttgagatacttaaagaaattcagagcatatcgaatgttatgaatgaagagtaaaataattacaggaaaagaatgcatgatttttcattgtcacaccaaataaccagttggacaatattgcattttcaaaatggagagttatttaaagtggatgtgtagccttctggaatctgcacgtgactggcattttaaaacaactcattaaatattggattcattttatcgagatgccaagatgaacacaatgtgaatatcatttccatttctaagcagttgaatgacacagtcagattctttggtgtatgctttgttctttccatctcaagcatttatccaaattctgctcacagacatgaggaagcaggctgtagatttaagggcactcaaggggaaaacaaatgtagtttccacagtgtgaggataaatgtagaatcgtggtaatattggctgttaaattggcctgctccagagactggctcaaaaaagaaagaagcaacgaaaacaaaatgcacagcctgaatggacgtagcactgtcatgtggcatttggaaaatctttaattatcctaatgttatttcacttgcccttatgctttattttagagtcccagggacaactggatgaaacattacgtctgtagtcatcttatttgagatgggggtgggaacgaattaaaatatgatagagaactatatgcagattttaaaatctagtcagtactagcatctataaagggcttttctgaaatttaaacagcttggtgatgcatcctgatattataagcttaaaactatcttgagggggaaatgacttcttttctccttctgtcccttttctcaaaagcatctttcccccaaatgtatgtctctaggacattttatagttttaagaggaagaaaacagaaacgtggcatcatttgggaagaaccaaggtagaatttaattttctggactttaaatctcctggttaaataatgctaatcactgtaccatttgagttacatgttttaacctcttttttttttctaattattccatccaaaatttctggtgaattacacagaaatttttggaaatgggactttgtgcaggtaaccaccctgcacttcaggtaatgttcctgtcacagctgtcgactaccccacgctgcaggaaatccattcagaaatgagctaacagtctccagtgtagcaggagagccagtcacttccctccccaggccccaaagcaccccaaggctggtattccttgagtcataggtattaataataaaagcctcaatgcagcttctccatgtagttcctctcctacaagccaggtggattctggtcctaactaaagagatgggagttcacctgagggcaagaagtacccaggatgcccaaacagccgcacaggtgtcctgtgcttcctgtgagacttcctgggggaaatatacaaactaatatattttttaatgtttacgtcatttacactgctgcttttctcatattctgcttttaattacttgtagtaaatcatttgtttgggcttcaagcactgtcttccatctgcatcttccagatttatcatgagtgatcttgttctactgttaaagatgtcaagcctaaaaagtaataaagtttttatttggctgttgaaccttgatgtagcccctactacatacactacaagttatgccttctggctactacagaatctccgcagaccttttagttatgagtagaagcaataagaaggtgtccttatggtcttaggaataatagttccaatgtattggcataatttgtttgaatgtctttattttgatattaacaccggcataaatctatttttgctaccagatgatagctattttcatttgctctattttcctctgcattgtactaatctgttactcagtgttagtcttcatttttctgtgttggaaacctgcgtcatgtaaatatctgcaaatcatgacagtctaaagtgcaaaccattttcagagactttggggaatgcagtgatcagaagtggctaatttattttatttctgattattttatccagagggtacttttttaatggatatttgtaaatcttccacttaaccactgaaaattattttgttttaatcccacccttccatccatacctctgcctccccaaaaagctcctattaatttgcttatccccctcatgtagctagttgaatgtgaataaataacatggaaaaaaag

SEQ ID NO: 163145 - DNA, 2707 bp, Homo sapiens
  Payload ID: 12151
  Gene Symbol: OSBPL3
  Gene Name: oxysterol binding protein-like 3
  Uniprot ID: Q9H4L5
  ENST ID: ENST00000396429
  CDS Start-End: 104-2659
tggataagagctaaaccacctgccactggggacttccatactctcggctcccttgtcatctgatggcattttgattgtctcgaggccaagtgacttgctgtccatgatgagtgatgagaagaaccttggtgtgtcccaaaaattggtatcaccttcaaggagcacaagtagctgctcttccaagcaaggaagtcgacaggacagctgggaagtggtggaaggactgaggggggagatgaattacacccaggagccaccagttcagaaaggatttttgctgaaaaagaggaagtggcccttaaaaggctggcataagagattcttctatctggacaaaggaatcttgaaatatgccaagagccaaaccgatatagagagagagaagctgcatggctgcattgatgtcgggctctcagtgatgtctgtaaagaagtcatcaaaatgcatagaccttgacaccgaggagcacatctaccatctgaaggtcaagtcagaagaagtctttgatgagtgggtatcgaaacttcgccaccacagaatgtatcgtcagaatgaaattgccatgtttccacatgaagttaaccactttttctcagggtccaccatcacagactcttcatctggggtgtttgactccatttcaagtaggaagcgtagcagtatatcaaagcagaatttatttcaaactggaagcaatgtatcattttcttgtggtggtgagacacgagttccattatggttacagtcttcagaggacatggaaaaatgctccaaagacctggcgcactgtcatgcctacctggtagaaatgagccagctcctgcaaagcatggacgtcctgcatcggacatactcggcaccagctatcaacgccatccagggtggatcttttgaaagtcccaaaaaggaaaaaagatcgcacaggaggtggcggtccagagctattggcaaagatgctaaaggaacactgcaggtcccgaaacctttttctggcccagtaagactacactcctccaatcctaatttgtcaacactagattttggagaagagaaaaattattctgatggctctgaaacctcatcagagttttctaaaatgcaagaagatctgtgtcatattgcccataaagtttacttcactttaaggtcagcttttaatatcatgtcagcggagagagagaaactgaagcagctgatggagcaggatgcctcctcctccccgtctgctcaggtcattggtctgaagaacgccctgtcatccgaaaactccagagatgaaaaccgagctctagttcatcagctttctaatgaaagtagactctccatcactgactccctttctgagttttttgatgctcaggaagttctgttatctccaagctcttcagaaaacgagatttctgatgatgactcatatgtcagtgacataagtgataatctttccttagataatctcagtaatgatttagataatgagagacagaccttggggcctgtccttgatagtggtcgggaagcgaagtcccggagaagaacgtgcctgccggcgccctgcccgagcagcagtaacatcagcctgtggaacatcctgaggaacaacatcgggaaggacctgtccaaggtggccatgccggtggagctgaacgagcccctgaacacgctgcagaggctctgcgaggagctggagtacagcgagctcctggacaaggccgcgcagattcccagccccctggaaaggatggtatatgtggcagcctttgccatatcagcgtatgcatctagctactaccgagctggaagcaagccatttaatccggttcttggagaaacatatgaatgtattcgggaggacaagggcttccagtttttttcagaacaggtcagccaccatccgcctatctctgcgtgtcatgctgagtctagaaattttgttttctggcaagatgtgagatggaaaaacaaattctggggcaaatccatggaaattgttccaattggcacaacccatgtgactctgccagtttttggggatcattttgagtggaacaaagtgacctcttgcatccataacatcttaagcgggcagaggtggattgagcactatggagagattgtcatcaagaacctgcatgatgattcctgctactgcaaagtgaattttataaaggcaaaatactggagcactaatgcccatgagattgaaggcacagtgtttgacaggagtggaaaagcggttcatcggctgtttgggaaatggcatgaaagcatctactgtggcggcggctcctcttctgcctgtgtatggagagcaaatcctatgccgaaaggctacgagcaatactatagcttcacacagtttgcgctggaattaaatgaaatggatccatcatcaaagtctttattgccacctactgacactcgatttaggccagaccagaggtttctagaggaagggaacttagaagaagctgaaatacaaaagcagaggattgaacaactgcagagagaaaggcggcgggtcttagaagaaaatcatgtggagcaccagcctcggtttttcaggaaatccgacgatgactcttgggtgagcaacggcacctatttggaacttagaaaagatcttggtttttccaaactggaccatcctgtcttatggtgaaaaagtaaagaagaaagataacattagtgtatttctcctgtgcttgcc

SEQ ID NO: 163146 - DNA, 2969 bp, Homo sapiens
  Payload ID: 12151
  Gene Symbol: OSBPL3
  Gene Name: oxysterol binding protein-like 3
  Uniprot ID: Q9H4L5
  ENST ID: ENST00000396431
  CDS Start-End: 141-2711
tttcctttgggccacccaaaatgttttttaaatactttggataagagctaaaccacctgccactggggacttccatactctcggctcccttgtcatctgatggcattttgattgtctcgaggccaagtgacttgctgtccatgatgagtgatgagaagaaccttggtgtgtcccaaaaattggtatcaccttcaaggagcacaagtagctgctcttccaagcaaggaagtcgacaggacagctgggaagtggtggaaggactgaggggggagatgaattacacccaggagccaccagttcagaaaggatttttgctgaaaaagaggaagtggcccttaaaaggctggcataagagattcttctatctggacaaaggaatcttgaaatatgccaagagccaaaccgatatagagagagagaagctgcatggctgcattgatgtcgggctctcagtgatgtctgtaaagaagtcatcaaaatgcatagaccttgacaccgaggagcacatctaccatctgaaggtcaagtcagaagaagtctttgatgagtgggtatcgaaacttcgccaccacagaatgtatcgtcagaatgaaattgccatgtttccacatgaagttaaccactttttctcagggtccaccatcacagactcttcatctggggtgtttgactccatttcaagtaggaagcgtagcagtatatcaaagcagaatttatttcaaactggaagcaatgtatcattttcttgtggtggtgagacacgagttccattatggttacagtcttcagaggacatggaaaaatgctccaaagacctggcgcactgtcatgcctacctggtagaaatgagccagctcctgcaaagcatggacgtcctgcatcggacatactcggcaccagctatcaacgccatccaggtcccgaaacctttttctggcccagtaagactacactcctccaatcctaatttgtcaacactagattttggagaagagaaaaattattctgatggctctgaaacctcatcagagttttctaaaatgcaagaagatctgtgtcatattgcccataaagtttacttcactttaaggtcagcttttaatatcatgtcagcggagagagagaaactgaagcagctgatggagcaggatgcctcctcctccccgtctgctcaggtcattggtctgaagaacgccctgtcatccgccctagcacaaaacacagatcttaaagaacgcttacgcagaatccatgccgagtctctgctcctcgactcccccgctgtcgccaagtcgggtgacaatctggcagaggaaaactccagagatgaaaaccgagctctagttcatcagctttctaatgaaagtagactctccatcactgactccctttctgagttttttgatgctcaggaagttctgttatctccaagctcttcagaaaacgagatttctgatgatgactcatatgtcagtgacataagtgataatctttccttagataatctcagtaatgatttagataatgagagacagaccttggggcctgtccttgatagtggtcgggaagcgaagtcccggagaagaacgtgcctgccggcgccctgcccgagcagcagtaacatcagcctgtggaacatcctgaggaacaacatcgggaaggacctgtccaaggtggccatgccggtggagctgaacgagcccctgaacacgctgcagaggctctgcgaggagctggagtacagcgagctcctggacaaggccgcgcagattcccagccccctggaaaggatggtatatgtggcagcctttgccatatcagcgtatgcatctagctactaccgagctggaagcaagccatttaatccggttcttggagaaacatatgaatgtattcgggaggacaagggcttccagtttttttcagaacaggtcagccaccatccgcctatctctgcgtgtcatgctgagtctagaaattttgttttctggcaagatgtgagatggaaaaacaaattctggggcaaatccatggaaattgttccaattggcacaacccatgtgactctgccagtttttggggatcattttgagtggaacaaagtgacctcttgcatccataacatcttaagcgggcagaggtggattgagcactatggagagattgtcatcaagaacctgcatgatgattcctgctactgcaaagtgaattttataaaggcaaaatactggagcactaatgcccatgagattgaaggcacagtgtttgacaggagtggaaaagcggttcatcggctgtttgggaaatggcatgaaagcatctactgtggcggcggctcctcttctgcctgtgtatggagagcaaatcctatgccgaaaggctacgagcaatactatagcttcacacagtttgcgctggaattaaatgaaatggatccatcatcaaagtctttattgccacctactgacactcgatttaggccagaccagaggtttctagaggaagggaacttagaagaagctgaaatacaaaagcagaggattgaacaactgcagagagaaaggcggcgggtcttagaagaaaatcatgtggagcaccagcctcggtttttcaggaaatccgacgatgactcttgggtgagcaacggcacctatttggaacttagaaaagatcttggtttttccaaactggaccatcctgtcttatggtgaaaaagtaaagaagaaagataacattagtgtatttctcctgtgcttgccttctgaagtggcacaaacctgtgtttatatatttaaaagatactctaggatgatcacttgtgcttagcttagcattgtaactctttaagtctatattttcctcagtgcgtttctttacaatttcaaatgttaccctgattgtttatatgaatgtagaacaccttgacatttctttttatatataaactatttaataaaaatgaaagattg

SEQ ID NO: 163147 - DNA, 3219 bp, Homo sapiens
  Payload ID: 12151
  Gene Symbol: OSBPL3
  Gene Name: oxysterol binding protein-like 3
  Uniprot ID: Q9H4L5
  ENST ID: ENST00000409759
  CDS Start-End: 104-1924
tggataagagctaaaccacctgccactggggacttccatactctcggctcccttgtcatctgatggcattttgattgtctcgaggccaagtgacttgctgtccatgatgagtgatgagaagaaccttggtgtgtcccaaaaattggtatcaccttcaaggagcacaagtagctgctcttccaagcaaggaagtcgacaggacagctgggaagtggtggaaggactgaggggggagatgaattacacccaggagccaccagttcagaaaggatttttgctgaaaaagaggaagtggcccttaaaaggctggcataagagattcttctatctggacaaaggaatcttgaaatatgccaagagccaaaccgatatagagagagagaagctgcatggctgcattgatgtcgggctctcagtgatgtctgtaaagaagtcatcaaaatgcatagaccttgacaccgaggagcacatctaccatctgaaggtcaagtcagaagaagtctttgatgagtgggtatcgaaacttcgccaccacagaatgtatcgtcagaatgaaattgccatgtttccacatgaagttaaccactttttctcagggtccaccatcacagactcttcatctggggtgtttgactccatttcaagtaggaagcgtagcagtatatcaaagcagaatttatttcaaactggaagcaatgtatcattttcttgtggtggtgagacacgagttccattatggttacagtcttcagaggacatggaaaaatgctccaaagacctggcgcactgtcatgcctacctggtagaaatgagccagctcctgcaaagcatggacgtcctgcatcggacatactcggcaccagctatcaacgccatccagggtggatcttttgaaagtcccaaaaaggaaaaaagatcgcacaggaggtggcggtccagagctattggcaaagatgctaaaggaacactgcaggtcccgaaacctttttctggcccagtaagactacactcctccaatcctaatttgtcaacactagattttggagaagagaaaaattattctgatggctctgaaacctcatcagagttttctaaaatgcaagaagatctgtgtcatattgcccataaagtttacttcactttaaggtcagcttttaatatcatgtcagcggagagagagaaactgaagcagctgatggagcaggatgcctcctcctccccgtctgctcaggtcattggtctgaagaacgccctgtcatccgaaaactccagagatgaaaaccgagctctagttcatcagctttctaatgaaagtagactctccatcactgactccctttctgagttttttgatgctcaggaagttctgttatctccaagctcttcagaaaacgagatttctgatgatgactcatatgtcagtgacataagtgataatctttccttagataatctcagtaatgatttagataatgagagacagaccttggggcctgtccttgatagtggtcgggaagcgaagtcccggagaagaacgtgcctgccggcgccctgcccgagcagcagtaacatcagcctgtggaacatcctgaggaacaacatcgggaaggacctgtccaaggtggccatgccggtggagctgaacgagcccctgaacacgctgcagaggctctgcgaggagctggagtacagcgagctcctggacaaggccgcgcagattcccagccccctggaaaggatggtgaggagtcagccttcccttgccactgtccagcctcggtccccaagccacgaggccattcacggggcccatcagagagacagcccctgttccctccggtttcattttgattgttccgtaaacaggttcattactcagagctgtctggcttcctccgcctggctgtttccagtcaccttgtgaggatttggagacggggttggggtgcttctccgtggcacttggtgcctggggtagttctgttctgtgggtttgtgcttcctctttctccagaagccttctggctgattgttccgatgtgcccggctggaaaacatgtctttagggctgtctgcatgtttatttttacttccctgggtggacagaatttaatttctcgagctgtttttctcatccagggtatatgtggcagcctttgccatatcagcgtatgcatctagctactaccgagctggaagcaagccatttaatccggttcttggagaaacatatgaatgtattcgggaggacaagggcttccagtttttttcagaacaggtcagccaccatccgcctatctctgcgtgtcatgctgagtctagaaattttgttttctggcaagatgtgagatggaaaaacaaattctggggcaaatccatggaaattgttccaattggcacaacccatgtgactctgccagtttttggggatcattttgagtggaacaaagtgacctcttgcatccataacatcttaagcgggcagaggtggattgagcactatggagagattgtcatcaagaacctgcatgatgattcctgctactgcaaagtgaattttataaaggcaaaatactggagcactaatgcccatgagattgaaggcacagtgtttgacaggagtggaaaagcggttcatcggctgtttgggaaatggcatgaaagcatctactgtggcggcggctcctcttctgcctgtgtatggagagcaaatcctatgccgaaaggctacgagcaatactatagcttcacacagtttgcgctggaattaaatgaaatggatccatcatcaaagtctttattgccacctactgacactcgatttaggccagaccagaggtttctagaggaagggaacttagaagaagctgaaatacaaaagcagaggattgaacaactgcagagagaaaggcggcgggtcttagaagaaaatcatgtggagcaccagcctcggtttttcaggaaatccgacgatgactcttgggtgagcaacggcacctatttggaacttagaaaagatcttggtttttccaaactggaccatcctgtcttatggtgaaaaagtaaagaagaaagataacattagtgtatttctcctgtgcttgccttctgaagtggcacaaacctgtgtttatatatttaaaagatactctaggatgatcacttgtgcttagcttagcattgtaactctttaagtctatattttcctcagtgcgtttc

SEQ ID NO: 163148 - DNA, 3490 bp, Homo sapiens
  Payload ID: 12151
  Gene Symbol: OSBPL3
  Gene Name: oxysterol binding protein-like 3
  Uniprot ID: Q9H4L5
  ENST ID: ENST00000409863
  CDS Start-End: 104-1939
tggataagagctaaaccacctgccactggggacttccatactctcggctcccttgtcatctgatggcattttgattgtctcgaggccaagtgacttgctgtccatgatgagtgatgagaagaaccttggtgtgtcccaaaaattggtatcaccttcaaggagcacaagtagctgctcttccaagcaaggaagtcgacaggacagctgggaagtggtggaaggactgaggggggagatgaattacacccaggagccaccagttcagaaaggatttttgctgaaaaagaggaagtggcccttaaaaggctggcataagagattcttctatctggacaaaggaatcttgaaatatgccaagagccaaaccgatatagagagagagaagctgcatggctgcattgatgtcgggctctcagtgatgtctgtaaagaagtcatcaaaatgcatagaccttgacaccgaggagcacatctaccatctgaaggtcaagtcagaagaagtctttgatgagtgggtatcgaaacttcgccaccacagaatgtatcgtcagaatgaaattgccatgtttccacatgaagttaaccactttttctcagggtccaccatcacagactcttcatctggggtgtttgactccatttcaagtaggaagcgtagcagtatatcaaagcagaatttatttcaaactggaagcaatgtatcattttcttgtggtggtgagacacgagttccattatggttacagtcttcagaggacatggaaaaatgctccaaagacctggcgcactgtcatgcctacctggtagaaatgagccagctcctgcaaagcatggacgtcctgcatcggacatactcggcaccagctatcaacgccatccaggtcccgaaacctttttctggcccagtaagactacactcctccaatcctaatttgtcaacactagattttggagaagagaaaaattattctgatggctctgaaacctcatcagagttttctaaaatgcaagaagatctgtgtcatattgcccataaagtttacttcactttaaggtcagcttttaatatcatgtcagcggagagagagaaactgaagcagctgatggagcaggatgcctcctcctccccgtctgctcaggtcattggtctgaagaacgccctgtcatccgccctagcacaaaacacagatcttaaagaacgcttacgcagaatccatgccgagtctctgctcctcgactcccccgctgtcgccaagtcgggtgacaatctggcagaggaaaactccagagatgaaaaccgagctctagttcatcagctttctaatgaaagtagactctccatcactgactccctttctgagttttttgatgctcaggaagttctgttatctccaagctcttcagaaaacgagatttctgatgatgactcatatgtcagtgacataagtgataatctttccttagataatctcagtaatgatttagataatgagagacagaccttggggcctgtccttgatagtggtcgggaagcgaagtcccggagaagaacgtgcctgccggcgccctgcccgagcagcagtaacatcagcctgtggaacatcctgaggaacaacatcgggaaggacctgtccaaggtggccatgccggtggagctgaacgagcccctgaacacgctgcagaggctctgcgaggagctggagtacagcgagctcctggacaaggccgcgcagattcccagccccctggaaaggatggtgaggagtcagccttcccttgccactgtccagcctcggtccccaagccacgaggccattcacggggcccatcagagagacagcccctgttccctccggtttcattttgattgttccgtaaacaggttcattactcagagctgtctggcttcctccgcctggctgtttccagtcaccttgtgaggatttggagacggggttggggtgcttctccgtggcacttggtgcctggggtagttctgttctgtgggtttgtgcttcctctttctccagaagccttctggctgattgttccgatgtgcccggctggaaaacatgtctttagggctgtctgcatgtttatttttacttccctgggtggacagaatttaatttctcgagctgtttttctcatccagggtatatgtggcagcctttgccatatcagcgtatgcatctagctactaccgagctggaagcaagccatttaatccggttcttggagaaacatatgaatgtattcgggaggacaagggcttccagtttttttcagaacaggtcagccaccatccgcctatctctgcgtgtcatgctgagtctagaaattttgttttctggcaagatgtgagatggaaaaacaaattctggggcaaatccatggaaattgttccaattggcacaacccatgtgactctgccagtttttggggatcattttgagtggaacaaagtgacctcttgcatccataacatcttaagcgggcagaggtggattgagcactatggagagattgtcatcaagaacctgcatgatgattcctgctactgcaaagtgaattttataaaggcaaaatactggagcactaatgcccatgagattgaaggcacagtgtttgacaggagtggaaaagcggttcatcggctgtttgggaaatggcatgaaagcatctactgtggcggcggctcctcttctgcctgtgtatggagagcaaatcctatgccgaaaggctacgagcaatactatagcttcacacagtttgcgctggaattaaatgaaatggatccatcatcaaagtctttattgccacctactgacactcgatttaggccagaccagaggtttctagaggaagggaacttagaagaagctgaaatacaaaagcagaggattgaacaactgcagagagaaaggcggcgggtcttagaagaaaatcatgtggagcaccagcctcggtttttcaggaaatccgacgatgactcttgggtgagcaacggcacctatttggaacttagaaaagatcttggtttttccaaactggaccatcctgtcttatggtgaaaaagtaaagaagaaagataacattagtgtatttctcctgtgcttgccttctgaagtggcacaaacctgtgtttatatatttaaaagatactctaggatgatcacttgtgcttagcttagcattgtaactctttaagtctatattttcctcagtgcgtttctttacaatttcaaatgttaccctgattgtttatatgaatgtagaacaccttgacatttctttttatatataaactatttaataaaaatgaaagattgaatgttcatgtgtgggttaaaaaaagaagctttaacactaattttccaaaggttagggaagattccaattaaatttatgccttataaaattatgttgtagaaaaaaaatcaacctctcccaggtgcattaagaaataagaattcccagggttactcacc

SEQ ID NO: 163149 - DNA, 3344 bp, Homo sapiens
  Payload ID: 12151
  Gene Symbol: OSBPL3
  Gene Name: oxysterol binding protein-like 3
  Uniprot ID: Q9H4L5
  ENST ID: ENST00000409452
  CDS Start-End: 104-2032
tggataagagctaaaccacctgccactggggacttccatactctcggctcccttgtcatctgatggcattttgattgtctcgaggccaagtgacttgctgtccatgatgagtgatgagaagaaccttggtgtgtcccaaaaattggtatcaccttcaaggagcacaagtagctgctcttccaagcaaggaagtcgacaggacagctgggaagtggtggaaggactgaggggggagatgaattacacccaggagccaccagttcagaaaggatttttgctgaaaaagaggaagtggcccttaaaaggctggcataagagattcttctatctggacaaaggaatcttgaaatatgccaagagccaaaccgatatagagagagagaagctgcatggctgcattgatgtcgggctctcagtgatgtctgtaaagaagtcatcaaaatgcatagaccttgacaccgaggagcacatctaccatctgaaggtcaagtcagaagaagtctttgatgagtgggtatcgaaacttcgccaccacagaatgtatcgtcagaatgaaattgccatgtttccacatgaagttaaccactttttctcagggtccaccatcacagactcttcatctggggtgtttgactccatttcaagtaggaagcgtagcagtatatcaaagcagaatttatttcaaactggaagcaatgtatcattttcttgtggtggtgagacacgagttccattatggttacagtcttcagaggacatggaaaaatgctccaaagacctggcgcactgtcatgcctacctggtagaaatgagccagctcctgcaaagcatggacgtcctgcatcggacatactcggcaccagctatcaacgccatccagggtggatcttttgaaagtcccaaaaaggaaaaaagatcgcacaggaggtggcggtccagagctattggcaaagatgctaaaggaacactgcaggtcccgaaacctttttctggcccagtaagactacactcctccaatcctaatttgtcaacactagattttggagaagagaaaaattattctgatggctctgaaacctcatcagagttttctaaaatgcaagaagatctgtgtcatattgcccataaagtttacttcactttaaggtcagcttttaatatcatgtcagcggagagagagaaactgaagcagctgatggagcaggatgcctcctcctccccgtctgctcaggtcattggtctgaagaacgccctgtcatccgccctagcacaaaacacagatcttaaagaacgcttacgcagaatccatgccgagtctctgctcctcgactcccccgctgtcgccaagtcgggtgacaatctggcagaggaaaactccagagatgaaaaccgagctctagttcatcagctttctaatgaaagtagactctccatcactgactccctttctgagttttttgatgctcaggaagttctgttatctccaagctcttcagaaaacgagatttctgatgatgactcatatgtcagtgacataagtgataatctttccttagataatctcagtaatgatttagataatgagagacagaccttggggcctgtccttgatagtggtcgggaagcgaagtcccggagaagaacgtgcctgccggcgccctgcccgagcagcagtaacatcagcctgtggaacatcctgaggaacaacatcgggaaggacctgtccaaggtggccatgccggtggagctgaacgagcccctgaacacgctgcagaggctctgcgaggagctggagtacagcgagctcctggacaaggccgcgcagattcccagccccctggaaaggatggtgaggagtcagccttcccttgccactgtccagcctcggtccccaagccacgaggccattcacggggcccatcagagagacagcccctgttccctccggtttcattttgattgttccgtaaacaggttcattactcagagctgtctggcttcctccgcctggctgtttccagtcaccttgtgaggatttggagacggggttggggtgcttctccgtggcacttggtgcctggggtagttctgttctgtgggtttgtgcttcctctttctccagaagccttctggctgattgttccgatgtgcccggctggaaaacatgtctttagggctgtctgcatgtttatttttacttccctgggtggacagaatttaatttctcgagctgtttttctcatccagggtatatgtggcagcctttgccatatcagcgtatgcatctagctactaccgagctggaagcaagccatttaatccggttcttggagaaacatatgaatgtattcgggaggacaagggcttccagtttttttcagaacaggtcagccaccatccgcctatctctgcgtgtcatgctgagtctagaaattttgttttctggcaagatgtgagatggaaaaacaaattctggggcaaatccatggaaattgttccaattggcacaacccatgtgactctgccagtttttggggatcattttgagtggaacaaagtgacctcttgcatccataacatcttaagcgggcagaggtggattgagcactatggagagattgtcatcaagaacctgcatgatgattcctgctactgcaaagtgaattttataaaggcaaaatactggagcactaatgcccatgagattgaaggcacagtgtttgacaggagtggaaaagcggttcatcggctgtttgggaaatggcatgaaagcatctactgtggcggcggctcctcttctgcctgtgtatggagagcaaatcctatgccgaaaggctacgagcaatactatagcttcacacagtttgcgctggaattaaatgaaatggatccatcatcaaagtctttattgccacctactgacactcgatttaggccagaccagaggtttctagaggaagggaacttagaagaagctgaaatacaaaagcagaggattgaacaactgcagagagaaaggcggcgggtcttagaagaaaatcatgtggagcaccagcctcggtttttcaggaaatccgacgatgactcttgggtgagcaacggcacctatttggaacttagaaaagatcttggtttttccaaactggaccatcctgtcttatggtgaaaaagtaaagaagaaagataacattagtgtatttctcctgtgcttgccttctgaagtggcacaaacctgtgtttatatatttaaaagatactctaggatgatcacttgtgcttagcttagcattgtaactctttaagtctatattttcctcagtgcgtttctttacaatttcaaatgt

SEQ ID NO: 163150 - DNA, 2614 bp, Homo sapiens
  Payload ID: 12151
  Gene Symbol: OSBPL3
  Gene Name: oxysterol binding protein-like 3
  Uniprot ID: Q9H4L5
  ENST ID: ENST00000409069
  CDS Start-End: 104-2566
tggataagagctaaaccacctgccactggggacttccatactctcggctcccttgtcatctgatggcattttgattgtctcgaggccaagtgacttgctgtccatgatgagtgatgagaagaaccttggtgtgtcccaaaaattggtatcaccttcaaggagcacaagtagctgctcttccaagcaaggaagtcgacaggacagctgggaagtggtggaaggactgaggggggagatgaattacacccaggagccaccagttcagaaaggatttttgctgaaaaagaggaagtggcccttaaaaggctggcataagagattcttctatctggacaaaggaatcttgaaatatgccaagagccaaaccgatatagagagagagaagctgcatggctgcattgatgtcgggctctcagtgatgtctgtaaagaagtcatcaaaatgcatagaccttgacaccgaggagcacatctaccatctgaaggtcaagtcagaagaagtctttgatgagtgggtatcgaaacttcgccaccacagaatgtatcgtcagaatgaaattgccatgtttccacatgaagttaaccactttttctcagggtccaccatcacagactcttcatctggggtgtttgactccatttcaagtaggaagcgtagcagtatatcaaagcagaatttatttcaaactggaagcaatgtatcattttcttgtggtggtgagacacgagttccattatggttacagtcttcagaggacatggaaaaatgctccaaagacctggcgcactgtcatgcctacctggtagaaatgagccagctcctgcaaagcatggacgtcctgcatcggacatactcggcaccagctatcaacgccatccaggtcccgaaacctttttctggcccagtaagactacactcctccaatcctaatttgtcaacactagattttggagaagagaaaaattattctgatggctctgaaacctcatcagagttttctaaaatgcaagaagatctgtgtcatattgcccataaagtttacttcactttaaggtcagcttttaatatcatgtcagcggagagagagaaactgaagcagctgatggagcaggatgcctcctcctccccgtctgctcaggtcattggtctgaagaacgccctgtcatccgaaaactccagagatgaaaaccgagctctagttcatcagctttctaatgaaagtagactctccatcactgactccctttctgagttttttgatgctcaggaagttctgttatctccaagctcttcagaaaacgagatttctgatgatgactcatatgtcagtgacataagtgataatctttccttagataatctcagtaatgatttagataatgagagacagaccttggggcctgtccttgatagtggtcgggaagcgaagtcccggagaagaacgtgcctgccggcgccctgcccgagcagcagtaacatcagcctgtggaacatcctgaggaacaacatcgggaaggacctgtccaaggtggccatgccggtggagctgaacgagcccctgaacacgctgcagaggctctgcgaggagctggagtacagcgagctcctggacaaggccgcgcagattcccagccccctggaaaggatggtatatgtggcagcctttgccatatcagcgtatgcatctagctactaccgagctggaagcaagccatttaatccggttcttggagaaacatatgaatgtattcgggaggacaagggcttccagtttttttcagaacaggtcagccaccatccgcctatctctgcgtgtcatgctgagtctagaaattttgttttctggcaagatgtgagatggaaaaacaaattctggggcaaatccatggaaattgttccaattggcacaacccatgtgactctgccagtttttggggatcattttgagtggaacaaagtgacctcttgcatccataacatcttaagcgggcagaggtggattgagcactatggagagattgtcatcaagaacctgcatgatgattcctgctactgcaaagtgaattttataaaggcaaaatactggagcactaatgcccatgagattgaaggcacagtgtttgacaggagtggaaaagcggttcatcggctgtttgggaaatggcatgaaagcatctactgtggcggcggctcctcttctgcctgtgtatggagagcaaatcctatgccgaaaggctacgagcaatactatagcttcacacagtttgcgctggaattaaatgaaatggatccatcatcaaagtctttattgccacctactgacactcgatttaggccagaccagaggtttctagaggaagggaacttagaagaagctgaaatacaaaagcagaggattgaacaactgcagagagaaaggcggcgggtcttagaagaaaatcatgtggagcaccagcctcggtttttcaggaaatccgacgatgactcttgggtgagcaacggcacctatttggaacttagaaaagatcttggtttttccaaactggaccatcctgtcttatggtgaaaaagtaaagaagaaagataacattagtgtatttctcctgtgcttgcc

SEQ ID NO: 163151 - DNA, 3088 bp, Homo sapiens
  Payload ID: 12151
  Gene Symbol: OSBPL3
  Gene Name: oxysterol binding protein-like 3
  Uniprot ID: Q9H4L5
  ENST ID: ENST00000409555
  CDS Start-End: 104-1831
tggataagagctaaaccacctgccactggggacttccatactctcggctcccttgtcatctgatggcattttgattgtctcgaggccaagtgacttgctgtccatgatgagtgatgagaagaaccttggtgtgtcccaaaaattggtatcaccttcaaggagcacaagtagctgctcttccaagcaaggaagtcgacaggacagctgggaagtggtggaaggactgaggggggagatgaattacacccaggagccaccagttcagaaaggatttttgctgaaaaagaggaagtggcccttaaaaggctggcataagagattcttctatctggacaaaggaatcttgaaatatgccaagagccaaaccgatatagagagagagaagctgcatggctgcattgatgtcgggctctcagtgatgtctgtaaagaagtcatcaaaatgcatagaccttgacaccgaggagcacatctaccatctgaaggtcaagtcagaagaagtctttgatgagtgggtatcgaaacttcgccaccacagaatgtatcgtcagaatgaaattgccatgtttccacatgaagttaaccactttttctcagggtccaccatcacagactcttcatctggggtgtttgactccatttcaagtaggaagcgtagcagtatatcaaagcagaatttatttcaaactggaagcaatgtatcattttcttgtggtggtgagacacgagttccattatggttacagtcttcagaggacatggaaaaatgctccaaagacctggcgcactgtcatgcctacctggtagaaatgagccagctcctgcaaagcatggacgtcctgcatcggacatactcggcaccagctatcaacgccatccaggtcccgaaacctttttctggcccagtaagactacactcctccaatcctaatttgtcaacactagattttggagaagagaaaaattattctgatggctctgaaacctcatcagagttttctaaaatgcaagaagatctgtgtcatattgcccataaagtttacttcactttaaggtcagcttttaatatcatgtcagcggagagagagaaactgaagcagctgatggagcaggatgcctcctcctccccgtctgctcaggtcattggtctgaagaacgccctgtcatccgaaaactccagagatgaaaaccgagctctagttcatcagctttctaatgaaagtagactctccatcactgactccctttctgagttttttgatgctcaggaagttctgttatctccaagctcttcagaaaacgagatttctgatgatgactcatatgtcagtgacataagtgataatctttccttagataatctcagtaatgatttagataatgagagacagaccttggggcctgtccttgatagtggtcgggaagcgaagtcccggagaagaacgtgcctgccggcgccctgcccgagcagcagtaacatcagcctgtggaacatcctgaggaacaacatcgggaaggacctgtccaaggtggccatgccggtggagctgaacgagcccctgaacacgctgcagaggctctgcgaggagctggagtacagcgagctcctggacaaggccgcgcagattcccagccccctggaaaggatggtgaggagtcagccttcccttgccactgtccagcctcggtccccaagccacgaggccattcacggggcccatcagagagacagcccctgttccctccggtttcattttgattgttccgtaaacaggttcattactcagagctgtctggcttcctccgcctggctgtttccagtcaccttgtgaggatttggagacggggttggggtgcttctccgtggcacttggtgcctggggtagttctgttctgtgggtttgtgcttcctctttctccagaagccttctggctgattgttccgatgtgcccggctggaaaacatgtctttagggctgtctgcatgtttatttttacttccctgggtggacagaatttaatttctcgagctgtttttctcatccagggtatatgtggcagcctttgccatatcagcgtatgcatctagctactaccgagctggaagcaagccatttaatccggttcttggagaaacatatgaatgtattcgggaggacaagggcttccagtttttttcagaacaggtcagccaccatccgcctatctctgcgtgtcatgctgagtctagaaattttgttttctggcaagatgtgagatggaaaaacaaattctggggcaaatccatggaaattgttccaattggcacaacccatgtgactctgccagtttttggggatcattttgagtggaacaaagtgacctcttgcatccataacatcttaagcgggcagaggtggattgagcactatggagagattgtcatcaagaacctgcatgatgattcctgctactgcaaagtgaattttataaaggcaaaatactggagcactaatgcccatgagattgaaggcacagtgtttgacaggagtggaaaagcggttcatcggctgtttgggaaatggcatgaaagcatctactgtggcggcggctcctcttctgcctgtgtatggagagcaaatcctatgccgaaaggctacgagcaatactatagcttcacacagtttgcgctggaattaaatgaaatggatccatcatcaaagtctttattgccacctactgacactcgatttaggccagaccagaggtttctagaggaagggaacttagaagaagctgaaatacaaaagcagaggattgaacaactgcagagagaaaggcggcgggtcttagaagaaaatcatgtggagcaccagcctcggtttttcaggaaatccgacgatgactcttgggtgagcaacggcacctatttggaacttagaaaagatcttggtttttccaaactggaccatcctgtcttatggtgaaaaagtaaagaagaaagataacattagtgtatttctcctgtgcttgccttctgaagtggcacaaacctgtgtttatatatttaaaagatactctaggatgatcacttgtgcttagcttagcat

SEQ ID NO: 163152 - DNA, 540 bp, Homo sapiens
  Payload ID: 12151
  Gene Symbol: OSBPL3
  Gene Name: oxysterol binding protein-like 3
  ENST ID: ENST00000441059
  CDS Start-End: 274-540
attatgtgcgtcgaggataagccaacctttataggtaagagtgctagtcattttatggactcataggatcactgaatttgaaagctagacaggatcgtcaggctgaaggaatcttggtaaatgggttttagggtttcctttgggccacccaaaatgttttttaaatactttggataagagctaaaccacctgccactggggacttccatactctcggctcccttgtcatctgatggcattttgattgtctcgaggccaagtgacttgctgtccatgatgagtgatgagaagaaccttggtgtgtcccaaaaattggtatcaccttcaaggagcacaagtagctgctcttccaagcaaggaagtcgacaggacagctgggaagtggtggaaggactgaggggggagatgaattacacccaggagccaccagttcagaaaggatttttgctgaaaaagaggaagtggcccttaaaaggctggcataagagattcttctatctggacaaaggaatcttgaaatatgccaagagccaaaccgat

SEQ ID NO: 163153 - DNA, 534 bp, Homo sapiens
  Payload ID: 12151
  Gene Symbol: OSBPL3
  Gene Name: oxysterol binding protein-like 3
  ENST ID: ENST00000415162
  CDS Start-End: 197-534
acctgtgcttgtcattatgtgcgtcgaggataagccaacctttataggttttagggtttcctttgggccacccaaaatgttttttaaatactttggataagagctaaaccacctgccactggggacttccatactctcggctcccttgtcatctgatggcattttgattgtctcgaggccaagtgacttgctgtccatgatgagtgatgagaagaaccttggtgtgtcccaaaaattggtatcaccttcaaggagcacaagtagctgctcttccaagcaaggaagtcgacaggacagctgggaagtggtggaaggactgaggggggagatgaattacacccaggagccaccagttcagaaaggatttttgctgaaaaagaggaagtggcccttaaaaggctggcataagagattcttctatctggacaaaggaatcttgaaatatgccaagagccaaaccgatatagagagagagaagctgcatggctgcattgatgtcgggctctcagtgatgtctgtaaagaagtcatcaaa

SEQ ID NO: 163154 - DNA, 568 bp, Homo sapiens
  Payload ID: 12151
  Gene Symbol: OSBPL3
  Gene Name: oxysterol binding protein-like 3
  ENST ID: ENST00000415952
  CDS Start-End: 386-568
agacatttcgcgagggggatggttccagaaagcgaagatctgagcgtggtgaatgaaatgtgaacagaatagctccggaaagagtctcagaaaccttgaattggggtcagtttggagactgaaaatgcgtcgagcgctgcaggtggtggttggcagggggatttaacactgtggagcccttactccgtcccaggcgctgagcccagcgagccacgcgcggtgcccagctcggtgaggttttagggtttcctttgggccacccaaaatgttttttaaatactttggataagagctaaaccacctgccactggggacttccatactctcggctcccttgtcatctgatggcattttgattgtctcgaggccaagtgacttgctgtccatgatgagtgatgagaagaaccttggtgtgtcccaaaaattggtatcaccttcaaggagcacaagtagctgctcttccaagcaaggaagtcgacaggacagctgggaagtggtggaaggactgaggggggagatgaattacacccaggagccaccagttcagaaaggatttttgctgaaaaag

SEQ ID NO: 163155 - DNA, 3889 bp, Homo sapiens
  Payload ID: 12152
  Gene Symbol: OSBPL5
  Gene Name: oxysterol binding protein-like 5
  Uniprot ID: Q9H0X9
  ENST ID: ENST00000263650
  CDS Start-End: 161-2800
tcctccctccgccgcgccctcgctccgcctcgcgcggggggaccatctgctggcatttcctgcagccaggcccgcgccgccagtggagcccccgcgcgcccggccggcccggagcaccgagctcgcggcacggtaggagaagcccccgagcgcccacagcatgaaggaggaggccttcctccggcgccgcttctccctgtgtccaccttcctccacccctcagaaagtcgacccccggaagctcacccggaacttgctcctcagcggagacaatgagctctacccactcagcccagggaaggacatggagcccaacggcccgtcgctgcccagggatgaagggcccccgaccccaagctctgccacgaaggtgccaccggcagagtacaggctgtgcaacgggtcagacaaggaatgtgtgtcccccaccgccagggtcaccaagaaggagactctcaaggcgcagaaggagaactaccggcaggagaagaagcgcgccacacggcagctgctcagcgctctgacagaccccagcgtggtcatcatggctgacagcctgaagatccgcggcaccctgaagagctggaccaagctgtggtgcgtgctgaagccgggggtgctgctcatctacaagacgcccaaggtgggccagtgggtgggcacggtgctgctgcactgctgcgagctcatcgagcggccctccaagaaggacggcttctgcttcaagctcttccacccgctggatcagtccgtctgggccgtgaagggccccaaaggtgagagcgtgggctccatcacacagcccctgcccagcagctacctgatcttcagggccgcctccgagtcagatggtcgctgctggctggacgccctggagctggccctgcgctgctctagcctactgagactgggcacctgcaagccgggccgagacggggagccagggacctcgccagacgcatcaccctcatcgctctgtgggctgccagcctcagccaccgtccacccagaccaagacctgttcccactgaacgggtcttccctggagaacgatgcattctcagacaagtcggagagagagaaccctgaggagtcagataccgagacccaggaccatagccggaagacggagagtggcagcgaccagtcagagacccctggggccccggtgcggagagggaccacctatgtggagcaggtccaggaggagctgggggagctgggcgaggcgtcccaggtggagacagtgtcagaggagaacaagagtctgatgtggaccctgctgaagcagctacggccaggcatggacctgtcccgcgtggtgctacccacgttcgtactggagccgcgctccttcctgaacaagctctccgactactactaccacgcagacctgctctccagggctgcggtggaggaggatgcctacagccgcatgaagctggtgctgcggtggtacctgtctggcttctacaagaagcccaagggaatcaagaagccgtacaaccccatcctgggggagaccttccgctgctgctggttccacccgcagactgacagccgcacattctacatagcagagcaggtgtcccaccacccgcccgtgtctgccttccacgtcagcaaccggaaggacggcttctgcatcagtggcagcatcacagccaagtccaggttttatgggaactcgctgtcggcgctgctggacggcaaagccacgctcaccttcctgaaccgagccgaggattacacccttaccatgccctacgcccactgcaaaggaatcctgtatggcacgatgaccctggagctgggtgggaaggtcaccatcgagtgtgcgaagaacaacttccaggcccagctggaattcaaactcaagcccttcttcgggggtagcaccagcatcaaccagatctcgggaaagatcacgtcgggagaggaagtcctggcgagcctcagtggccactgggacagggacgtgtttatcaaggaggaagggagcggaagcagtgcgcttttctggaccccgagcggggaggtccgcagacagaggctgaggcagcacacggtgccgctggaggagcagacggagctggagtccgagaggctctggcagcacgtcaccagggccatcagcaagggcgaccagcacagggccacacaggagaagtttgcactggaggaggcacagcggcagcgggcccgtgagcggcaggagagcctcatgccctggaagccgcagctgttccacctggaccccatcacccaggagtggcactaccgatacgaggaccacagcccctgggaccccctgaaggacatcgcccagtttgagcaagacgggatcctgcggaccttgcagcaggaggccgtggcccgccagaccaccttcctgggcagcccagggcccaggcacgagaggtctggcccagaccagcggcttcgcaaggccagcgaccagccctccggccacagccaggccacggagagcagcggatccacgcctgagtcctgcccagagctctcagacgaggagcaggatggtgactttgtccctggcggtgagagcccatgccctcggtgcaggaaggaggcgcggcggctgcaggccctgcacgaggccatcctctccatccgagaggcccagcaggagctgcacaggcacctctcggccatgctgagctccacggcacgggcagcacaggcaccgaccccaggcctcctgcagagcccccgatcctggttcctgctctgcgtgttcctggcgtgtcagctgttcattaaccacatcctcaaataggagccctgagggcagagctcctggccggtcctgagccctccctcccaggcacccagcactttaagcctgctccatggaggcagagaggcccggcaagcacagccactgtgacggggagtccaggcgcaggagggacccggggccacaaggcgctgcgggcccaggtgtgctgggcccctctcaggggcactggcctctctgcagggccttccgcccagcgctggccttaatgctaaagccaaatgcagcttctgctgtgcgacgcactcctggccatcttgccgtgtcaccccctgtccggcctccacttgccatgggggatggatggatttagggtgggagggcctgtgggggccctggacagtcacaccccagcagcagtgagtgggcaggtttggaggagccccgagtggcccaggagtccccccacacacagatgcataggcctgccttccggagaccctgtccacattgccgggaccaccctggtggggccactggtgggtgccagggacaggttagggccactctggggaaggcattttggttttttattccacgctgtgctgtttggatgggagccccacagaggcaggtcctggaaccaccccacccccacacctggacgctcgctctggtgggggcacacgcaggtggaggtggttgtgggtgcaggtgtgtgcaggggtgtggggggcgcaggggtgtggcttagctggccccgcacccaggccggggaggctcaagttcgccactttactcagaccgatgcacagtcttcccattttacacttttttaataaacataattgcaatattttaggtgggctgcgagctgcagtcagccttcacgtctggcctcagtccccgtgtcagtgccgctctgcgtgtgcgtgtgcgcgtgtgtgagcctctacacatatatatacgtacagagccttaaaccacatcgtggcggtgccgtctgagctgtagcgggtggctttgtttccagtttttgtacccgtgtccttgtctcccctcctcccccatctggggatgtgtctgtgttccacaccttgaaataaacagacacatacgtgttctctt

SEQ ID NO: 163156 - DNA, 2798 bp, Homo sapiens
  Payload ID: 12152
  Gene Symbol: OSBPL5
  Gene Name: oxysterol binding protein-like 5
  Uniprot ID: Q9H0X9
  ENST ID: ENST00000348039
  CDS Start-End: 159-2594
ctccctccgccgcgccctcgctccgcctcgcgcggggggaccatctgctggcatttcctgcagccaggcccgcgccgccagtggagcccccgcgcgcccggccggcccggagcaccgagctcgcggcacggtaggagaagcccccgagcgcccacagcatgaaggaggaggccttcctccggcgccgcttctccctgtgtccaccttcctccacccctcagaaagtcgacccccggaagctcacccggaacttgctcctcagcggagacaatgagctctacccactcagcccagggaaggacatggagcccaacggcccgtcgctgcccagggatgaagggcccccgaccccaagctctgccacgaaggtgccaccggcagagtacaggctgtgcaacgggtcagacaaggaatgtgtgtcccccaccgccagggtcaccaagaaggagactctcaaggcgcagaaggagaactaccggcaggagaagaagcgcgccacacggcagctgctcagcgctctgacagaccccagcgtggtcatcatggctgacagcctgaagggccccaaaggtgagagcgtgggctccatcacacagcccctgcccagcagctacctgatcttcagggccgcctccgagtcagatggtcgctgctggctggacgccctggagctggccctgcgctgctctagcctactgagactgggcacctgcaagccgggccgagacggggagccagggacctcgccagacgcatcaccctcatcgctctgtgggctgccagcctcagccaccgtccacccagaccaagacctgttcccactgaacgggtcttccctggagaacgatgcattctcagacaagtcggagagagagaaccctgaggagtcagataccgagacccaggaccatagccggaagacggagagtggcagcgaccagtcagagacccctggggccccggtgcggagagggaccacctatgtggagcaggtccaggaggagctgggggagctgggcgaggcgtcccaggtggagacagtgtcagaggagaacaagagtctgatgtggaccctgctgaagcagctacggccaggcatggacctgtcccgcgtggtgctacccacgttcgtactggagccgcgctccttcctgaacaagctctccgactactactaccacgcagacctgctctccagggctgcggtggaggaggatgcctacagccgcatgaagctggtgctgcggtggtacctgtctggcttctacaagaagcccaagggaatcaagaagccgtacaaccccatcctgggggagaccttccgctgctgctggttccacccgcagactgacagccgcacattctacatagcagagcaggtgtcccaccacccgcccgtgtctgccttccacgtcagcaaccggaaggacggcttctgcatcagtggcagcatcacagccaagtccaggttttatgggaactcgctgtcggcgctgctggacggcaaagccacgctcaccttcctgaaccgagccgaggattacacccttaccatgccctacgcccactgcaaaggaatcctgtatggcacgatgaccctggagctgggtgggaaggtcaccatcgagtgtgcgaagaacaacttccaggcccagctggaattcaaactcaagcccttcttcgggggtagcaccagcatcaaccagatctcgggaaagatcacgtcgggagaggaagtcctggcgagcctcagtggccactgggacagggacgtgtttatcaaggaggaagggagcggaagcagtgcgcttttctggaccccgagcggggaggtccgcagacagaggctgaggcagcacacggtgccgctggaggagcagacggagctggagtccgagaggctctggcagcacgtcaccagggccatcagcaagggcgaccagcacagggccacacaggagaagtttgcactggaggaggcacagcggcagcgggcccgtgagcggcaggagagcctcatgccctggaagccgcagctgttccacctggaccccatcacccaggagtggcactaccgatacgaggaccacagcccctgggaccccctgaaggacatcgcccagtttgagcaagacgggatcctgcggaccttgcagcaggaggccgtggcccgccagaccaccttcctgggcagcccagggcccaggcacgagaggtctggcccagaccagcggcttcgcaaggccagcgaccagccctccggccacagccaggccacggagagcagcggatccacgcctgagtcctgcccagagctctcagacgaggagcaggatggtgactttgtccctggcggtgagagcccatgccctcggtgcaggaaggaggcgcggcggctgcaggccctgcacgaggccatcctctccatccgagaggcccagcaggagctgcacaggcacctctcggccatgctgagctccacggcacgggcagcacaggcaccgaccccaggcctcctgcagagcccccgatcctggttcctgctctgcgtgttcctggcgtgtcagctgttcattaaccacatcctcaaataggagccctgagggcagagctcctggccggtcctgagccctccctcccaggcacccagcactttaagcctgctccatggaggcagagaggcccggcaagcacagccactgtgacggggagtccaggcgcaggagggacccggggccacaaggcgctgcgggcccaggtgtgctgggcccctctcaggggcactggcctctctgcag

SEQ ID NO: 163157 - DNA, 3619 bp, Homo sapiens
  Payload ID: 12152
  Gene Symbol: OSBPL5
  Gene Name: oxysterol binding protein-like 5
  Uniprot ID: Q9H0X9
  ENST ID: ENST00000389989
  CDS Start-End: 100-2535
atttcctgcagccaggcccgcgccgccagtggagcccccgcgcgcccggccggcccggagcaccgagctcgcggcacgaagcccccgagcgcccacagcatgaaggaggaggccttcctccggcgccgcttctccctgtgtccaccttcctccacccctcagaaagtcgacccccggaagctcacccggaacttgctcctcagcggagacaatgagctctacccactcagcccagggaaggacatggagcccaacggcccgtcgctgcccagggatgaagggcccccgaccccaagctctgccacgaaggtgccaccggcagagtacaggctgtgcaacgggtcagacaaggaatgtgtgtcccccaccgccagggtcaccaagaaggagactctcaaggcgcagaaggagaactaccggcaggagaagaagcgcgccacacggcagctgctcagcgctctgacagaccccagcgtggtcatcatggctgacagcctgaagggccccaaaggtgagagcgtgggctccatcacacagcccctgcccagcagctacctgatcttcagggccgcctccgagtcagatggtcgctgctggctggacgccctggagctggccctgcgctgctctagcctactgagactgggcacctgcaagccgggccgagacggggagccagggacctcgccagacgcatcaccctcatcgctctgtgggctgccagcctcagccaccgtccacccagaccaagacctgttcccactgaacgggtcttccctggagaacgatgcattctcagacaagtcggagagagagaaccctgaggagtcagataccgagacccaggaccatagccggaagacggagagtggcagcgaccagtcagagacccctggggccccggtgcggagagggaccacctatgtggagcaggtccaggaggagctgggggagctgggcgaggcgtcccaggtggagacagtgtcagaggagaacaagagtctgatgtggaccctgctgaagcagctacggccaggcatggacctgtcccgcgtggtgctacccacgttcgtactggagccgcgctccttcctgaacaagctctccgactactactaccacgcagacctgctctccagggctgcggtggaggaggatgcctacagccgcatgaagctggtgctgcggtggtacctgtctggcttctacaagaagcccaagggaatcaagaagccgtacaaccccatcctgggggagaccttccgctgctgctggttccacccgcagactgacagccgcacattctacatagcagagcaggtgtcccaccacccgcccgtgtctgccttccacgtcagcaaccggaaggacggcttctgcatcagtggcagcatcacagccaagtccaggttttatgggaactcgctgtcggcgctgctggacggcaaagccacgctcaccttcctgaaccgagccgaggattacacccttaccatgccctacgcccactgcaaaggaatcctgtatggcacgatgaccctggagctgggtgggaaggtcaccatcgagtgtgcgaagaacaacttccaggcccagctggaattcaaactcaagcccttcttcgggggtagcaccagcatcaaccagatctcgggaaagatcacgtcgggagaggaagtcctggcgagcctcagtggccactgggacagggacgtgtttatcaaggaggaagggagcggaagcagtgcgcttttctggaccccgagcggggaggtccgcagacagaggctgaggcagcacacggtgccgctggaggagcagacggagctggagtccgagaggctctggcagcacgtcaccagggccatcagcaagggcgaccagcacagggccacacaggagaagtttgcactggaggaggcacagcggcagcgggcccgtgagcggcaggagagcctcatgccctggaagccgcagctgttccacctggaccccatcacccaggagtggcactaccgatacgaggaccacagcccctgggaccccctgaaggacatcgcccagtttgagcaagacgggatcctgcggaccttgcagcaggaggccgtggcccgccagaccaccttcctgggcagcccagggcccaggcacgagaggtctggcccagaccagcggcttcgcaaggccagcgaccagccctccggccacagccaggccacggagagcagcggatccacgcctgagtcctgcccagagctctcagacgaggagcaggatggtgactttgtccctggcggtgagagcccatgccctcggtgcaggaaggaggcgcggcggctgcaggccctgcacgaggccatcctctccatccgagaggcccagcaggagctgcacaggcacctctcggccatgctgagctccacggcacgggcagcacaggcaccgaccccaggcctcctgcagagcccccgatcctggttcctgctctgcgtgttcctggcgtgtcagctgttcattaaccacatcctcaaataggagccctgagggcagagctcctggccggtcctgagccctccctcccaggcacccagcactttaagcctgctccatggaggcagagaggcccggcaagcacagccactgtgacggggagtccaggcgcaggagggacccggggccacaaggcgctgcgggcccaggtgtgctgggcccctctcaggggcactggcctctctgcagggccttccgcccagcgctggccttaatgctaaagccaaatgcagcttctgctgtgcgacgcactcctggccatcttgccgtgtcaccccctgtccggcctccacttgccatgggggatggatggatttagggtgggagggcctgtgggggccctggacagtcacaccccagcagcagtgagtgggcaggtttggaggagccccgagtggcccaggagtccccccacacacagatgcataggcctgccttccggagaccctgtccacattgccgggaccaccctggtggggccactggtgggtgccagggacaggttagggccactctggggaaggcattttggttttttattccacgctgtgctgtttggatgggagccccacagaggcaggtcctggaaccaccccacccccacacctggacgctcgctctggtgggggcacacgcaggtggaggtggttgtgggtgcaggtgtgtgcaggggtgtggggggcgcaggggtgtggcttagctggccccgcacccaggccggggaggctcaagttcgccactttactcagaccgatgcacagtcttcccattttacacttttttaataaacataattgcaatattttaggtgggctgcgagctgcagtcagccttcacgtctggcctcagtccccgtgtcagtgccgctctgcgtgtgcgtgtgcgcgtgtgtgagcctctacacatatatatacgtacagagccttaaaccacatcgtggcggtgccgtctgagctgtagcgggtggctttgtttccagtttttgtacccgtgtccttgtctcccctcctcccccatctggggatgtgtctgtgttccacaccttgaaataaacagacacatacgtgtt

SEQ ID NO: 163158 - DNA, 1731 bp, Homo sapiens
  Payload ID: 12152
  Gene Symbol: OSBPL5
  Gene Name: oxysterol binding protein-like 5
  ENST ID: ENST00000534454
  CDS Start-End: 1-1299
tacaaccccatcctgggggagaccttccgctgctgctggttccacccgcagactgacagccgcacattctacatagcagagcaggtgtcccaccacccgcccgtgtctgccttccacgtcagcaaccggaaggacggcttctgcatcagtggcagcatcacagccaagtccaggttttatgggaactcgctgtcggcgctgctggacggcaaagccacgctcaccttcctgaaccgagccgaggattacacccttaccatgccctacgcccactgcaaaggaatcctgtatggcacgatgaccctggagctgggtgggaaggtcaccatcgagtgtgcgaagaacaacttccaggcccagctggaattcaaactcaagcccttcttcgggggtagcaccagcatcaaccagatctcgggaaagatcacgtcgggagaggaagtcctggcgagcctcagtggccactgggacagggacgtgtttatcaaggaggaagggagcggaagcagtgcgcttttctggaccccgagcggggaggtccgcagacagaggctgaggcagcacacggtgccgctggaggagcagacggagctggagtccgagaggctctggcagcacgtcaccagggccatcagcaagggcgaccagcacagggccacacaggagaagtttgcactggaggaggcacagcggcagcgggcccgtgagcggcaggagagcctcatgccctggaagccgcagctgttccacctggaccccatcacccaggagtggcactaccgatacgaggaccacagcccctgggaccccctgaaggacatcgcccagtttgagcaagacgggatcctgcggaccttgcagcaggaggccgtggcccgccagaccaccttcctgggcagcccagggcccaggcacgagaggtctggcccagaccagcggcttcgcaaggccagcgaccagccctccggccacagccaggccacggagagcagcggatccacgcctgagtcctgcccagagctctcagacgaggagcaggatggtgactttgtccctggcggtgagagcccatgccctcggtgcaggaaggaggcgcggcggctgcaggccctgcacgaggccatcctctccatccgagaggcccagcaggagctgcacaggcacctctcggccatgctgagctccacggcacgggcagcacaggcaccgaccccaggcctcctgcagagcccccgatcctggttcctgctctgcgtgttcctggcgtgtcagctgttcattaaccacatcctcaaataggagccctgagggcagagctcctggccgtccccccacacacagatgcataggcctgccttccggagaccctgtccacattgccgggaccaccctggtggggccactggtgggtgccagggacaggttagggccactctggggaaggcattttggttttttattccacgctgtgctgtttggatgggagccccacagaggcaggtcctggaaccaccccacccccacacctggacgctcgctctggtgggggcacacgcaggtggaggtggttgtgggtgcaggtgtgtgcaggggtgtggggggcgcaggggtgtggcttagctggccccgcacccaggccggggaggctcaagttcgccactttactcagaccgatgcacagtcttcccattttacacttttttaataaacataattgcaatattttaggtg

SEQ ID NO: 163159 - DNA, 774 bp, Homo sapiens
  Payload ID: 12152
  Gene Symbol: OSBPL5
  Gene Name: oxysterol binding protein-like 5
  ENST ID: ENST00000533721
  CDS Start-End: 506-774
agaccgctgggctgcctcctgtcagaagccaactggagttagggtttggggtgactcctgggggtatggaggggtcacagggtgggcttacctgcccctccctcgtccctgggctgagcccagcccctccctcatccttgggctgagcgggtctgccccgccgaagcggctgggtggatttcctctcttgccgtttcgcaacttgctcccctctgtgtgtctgccccagtctcttcaaggtgccttttacaggaagacttctgtaagggtcccaccccacctgatacagcctcccaaagcctggagaagtgggccagcctttgggatcctagatagatgctcttgggtctgcctgcaccagggctgatccagatcccagactgaacagaaactctgctccccaaccccaggagtaaggcccctctgcacgtttttatcccacctccttggtacacagggccttgctgttccttgaacctgccagaagcccccgagcgcccacagcatgaaggaggaggccttcctccggcgccgcttctccctgtgtccaccttcctccacccctcagaaagtcgacccccggaagctcacccggaacttgctcctcagcggagacaatgagctctacccactcagcccagggaaggacatggagcccaacggcccgtcgctgcccagggatgaagggcccccgaccccaagctctgccacgaaggtgccaccggcagagtacaggctgtgcaacgggtcagacaaggaatgtgtgtcccccac

SEQ ID NO: 163160 - DNA, 706 bp, Homo sapiens
  Payload ID: 12152
  Gene Symbol: OSBPL5
  Gene Name: oxysterol binding protein-like 5
  ENST ID: ENST00000534157
  CDS Start-End: 498-706
atttcctccatgctctaggatgggaaggacaagagggcgtgactcttcccagagtcccatcatctctgatttaggaatggagcccttagggtgtctcacctcctcgggatgcctaatagtgtgtttggtgaatgcagatggacttaactggtccatagatcccctctcaccctgctgacacgaagacaaggatgaaggggaaagttgaggctcaacaactgaacagtattccttctaaatatgtacattcttagggattttaagtggaaaacagggaggagatttgagggataccccacctcggcaggcagctggtcaggctgcctgttgtgaccagcctggggtcgccttcccttcatccaaggccaggggagatggcaaaccttcagtaagcgctgccgtacctggcagagcagaagcaccaccccagcttggagacagcatgcccctgactgctggtcacggatggccccttgaagcccccgagcgcccacagcatgaaggaggaggccttcctccggcgccgcttctccctgtgtccaccttcctccacccctcagaaagtcgacccccggaagctcacccggaacttgctcctcagcggagacaatgagctctacccactcagcccagggaaggacatggagcccaacggcccgtcgctgcccagggatgaagggcccccgaccccaagctctgccacgaa

SEQ ID NO: 163161 - DNA, 2733 bp, Homo sapiens
  Payload ID: 12152
  Gene Symbol: OSBPL5
  Gene Name: oxysterol binding protein-like 5
  Uniprot ID: Q9H0X9
  ENST ID: ENST00000525498
  CDS Start-End: 62-2434
aagcctggccacgccaccatgcctgggtcctcactcccactgctctcttgcagggaaggacatggagcccaacggcccgtcgctgcccagggatgaagggcccccgaccccaagctctgccacgaaggtgccaccggcagagtacaggctgtgcaacgggtcagacaaggaatgtgtgtcccccaccgccagggtcaccaagaaggagactctcaaggcgcagaaggagaactaccggcaggagaagaagcgcgccacacggcagctgctcagcgctctgacagaccccagcgtggtcatcatggctgacagcctgaagatccgcggcaccctgaagagctggaccaagctgtggtgcgtgctgaagccgggggtgctgctcatctacaagacgcccaagggccccaaaggtgagagcgtgggctccatcacacagcccctgcccagcagctacctgatcttcagggccgcctccgagtcagatggtcgctgctggctggacgccctggagctggccctgcgctgctctagcctactgagactgggcacctgcaagccgggccgagacggggagccagggacctcgccagacgcatcaccctcatcgctctgtgggctgccagcctcagccaccgtccacccagaccaagacctgttcccactgaacgggtcttccctggagaacgatgcattctcagacaagtcggagagagagaaccctgaggagtcagataccgagacccaggaccatagccggaagacggagagtggcagcgaccagtcagagacccctggggccccggtgcggagagggaccacctatgtggagcaggtccaggaggagctgggggagctgggcgaggcgtcccaggtggagacagtgtcagaggagaacaagagtctgatgtggaccctgctgaagcagctacggccaggcatggacctgtcccgcgtggtgctacccacgttcgtactggagccgcgctccttcctgaacaagctctccgactactactaccacgcagacctgctctccagggctgcggtggaggaggatgcctacagccgcatgaagctggtgctgcggtggtacctgtctggcttctacaagaagcccaagggaatcaagaagccgtacaaccccatcctgggggagaccttccgctgctgctggttccacccgcagactgacagccgcacattctacatagcagagcaggtgtcccaccacccgcccgtgtctgccttccacgtcagcaaccggaaggacggcttctgcatcagtggcagcatcacagccaagtccaggttttatgggaactcgctgtcggcgctgctggacggcaaagccacgctcaccttcctgaaccgagccgaggattacacccttaccatgccctacgcccactgcaaaggaatcctgtatggcacgatgaccctggagctgggtgggaaggtcaccatcgagtgtgcgaagaacaacttccaggcccagctggaattcaaactcaagcccttcttcgggggtagcaccagcatcaaccagatctcgggaaagatcacgtcgggagaggaagtcctggcgagcctcagtggccactgggacagggacgtgtttatcaaggaggaagggagcggaagcagtgcgcttttctggaccccgagcggggaggtccgcagacagaggctgaggcagcacacggtgccgctggaggagcagacggagctggagtccgagaggctctggcagcacgtcaccagggccatcagcaagggcgaccagcacagggccacacaggagaagtttgcactggaggaggcacagcggcagcgggcccgtgagcggcaggagagcctcatgccctggaagccgcagctgttccacctggaccccatcacccaggagtggcactaccgatacgaggaccacagcccctgggaccccctgaaggacatcgcccagtttgagcaagacgggatcctgcggaccttgcagcaggaggccgtggcccgccagaccaccttcctgggcagcccagggcccaggcacgagaggtctggcccagaccagcggcttcgcaaggccagcgaccagccctccggccacagccaggccacggagagcagcggatccacgcctgagtcctgcccagagctctcagacgaggagcaggatggtgactttgtccctggcggtgagagcccatgccctcggtgcaggaaggaggcgcggcggctgcaggccctgcacgaggccatcctctccatccgagaggcccagcaggagctgcacaggcacctctcggccatgctgagctccacggcacgggcagcacaggcaccgaccccaggcctcctgcagagcccccgatcctggttcctgctctgcgtgttcctggcgtgtcagctgttcattaaccacatcctcaaataggagccctgagggcagagctcctggccggtcctgagccctccctcccaggcacccagcactttaagcctgctccatggaggcagagaggcccggcaagcacagccactgtgacggggagtccaggcgcaggagggacccggggccacaaggcgctgcgggcccaggtgtgctgggcccctctcaggggcactggcctctctgcagggccttccgcccagcgctggccttaatgctaaagccaaatgcagcttctgctgtgcgacgcactcctggccatcttgccgtgtcaccccctgtcc

SEQ ID NO: 163162 - DNA, 554 bp, Homo sapiens
  Payload ID: 12152
  Gene Symbol: OSBPL5
  Gene Name: oxysterol binding protein-like 5
  ENST ID: ENST00000526122
  CDS Start-End: 182-554
tgaccacccaccaccaggctcccagggcccaggccctcctcaccctgcctcagaagtcccctgagagggggacttcttagccaggggcacccccaccatgtggctctgaagccccttccggggcggtgacctcctgctgcccctccttccttccttccagaagcccccgagcgcccacagcatgaaggaggaggccttcctccggcgccgcttctccctgtgtccaccttcctccacccctcagaaagtcgacccccggaagctcacccggaacttgctcctcagcggagacaatgagctctacccactcagcccagggaaggacatggagcccaacggcccgtcgctgcccagggatgaagggcccccgaccccaagctctgccacgaaggtgccaccggcagagtacaggctgtgcaacgggtcagacaaggaatgtgtgtcccccaccgccagggtcaccaagaaggagactctcaaggcgcagaaggagaactaccggcaggagaagaagcgcgccacacggcagctgctcagcgctctgacagacccca

SEQ ID NO: 163163 - DNA, 2182 bp, Homo sapiens
  Payload ID: 12152
  Gene Symbol: OSBPL5
  Gene Name: oxysterol binding protein-like 5
  ENST ID: ENST00000471998
  CDS Start-End: 107-454
atttcctgcagccaggcccgcgccgccagtggagcccccgcgcgcccggccggcccggagcaccgagctcgcggcacggtaggagaagcccccgagcgcccacagcatgaaggaggaggccttcctccggcgccgcttctccctgtgtccaccttcctccacccctcagaaagtcgacccccggaagctcacccggaacttgctcctcagcggagacaatgagctctacccactcagcccagggaaggacatggagcccaacggcccgtcgctgcccagggatgaagggcccccgaccccaagctctgccacgaaggtgccaccggcagagtacaggctgtgcaacgggtcagacaaggaatgtgtgtcccccaccgccagggtcaccaagaaggagactctcaaggcgcagaaggagaactaccggcaggagaagaaccgcgctccttcctgaacaagctctccgactactactaccacgcagacctgctctccagggctgcggtggaggaggatgcctacagccgcatgaagctggtgctgcggtggtacctgtctggcttctacaagaagcccaagggaatcaagaagccgtacaaccccatcctgggggagaccttccgctgctgctggttccacccgcagactgacagccgcacattctacatagcagagcaggtgtcccaccacccgcccgtgtctgccttccacgtcagcaaccggaaggacggcttctgcatcagtggcagcatcacagccaagtccaggttttatgggaactcgctgtcggcgctgctggacggcaaagccacgctcaccttcctgaaccgagccgaggattacacccttaccatgccctacgcccactgcaaaggaatcctgtatggcacgatgaccctggagctgggtgggaaggtcaccatcgagtgtgcgaagaacaacttccaggcccagctggaattcaaactcaagcccttcttcgggggtagcaccagcatcaaccagatctcgggaaagatcacgtcgggagaggaagtcctggcgagcctcagtggccactgggacagggacgtgtttatcaaggaggaagggagcggaagcagtgcgcttttctggaccccgagcggggaggtccgcagacagaggctgaggcagcacacggtgccgctggaggagcagacggagctggagtccgagaggctctggcagcacgtcaccagggccatcagcaagggcgaccagcacagggccacacaggagaagtttgcactggaggaggcacagcggcagcgggcccgtgagcggcaggagagcctcatgccctggaagccgcagctgttccacctggaccccatcacccaggagtggcactaccgatacgaggaccacagcccctgggaccccctgaaggacatcgcccagtttgagcaagacgggatcctgcggaccttgcagcaggaggccgtggcccgccagaccaccttcctgggcagcccagggcccaggcacgagaggtctggcccagaccagcggcttcgcaaggccagcgaccagccctccggccacagccaggccacggagagcagcggatccacgcctgagtcctgcccagagctctcagacgaggagcaggatggtgactttgtccctggcggtgagagcccatgccctcggtgcaggaaggaggcgcggcggctgcaggccctgcacgaggccatcctctccatccgagaggcccagcaggagctgcacaggcacctctcggccatgctgagctccacggcacgggcagcacaggcaccgaccccaggcctcctgcagagcccccgatcctggttcctgctctgcgtgttcctggcgtgtcagctgttcattaaccacatcctcaaataggagccctgagggcagagctcctggccggtcctgagccctccctcccaggcacccagcactttaagcctgctccatggaggcagagaggcccggcaagcacagccactgtgacggggagtccaggcgcaggagggacccggggccacaaggcgctgcgggcccaggtgtgctgggcccctctcaggggcactggcctctctgcagggccttccgcccagcgctggccttaatgctaaagccaaatgcagcttctgctgtgcgacgcactcctggccatcttgccgtgtca

SEQ ID NO: 163164 - DNA, 575 bp, Homo sapiens
  Payload ID: 12152
  Gene Symbol: OSBPL5
  Gene Name: oxysterol binding protein-like 5
  ENST ID: ENST00000530372
  CDS Start-End: 282-575
agcacataaggggcagggacaacgggctcagatgtctggggctcctcttgtgttctgatggctcctgagacggggagaaacggcgacagtttcctgggttcaggaagggagaggaggcgcctcgcaccctggctagggtgggctgggggcctgcacccctaagttggagaaccccacgaagctgaccccactcaccgctgcccaccccgccaagcctcctggccattttcagcggagtgtcccgacctctggccgcccggaagcccccgagcgcccacagcatgaaggaggaggccttcctccggcgccgcttctccctgtgtccaccttcctccacccctcagaaagtcgacccccggaagctcacccggaacttgctcctcagcggagacaatgagctctacccactcagcccagggaaggacatggagcccaacggcccgtcgctgcccagggatgaagggcccccgaccccaagctctgccacgaaggtgccaccggcagagtacaggctgtgcaacgggtcagacaaggaatgtgtgtcccccaccgccagggtcaccaagaaggagact

SEQ ID NO: 163165 - DNA, 554 bp, Homo sapiens
  Payload ID: 12152
  Gene Symbol: OSBPL5
  Gene Name: oxysterol binding protein-like 5
  ENST ID: ENST00000533234
  CDS Start-End: 136-554
ctcgctccgcctcgcgcggggggaccatctgctggcatttcctgcagccaggcccgcgccgccagtggagcccccgcgcgcccggccggcccggagcaccgagctcgcggcacgaagcccccgagcgcccacagcatgaaggaggaggccttcctccggcgccgcttctccctgtgtccaccttcctccacccctcagaaagtcgacccccggaagctcacccggaacttgctcctcagcggagacaatgagctctacccactcagcccagggaaggacatggagcccaacggcccgtcgctgcccagggatgaagggcccccgaccccaagctctgccacgaaggtgccaccggcagagtacaggctgtgcaacgggtcagacaaggaatgtgtgtcccccaccgccagggtcaccaagaaggagactctcaaggcgcagaaggagaactaccggcaggagaagaagcgcgccacacggcagctgctcagcgctctgacagaccccagcgtggtcatcatggctgacagcctgaagatccgcggcaccctgaa

SEQ ID NO: 163166 - DNA, 2653 bp, Homo sapiens
  Payload ID: 12152
  Gene Symbol: OSBPL5
  Gene Name: oxysterol binding protein-like 5
  ENST ID: ENST00000478260
  CDS Start-End: 563-1564
aaaacaaagaaagacgtattaatttttttaaacatacgggatgccatcatgggtgctggtgccctctgtgttctgggtgccatcctgggacgcagcagtgagcgagaagatgcctgccctcaggagcccaatgccagagcgggaactgcagagtcaagtgaagcacgatgcatgtctcacagggctggtggcctcccaggaggctggaacaggaggcgacacctgacatgagcaaaggccctggcgaggacagagcccccttagtgggggagacggcccctgagggaccaggcgtgcctcccaggctccgtgcctcccaggctccgcacctcccaggctccgcacccccaccagcctctccctgtggggttctgctcccagcgcctcctgtccttctcaccctcccagggactgacacaggcctcccagggatcggtgctgctgggtcgggactcagggatcggtgctgctgggtcggtactcagcagggcctggggctcagcagggctggggccgcctggcccctgacactggctgcatttcaggaatcctgtatggcacgatgaccctggagctgggtgggaaggtcaccatcgagtgtgcgaagaacaacttccaggcccagctggaattcaaactcaagcccttcttcgggggtagcaccagcatcaaccagatctcgggaaagatcacgtcgggagaggaagtcctggcgagcctcagtggccactgggacagggacgtgtttatcaaggaggaagggagcggaagcagtgcgcttttctggaccccgagcggggaggtccgcagacagaggctgaggcagcacacggtgccgctggaggagcagacggagctggagtccgagaggctctggcagcacgtcaccagggccatcagcaagggcgaccagcacagggccacacaggagaagtttgcactggaggaggcacagcggcagcgggcccgtgagcggcaggagagcctcatgccctggaagccgcagctgttccacctggaccccatcacccaggagtggcactaccgatacgaggaccacagcccctgggaccccctgaaggacatcgcccagtttgagcaagacgggatcctgcggaccttgcagcaggaggccgtggcccgccagaccaccttcctgggcagcccagggcccaggcacgagaggtctggcccagaccagcggcttcgcaaggccagcgaccagccctccggccacagccaggccacggagagcagcggatccacgcctgagtcctgcccagagctctcagacgaggagcaggatggtgactttgtccctggcggtgagagcccatgccctcggtgcaggaaggaggcgcggcggctgcaggccctgcacgaggccatcctctccatccgagaggcccagcaggagctgcacaggcacctctcggccatgctgagctccacggcacgggcagcacaggcaccgaccccaggcctcctgcagagcccccgatcctggttcctgctctgcgtgttcctggcgtgtcagctgttcattaaccacatcctcaaataggagccctgagggcagagctcctggccggtcctgagccctccctcccaggcacccagcactttaagcctgctccatggaggcagagaggcccggcaagcacagccactgtgacggggagtccaggcgcaggagggacccggggccacaaggcgctgcgggcccaggtgtgctgggcccctctcaggggcactggcctctctgcagggccttccgcccagcgctggccttaatgctaaagccaaatgcagcttctgctgtgcgacgcactcctggccatcttgccgtgtcaccccctgtccggcctccacttgccatgggggatggatggatttagggtgggagggcctgtgggggccctggacagtcacaccccagcagcagtgagtgggcaggtttggaggagccccgagtggcccaggagtccccccacacacagatgcataggcctgccttccggagaccctgtccacattgccgggaccaccctggtggggccactggtgggtgccagggacaggttagggccactctggggaaggcattttggttttttattccacgctgtgctgtttggatgggagccccacagaggcaggtcctggaaccaccccacccccacacctggacgctcgctctggtgggggcacacgcaggtggaggtggttgtgggtgcaggtgtgtgcaggggtgtggggggcgcaggggtgtggcttagctggccccgcacccaggccggggaggctcaagttcgccactttactcagaccgatgcacagtcttcccattttacacttttttaataaacataattgcaatattttaggtgggctgcgagctgcagtcagccttcacgtctggcctcagtccccgtgtcagtgccgctctgcgtgtgcgtgtgcgcgtgtgtgagcctctacacatatatatacgtacagagccttaaaccacatcgtggcggtgccgtctgagctgtagcgggtggctttgtttccagtttttgtacccgtgtccttgtctcccctcctcccccatctggggatgtgtctgtgttccacaccttgaaataaacagacacatacgtgttctctt

SEQ ID NO: 163167 - DNA, 10513 bp, Homo sapiens
  Payload ID: 12153
  Gene Symbol: OSBPL6
  Gene Name: oxysterol binding protein-like 6
  Uniprot ID: Q9BZF3
  ENST ID: ENST00000190611
  CDS Start-End: 377-3181
ccgcggcgccaccgctcgccctccaggttctgccacttgctgggaaaacagcaacagaaggatattaaggagccacccctataatttacccagatagccccagcaaggtcaaagacatatcatgtcccaaggagaaaagctgcaggcatctgaggataaatcactgtgaaacagctttgaccataaagctgacttggaagactttgactccaaggtgcaaggtggtttggacaccctcaatattgcctgctcttttctagtcaaacctgattcatgaaatggaatgaagctgaaaaatcatctacttctttgtttgtggatttgagagaagattgggatggtcttaagtgcataaaacgagactctaactgcagcgatgagttcagatgagaagggcatttcccctgctcataaaacatccactccaacccatagaagtgcctcctcttcaacatcctcccaaagggacagtaggcagagtattcacatactggagaggactgcttcctctagcaccgagccctctgtaagtcggcaattgctagaaccggagccagtccccctctccaaggaagctgacagctgggaaattatagaagggctgaaaataggccaaaccaatgtccagaaaccagacaaacatgagggctttatgctgaagaaaagaaaatggcctttaaaaggctggcacaagcgtttttttgtcctggataatggaatgttaaagtattcaaaggcaccactcgatattcagaaaggaaaggtccatgggagcatagatgtgggactctcagtcatgtcaattaaaaagaaagctcgaagaatagaccttgacaccgaagagcacatctatcatttgaaggtgaaatcccaggactggtttgatgcatgggtctccaaactgcgacatcatcggttgtatcgtcagaatgaaattgtgagatcaccaagagatgctagttttcacatatttccttcaacgtccacagctgaatcctcaccagctgctaatgtttctgtaatggatggaaagatgcaaccaaacagctttccgtggcagtcccctttaccatgcagcaatagcctccctgcaacgtgcacaactggccagagtaaagtggcagcctggttacaggactcggaagagatggacaggtgtgcagaagatcttgcacattgccagtcaaaccttgtggaacttagcaaactcctgcaaaatttggaaatacttcagagaactcagtcggcacctaactttactgacatgcaggctaactgtgtagatatttcaaagaaagacaagcgggtcacaagacgatggagaacaaaaagtgtcagcaaagatacaaaaatacaactgcaggttcctttcagtgctaccatgtcaccagttcgcttgcattcctccaaccccaacctttgtgcagatattgaatttcagactccccctagccacctcactgaccctctggaaagttcaacagattatacaaagctgcaagaagaattttgtctaatcgcacagaaagtgcattctcttttgaagtctgcatttaatagcatagctatagagaaggagaagctgaagcagatggtttccgagcaggatcacagtaaaggccacagcacgcagatggcacggctccgacagtcactgtctcaggcactcaaccagaatgctgaactaaggagtcggttgaacagaatacattcagagtctattatttgtgatcaggttgtcagtgtaaatattattcctagccctgatgaggctggtgagcaaatccatgtcagtctccccttatcacagcaagtagccaatgagagccgcctctccatgtcagagtctgtttctgagttctttgatgcccaagaggtgctcctctctgcaagttcgtcagagaatgaggcttcagatgatgagtcttacatcagtgatgtgagtgataatatatctgaagacaacaccagtgttgcagacaatatttctcggcaaatcctgaatggggagcttacaggaggggccttccgaaatgggcgtcgagcatgcctgccagctccttgtcctgacaccagtaacattaacctgtggaatatcttgaggaacaacattggtaaagacctgtctaaagtctctatgcctgtggagctaaacgagccgctcaacaccctgcagcacctctgtgaggaaatggaatacagcgagctcctggacaaggcttcggaaactgatgatccatatgagcgcatggttctcgttgccgcatttgcagtttcaggatactgctccacctatttcagagcaggaagtaagccattcaacccagtccttggggagacttatgaatgcattagagaagacaagggattccgctttttctcagaacaggttagccatcatccacccatttctgcctgtcactgtgaatcaaagaattttgtgttttggcaagatatcagatggaaaaacaagttctgggggaagtcgatggaaatcctgcctgttggaacactgaatgtcatgcttccaaagtatggagattactatgtgtggaataaagtcaccacttgcatacacaacatcctcagtgggagaagatggatagaacattatggagaagtaaccatcagaaataccaaaagcagtgtttgcatttgcaaactcacatttgtcaaggtgaattattggaattctaacatgaatgaagtccagggggtggtgatagatcaggaggggaaggcggtgtaccggctgtttggaaagtggcatgaaggactctactgtggtgtggccccctctgcaaagtgcatttggagaccaggttccatgccaacaaactatgagctgtactatggcttcacaaggtttgctattgagctcaatgagttagatccagtactaaaagatctccttccaccaacagacgcccggttccggccagatcaaagatttttggaagaaggaaatttagaagctgcagcatcagagaagcaaagagtagaggaactccagagatctcggagacgatatatggaagaaaacaatcttgaacatataccaaaattttttaaaaaagttattgatgccaatcaaagagaagcctgggtttctaacgacacctactgggagcttcgaaaggaccctgggtttagcaaagtagacagccctgttctttggtagactgggaatgtagagctagccaacatatcacattctgaatgaataaataactatgcacaattatgtttcttatagctatgtgtggtttctgggtcaactgaaaacctaccatttgcttttctattcatctttataatggactttcagaagtgcattagacaaggcccctaaccactttgggatcctttctgttttgctgcaaccatattccttaaaaaaaaaaaaaaaaaaaaaaaaaaaatccacaccgtccttggaaagcagaataaaaggagcagaatataaaatccaaagtctgaccagtttgtaaagaaaaacaaatggtaactggtgcttaaagctgatcaagaaagttaacaacaacatagaaaccacacgattgttccactgtctggaagcaccatcccctatcgcaggactcctgggccacaagcagtcggtcagtgcagacttcaagtgtgtctgtttgatgtggtgtgattgtgctggccttgtcgaaaaagatgtgatgcttctcagaacctgttccatctgtatgccattgttcatgccttaagaaatgcaaagatgtacaataaatcatttttaaaatgtgtgctcataggtttatgtgaagaacagattttttgaatcatggcatgattcactttctcaatcaggacaattatgagactaacttaaatgggttttttaaaagtgaacaacacgtgctttactctgataagtcagttaccatatggtatgtctgaagggaaagaaggaaaagacgtgctaagtagatctctgtatttacgtggctcgttaatttcctgtcctgcgtccagataataaaccatccctcttccacctaacctcacagtgtgccctattatttggaaaaatctgtctttgatttggacatttggtcatcagtgttaaaaccttaaaaggaaataacaaaaagcatatggaattcctgtgtgggcttagtagtactataaatgtaattgtttttgagtgaagcaccatgtaatccatgtctcaatcccatgcccgctccactgacactagtcgaattccactgagaacagaagcaagaataatagtagtttatttgcattgtttaaatgaattctatgcaaaatcatatttcaaattttcatcaagtgattccatatggtacatggctacatattaagcatttaccttgctattggcagagatatgaaacttaagctaaggaatgtatccatcccaaagcaggaaagcagaagtgtgttttgcatacttcaggatttgtttttcctccactaatatacagaggcttttgcagaaaacttgcatcagtattcctgtttctgcacgtaggtgactatataaatgcctgtatgttttttttaaaatatctcctcagagattttcctagggaattataaaattacatatattttattgttagttagatgtttattcttggattcttaccattagaatttaagtgttatttaaaactctgatacagttacagacactttacattttattatgaggtgttgattttagtggtatttctcctcagcaaagcattcctaataatggctaatacaccatcaaatgaaaaactgctgatgagagtgtaagagaaagcgctaacgtttccactagatggcgcaatattttatttatccaaaactcctcccttgcatctgagtttttatgttatgtgtacagtctgcattagcttagaatggaatttcattctcaggtaaattttcgaatccatcaccagatctaagcattctgcttcaacaataccctctctattcctctcattcccattttaaatccataggtggcttgccctgcggcagtaaaatcttccccttgatattgattctttttctgctcattcatcttgatgttctttttctgcatcctgagatacatgtcgttaattttaataagaatcctattgacttcctcacgggagtctgttctcctatggttgataaagctttaaatactatttaaagtggttctggtctgtacttactagcacttccctgaacagtctcaaaatagcctaaacataagaaaacaatcctgcaaagtaaaggtttttacaagcagagatgaaggaaagggagcagcagctgaccatcagatgtggtatcaggtagctggaagaggatccaggacccatcagggaagcaacgactgtacttagcaatttgggttataattacaaaaaagaaaaaatagtagaaaggatctttaccagacagtaaggtcatggtacaaatcaggtgagtgaatgttggtcagaggtagcctgacactctgatgaggacttcaagatgagaatgagaaaaatgtctattaaaatcactacatttgataatatctcagatttagaatctcttttgggattcagatagtctgattattccaattcaagtgttcagttaagttttagttactattcctataatacccaattcactaatatcatatctcctgtggaatattcattggtgcgatggcctcatccccttttttactttttattgacatggtggttataaaatgaagagacttactctattggaattttcatctacgtagtatttgggctgtcaagactaaatagcaaaagggtagaatattagatcattctcttaataagacctgatttattccttaggatgttatacaaacctttttatttcaggcctactttcttgttttttcctaaaaggatctaggatagaggagaacataatatgcctgtatacttctcccatggtttattcataagctgcttcatctcattggagatggtcattgaggagagcagtaataagtgacgatgattctgaggacttggctagactgagcggatcaatggcacacaccagcactggtagaggctgaccagaagctcatcgattccatatgctgtcacccagggtgcagatttactctcttttgctgttattttattgtttttcttaaattaagccattgtttttcatggattatttttaaaatacctaccccataattttcaggcaattgtaaaaataaaccttatttaagataacttttaatggtacatatcaactatatgtggggaaaaaatgcaattttctgggcaagagaaaccaaaggattttcaatatatgagatgccaggttgtcaattttctaaaccttttcctctagattattctggccctaggcctttcagcaaccccactaatcaattattagatcctgccccaaggagcagtggcttgggggctggatttagggaggaaaacctgattaaactgttttgcttagtactggttacagctgtagctggagaagagtttataatcataaagtacatttttgttattaccttgtggattttaattatccatcttgtctaatcttgttctctgtcatcctagataatgaggtgtttgtgggagcagagctctgcacacaccaggggatgtaataaatgtttgcacttggcccagtatattatgaatgtggcacagtaaataaagtttgtgtacaaaatactagtttatttctatgggagccattatgttcaggatatataaaatgtatctaattaaacaattttgaatctattttgtgctctagaaatgttcttttggggaaagatggaaagaaatgtataaatggagttaagattaaagtatttggggttttttttccccaaaagcttcccagttgtttagaaataatactatccaaagtaggattcggtcctgtaagtcctaactgaatttcttttgtaaaactgatacgtttaaactgtacattgcataatcattctgttaaactaaacctttgtttaatacataattgtaagagcatatatttgttattgaattgaaagactttttttgtagcttttgcttttaaagaagatggcaaattatctaagaaagacttagctttattacgtccaaaatgagatctaaagaaggaggtctttaaaaattgttgtgatggaccaacatgtccaacatcttaagcaaatgaagcttcatgattaaggcagcttacagataagtggaaaagaacttacctgtcatatgcatccttttgttttccaaaacaacatctgatttagttcattttctccagccttgctcctaacatagtgaaaggcatagatacacatgtatgttcttttacactgtgtcattgtttgtaaaatatacagtatttatgtacagtttcagagacattcaatattgaaaaccacttcagttagcctcctagtgaatactattaatttttcatggattacatattaccatatgaccccataaatacattttattagttactttggtatcttcaaattggtaagaaaaaaacataaaacaaaaatgttcttattttctgcaatttttttttctagccattccttcctcccaaatagaagtgagggcaattgtagagagaggaatattaagttttcataaagcaaagtatcatcttatttgtgttccacctgtttcttctaacacttaattcataaagtgagcaattgaacttcttaatactgttagagaatatgctagaactattacttcttttatcttagacacccactttcccttaattctcatctatttagttttttaataaaattgttgctagaatttttttgtcttttcaagttctttttttgttaattttattgatattgctgtacttttttttttttttttgagacagagtcttgagtgctctgtcacccaggctggagcgcaatggcacaatctcggctcactgcagcctccgcctcccaggttcaagggattcttgtgcctcagcctcccgagtagctgggtttacaggcgtgtgccacccacctagctaatttttgtattttagttagagacgggggttttgccatgttggccaggctggtctcgaactcctgacctcaagtgtttcacccgcctcagccccccaaagtgctgggattacaggtgtgagcaaccgcgcctggactcaagttctttttaaagcttgattaaggtataaccgacatataatacacttcgcatatttgaacagtacttgatacagtttgatgtatgtatatacccttgacataatcaaaatagtgaacatatctatcatccccaaaagtttcccctgcccctttgtaatccttccccatcctctatcctgaggcaaccattgatctgcttttattatttttaaaagttagcgtattttcttatatgtattgcatatgggatttttctagaaggccacgtgcatatgcaccctccccttccattaccccagtatccgccatcaagtagtaacatgttgtaacagaaagaatcccattaagtcctagttctggtagcccggtacaaattttagattttcccccaaaaatgaaaaaaaattatttaaaaaatttagatttgaaatgcttagaaaacaatcatttatttttttatgtcaaaatgtccaagtaaattaatggattaatttccatgcttctggtgatgtaacaccacttggtggtggcgctgaggaaaccctgggaagtgtttttctcttctgtgtaatgaaagactcactgacaaagccgtcggtatccagaatgactgctcttgaaatgatattttgatgatgatgatcagggaagtagcctatgctgatttatttatcatccccccaccccaaccccacttttgtgtcacaaacatttgaaacacccagtgctcaagaatgctgcttttccaattctgctaatatcctctctccccatctggaaacaaagttactaaacctagttttgaaaaagcaatggaaatgaaagtgtccagtgaacttactggcagttgtgcaagttgaaagcttattccttacatcctgagcctaaaagccttattccttatatccggagcctaaaagtttgctcaaaagtagaaaactttccagacaagatcacatacaaaatggttaacatgaaatgctaatgaagaaacaaggcaagaatgaatacaagagaaatggaatctggggaaaaaagtaggttctctaactggggcagggatcttgcttcttgggggcatatggttggatcccaggtgggccacgaaaatcatcttggatatttgtttacaggctgattcctgagtttccctccaaagattctgagtccacagatctagggtgtggaccgagaatcctcattgtaacaagcaccctctgcccccgggacattttaaggtagatggagaactaaggtgagagtgtgccagctaaatactctttcctttgtccctgtgcctcagtcttttttgtttgttttttttcatgtgacactcagtaggaaagtctagttcaagaaccggaaactgagccgggcatggtggtgcgcacctgtagtcccagctactcaggaggctgaggcaggaggatggcttgagcctgacgcccatgccgctgtgagctatgattgcaccactgccctgagcctggacgacagagcaagttcctgtcttaaaaaaaaaagtaataaaaaagacatttaaaaaaaaattagagctcagtgacctgtgactcactttgccactttgtcattttcttgacttctgtcccaacgccagccctgtaatatggagataaagagtggggaggacagaactctgaaacctaaaaggcaagatttttgctaaaccggagaacgtaaaaatacattcctagaggcaatctaaccagccagataaccagaagtttactcttcaaagccaagaatcagtacccccacctcaccttccattctctcttaggctttgtctatgtctctaaggggagtttttcagttgactgatgaggtcctgactggtagggaaagcctgcagggaaatcctgtggcaaagcacactcttgatcacctacttaacaagaaggtctagcaggacattcttgatccaggtcagcttcttccctgaaaataatacatatttttaatttctgtttgaaaaaactccactgtgaaattactctgcttatattagaaggtatgaagacagtagttatgtactgttcgtttgcatacggtcattttgagatagaaaaattaaatttttttaggaaaagaatttcaagcaactttctacgaaaatacagcttgtggttaaatttcctaatgaaagaggaattattcactgaaaaatttgtctaatctgtgccacctcaaaataagaattgtgcctcttcaatgaatgttgtatatgagaatgttacatttgtaacagcacaggaaactcaataaattataaatgaatta

SEQ ID NO: 163168 - DNA, 2999 bp, Homo sapiens
  Payload ID: 12153
  Gene Symbol: OSBPL6
  Gene Name: oxysterol binding protein-like 6
  Uniprot ID: Q9BZF3
  ENST ID: ENST00000315022
  CDS Start-End: 121-2937
tttccacttgctgctcaggaggtattgagatcaatgaacactaacctgaggagcatatttttaccaaattaaagagctacagtgaaatatgtgttccaggttcctggttttaagctaaatatgcatcagttatctctgatcaggggaaacagagggcggagtattcacatactggagaggactgcttcctctagcaccgagccctctgtaagtcggcaattgctagaaccggagccagtccccctctccaaggaagctgacagctgggaaattatagaagggctgaaaataggccaaaccaatgtccagaaaccagacaaacatgagggctttatgctgaagaaaagaaaatggcctttaaaaggctggcacaagcgtttttttgtcctggataatggaatgttaaagtattcaaaggcaccactcgatattcagaaaggaaaggtccatgggagcatagatgtgggactctcagtcatgtcaattaaaaagaaagctcgaagaatagaccttgacaccgaagagcacatctatcatttgaaggtgaaatcccaggactggtttgatgcatgggtctccaaactgcgacatcatcggttgtatcgtcagaatgaaattgtgagatcaccaagagatgctagttttcacatatttccttcaacgtccacagctgaatcctcaccagctgctaatgtttctgtaatggatggaaagatgcaaccaaacagctttccgtggcagtcccctttaccatgcagcaatagcctccctgcaacgtgcacaactggccagagtaaagtggcagcctggttacaggactcggaagagatggacaggtgtgcagaagatcttgcacattgccagtcaaaccttgtggaacttagcaaactcctgcaaaatttggaaatacttcagagaactcagtcggcacctaactttactgacatgcaggctaactgtgtagatatttcaaagaaagacaagcgggtcacaagacgatggagaacaaaaagtgtcagcaaagatacaaaaatacaactgcaggaagggccacccgcgaagggccagttcagcacaactcggcgccggcagaggctagcggcagcagtggctacaacagttcctttcagtgctaccatgtcaccagttcgcttgcattcctccaaccccaacctttgtgcagatattgaatttcagactccccctagccacctcactgaccctctggaaagttcaacagattatacaaagctgcaagaagaattttgtctaatcgcacagaaagtgcattctcttttgaagtctgcatttaatagcatagctatagagaaggagaagctgaagcagatggtttccgagcaggatcacagtaaaggccacagcacgcagatggcacggctccgacagtcactgtctcaggcactcaaccagaatgctgaactaaggagtcggttgaacagaatacattcagagtctattatttgtgatcaggttgtcagtgtaaatattattcctagccctgatgaggctggtgagcaaatccatgtcagtctccccttatcacagcaagtagccaatgagagccgcctctccatgtcagagtctgtttctgagttctttgatgcccaagaggtgctcctctctgcaagttcgtcagagaatgaggcttcagatgatgagtcttacatcagtgatgtgagtgataatatatctgaagacaacaccagtgttgcagacaatatttctcggcaaatcctgaatggggagcttacaggaggggccttccgaaatgggcgtcgagcatgcctgccagctccttgtcctgacaccagtaacattaacctgtggaatatcttgaggaacaacattggtaaagacctgtctaaagtctctatgcctgtggagctaaacgagccgctcaacaccctgcagcacctctgtgaggaaatggaatacagcgagctcctggacaaggcttcggaaactgatgatccatatgagcgcatggttctcgttgccgcatttgcagtttcaggatactgctccacctatttcagagcaggaagtaagccattcaacccagtccttggggagacttatgaatgcattagagaagacaagggattccgctttttctcagaacaggttagccatcatccacccatttctgcctgtcactgtgaatcaaagaattttgtgttttggcaagatatcagatggaaaaacaagttctgggggaagtcgatggaaatcctgcctgttggaacactgaatgtcatgcttccaaagtatggagattactatgtgtggaataaagtcaccacttgcatacacaacatcctcagtgggagaagatggatagaacattatggagaagtaaccatcagaaataccaaaagcagtgtttgcatttgcaaactcacatttgtcaaggtgaattattggaattctaacatgaatgaagtccagggggtggtgatagatcaggaggggaaggcggtgtaccggctgtttggaaagtggcatgaaggactctactgtggtgtggccccctctgcaaagtgcatttggagaccaggttccatgccaacaaactatgagctgtactatggcttcacaaggtttgctattgagctcaatgagttagatccagtactaaaagatctccttccaccaacagacgcccggttccggccagatcaaagatttttggaagaaggaaatttagaagctgcagcatcagagaagcaaagagtagaggaactccagagatctcggagacgatatatggaagaaaacaatcttgaacatataccaaaattttttaaaaaagttattgatgccaatcaaagagaagcctgggtttctaacgacacctactgggagcttcgaaaggaccctgggtttagcaaagtagacagccctgttctttggtagactgggaatgtagagctagccaacatatcacattctgaatgaataaataactatgcacaatt

SEQ ID NO: 163169 - DNA, 2217 bp, Homo sapiens
  Payload ID: 12153
  Gene Symbol: OSBPL6
  Gene Name: oxysterol binding protein-like 6
  Uniprot ID: Q9BZF3
  ENST ID: ENST00000357080
  CDS Start-End: 526-2052
gccgccgccgctgtcggtgctggagatcgcggctcggtgcaggcggcgcccatgcctcctctcctccactagcccgcgcgccagtccgcctgccggggccggctctccgcctcctgcctcccgtcgcagccgcgcagccgccgcagagtccgcggcgccaccgctcgccctccaggttctgccacttgctgggaaaacagcaacagaaggatattaaggagccacccctataatttacccagatagccccagcaaggtcaaagacatatcatgtcccaaggagaaaagctgcaggcatctgaggataaatcactgtgaaacagctttgaccataaagctgacttggaagactttgactccaaggtgcaaggtggtttggacaccctcaatattgcctgctcttttctagtcaaacctgattcatgaaatggaatgaagctgaaaaatcatctacttctttgtttgtggatttgagagaagattgggatggtcttaagtgcataaaacgagactctaactgcagcgatgagttcagatgagaagggcatttcccctgctcataaaacatccactccaacccatagaagtgcctcctcttcaacatcctcccaaagggacagtaggcagagtattcacatactggagaggactgcttcctctagcaccgagccctctgtaagtcggcaattgctagaaccggagccagtccccctctccaaggaagctgacagctgggaaattatagaagggctgaaaataggccaaaccaatgtccagaaaccagacaaacatgagggctttatgctgaagaaaagaaaatggcctttaaaaggctggcacaagcgtttttttgtcctggataatggaatgttaaagtattcaaaggcaccactcgatattcagaaaggaaaggtccatgggagcatagatgtgggactctcagtcatgtcaattaaaaagaaagctcgaagaatagaccttgacaccgaagagcacatctatcatttgaaggtgaaatcccaggactggtttgatgcatgggtctccaaactgcgacatcatcggttgtatcgtcagaatgaaattgtgagatcaccaagagatgctagttttcacatatttccttcaacgtccacagctgaatcctcaccagctgctaatgtttctgtaatggatggaaagatgcaaccaaacagctttccgtggcagtcccctttaccatgcagcaatagcctccctgcaacgtgcacaactggccagagtaaagtggcagcctggttacaggactcggaagagatggacaggtgtgcagaagatcttgcacattgccagtcaaaccttgtggaacttagcaaactcctgcaaaatttggaaatacttcagagaactcagtcggcacctaactttactgacatgcaggttcctttcagtgctaccatgtcaccagttcgcttgcattcctccaaccccaacctttgtgcagatattgaatttcagactccccctagccacctcactgaccctctggaaagttcaacagattatacaaagctgcaagaagaattttgtctaatcgcacagaaagtgcattctcttttgaagtctgcatttaatagcatagctatagagaaggagaagctgaagcagatggtttccgagcaggatcacagtaaaggccacagcacgcagatggcacggctccgacagtcactgtctcaggctggtgagcaaatccatgtcagtctccccttatcacagcaagtagccaatgagagccgcctctccatgtcagagtctgtttctgagttctttgatgcccaagaggtgctcctctctgcaagttcgtcagagaatgaggcttcagatgatgagtcttacatcagtgatgtgagtgataatatatctgaagacaacaccagtgttgcagacaatatttctcggcaaagtatgcatcatttgagcttccaggttgttctatctacatgccaaattgcaacacgaagacttaatgaacaggcattccccctcccacgccacccccacccctgctaattgttcttttggcagctgattgttcaatacattctattttgtatgatctcttgaggtaaatggttgaaaaaatctgttaggtaaatagttaagagaaaacgtttttcctctttctcaaaccaacagcttgagtccttcttattaaatgtatttaattttttaaaa

SEQ ID NO: 163170 - DNA, 7114 bp, Homo sapiens
  Payload ID: 12153
  Gene Symbol: OSBPL6
  Gene Name: oxysterol binding protein-like 6
  Uniprot ID: Q9BZF3
  ENST ID: ENST00000359685
  CDS Start-End: 545-3241
ctggaggcgcagcacggtcgccgccgccgctgtcggtgctggagatcgcggctcggtgcaggcggcgcccatgcctcctctcctccactagcccgcgcgccagtccgcctgccggggccggctctccgcctcctgcctcccgtcgcagccgcgcagccgccgcagagtccgcggcgccaccgctcgccctccaggttctgccacttgctgggaaaacagcaacagaaggatattaaggagccacccctataatttacccagatagccccagcaaggtcaaagacatatcatgtcccaaggagaaaagctgcaggcatctgaggataaatcactgtgaaacagctttgaccataaagctgacttggaagactttgactccaaggtgcaaggtggtttggacaccctcaatattgcctgctcttttctagtcaaacctgattcatgaaatggaatgaagctgaaaaatcatctacttctttgtttgtggatttgagagaagattgggatggtcttaagtgcataaaacgagactctaactgcagcgatgagttcagatgagaagggcatttcccctgctcataaaacatccactccaacccatagaagtgcctcctcttcaacatcctcccaaagggacagtaggcagagtattcacatactggagaggactgcttcctctagcaccgagccctctgtaagtcggcaattgctagaaccggagccagtccccctctccaaggaagctgacagctgggaaattatagaagggctgaaaataggccaaaccaatgtccagaaaccagacaaacatgagggctttatgctgaagaaaagaaaatggcctttaaaaggctggcacaagcgtttttttgtcctggataatggaatgttaaagtattcaaaggcaccactcgatattcagaaaggaaaggtccatgggagcatagatgtgggactctcagtcatgtcaattaaaaagaaagctcgaagaatagaccttgacaccgaagagcacatctatcatttgaaggtgaaatcccaggactggtttgatgcatgggtctccaaactgcgacatcatcggttgtatcgtcagaatgaaattgtgagatcaccaagagatgctagttttcacatatttccttcaacgtccacagctgaatcctcaccagctgctaatgtttctgtaatggatggaaagatgcaaccaaacagctttccgtggcagtcccctttaccatgcagcaatagcctccctgcaacgtgcacaactggccagagtaaagtggcagcctggttacaggactcggaagagatggacaggtgtgcagaagatcttgcacattgccagtcaaaccttgtggaacttagcaaactcctgcaaaatttggaaatacttcagagaactcagtcggcacctaactttactgacatgcaggctaactgtgtagatatttcaaagaaagacaagcgggtcacaagacgatggagaacaaaaagtgtcagcaaagatacaaaaatacaactgcaggttcctttcagtgctaccatgtcaccagttcgcttgcattcctccaaccccaacctttgtgcagatattgaatttcagactccccctagccacctcactgaccctctggaaagttcaacagattatacaaagctgcaagaagaattttgtctaatcgcacagaaagtgcattctcttttgaagtctgcatttaatagcatagctatagagaaggagaagctgaagcagatggtttccgagcaggatcacagtaaaggccacagcacgcagatggcacggctccgacagtcactgtctcaggctggtgagcaaatccatgtcagtctccccttatcacagcaagtagccaatgagagccgcctctccatgtcagagtctgtttctgagttctttgatgcccaagaggtgctcctctctgcaagttcgtcagagaatgaggcttcagatgatgagtcttacatcagtgatgtgagtgataatatatctgaagacaacaccagtgttgcagacaatatttctcggcaaatcctgaatggggagcttacaggaggggccttccgaaatgggcgtcgagcatgcctgccagctccttgtcctgacaccagtaacattaacctgtggaatatcttgaggaacaacattggtaaagacctgtctaaagtctctatgcctgtggagctaaacgagccgctcaacaccctgcagcacctctgtgaggaaatggaatacagcgagctcctggacaaggcttcggaaactgatgatccatatgagcgcatggttctcgttgccgcatttgcagtttcaggatactgctccacctatttcagagcaggaagtaagccattcaacccagtccttggggagacttatgaatgcattagagaagacaagggattccgctttttctcagaacaggttagccatcatccacccatttctgcctgtcactgtgaatcaaagaattttgtgttttggcaagatatcagatggaaaaacaagttctgggggaagtcgatggaaatcctgcctgttggaacactgaatgtcatgcttccaaagtatggagattactatgtgtggaataaagtcaccacttgcatacacaacatcctcagtgggagaagatggatagaacattatggagaagtaaccatcagaaataccaaaagcagtgtttgcatttgcaaactcacatttgtcaaggtgaattattggaattctaacatgaatgaagtccagggggtggtgatagatcaggaggggaaggcggtgtaccggctgtttggaaagtggcatgaaggactctactgtggtgtggccccctctgcaaagtgcatttggagaccaggttccatgccaacaaactatgagctgtactatggcttcacaaggtttgctattgagctcaatgagttagatccagtactaaaagatctccttccaccaacagacgcccggttccggccagatcaaagatttttggaagaaggaaatttagaagctgcagcatcagagaagcaaagagtagaggaactccagagatctcggagacgatatatggaagaaaacaatcttgaacatataccaaaattttttaaaaaagttattgatgccaatcaaagagaagcctgggtttctaacgacacctactgggagcttcgaaaggaccctgggtttagcaaagtagacagccctgttctttggtagactgggaatgtagagctagccaacatatcacattctgaatgaataaataactatgcacaattatgtttcttatagctatgtgtggtttctgggtcaactgaaaacctaccatttgcttttctattcatctttataatggactttcagaagtgcattagacaaggcccctaaccactttgggatcctttctgttttgctgcaaccatattccttaaaaaaaaaaaaaaaaaaaaaaaaaaaatccacaccgtccttggaaagcagaataaaaggagcagaatataaaatccaaagtctgaccagtttgtaaagaaaaacaaatggtaactggtgcttaaagctgatcaagaaagttaacaacaacatagaaaccacacgattgttccactgtctggaagcaccatcccctatcgcaggactcctgggccacaagcagtcggtcagtgcagacttcaagtgtgtctgtttgatgtggtgtgattgtgctggccttgtcgaaaaagatgtgatgcttctcagaacctgttccatctgtatgccattgttcatgccttaagaaatgcaaagatgtacaataaatcatttttaaaatgtgtgctcataggtttatgtgaagaacagattttttgaatcatggcatgattcactttctcaatcaggacaattatgagactaacttaaatgggttttttaaaagtgaacaacacgtgctttactctgataagtcagttaccatatggtatgtctgaagggaaagaaggaaaagacgtgctaagtagatctctgtatttacgtggctcgttaatttcctgtcctgcgtccagataataaaccatccctcttccacctaacctcacagtgtgccctattatttggaaaaatctgtctttgatttggacatttggtcatcagtgttaaaaccttaaaaggaaataacaaaaagcatatggaattcctgtgtgggcttagtagtactataaatgtaattgtttttgagtgaagcaccatgtaatccatgtctcaatcccatgcccgctccactgacactagtcgaattccactgagaacagaagcaagaataatagtagtttatttgcattgtttaaatgaattctatgcaaaatcatatttcaaattttcatcaagtgattccatatggtacatggctacatattaagcatttaccttgctattggcagagatatgaaacttaagctaaggaatgtatccatcccaaagcaggaaagcagaagtgtgttttgcatacttcaggatttgtttttcctccactaatatacagaggcttttgcagaaaacttgcatcagtattcctgtttctgcacgtaggtgactatataaatgcctgtatgttttttttaaaatatctcctcagagattttcctagggaattataaaattacatatattttattgttagttagatgtttattcttggattcttaccattagaatttaagtgttatttaaaactctgatacagttacagacactttacattttattatgaggtgttgattttagtggtatttctcctcagcaaagcattcctaataatggctaatacaccatcaaatgaaaaactgctgatgagagtgtaagagaaagcgctaacgtttccactagatggcgcaatattttatttatccaaaactcctcccttgcatctgagtttttatgttatgtgtacagtctgcattagcttagaatggaatttcattctcaggtaaattttcgaatccatcaccagatctaagcattctgcttcaacaataccctctctattcctctcattcccattttaaatccataggtggcttgccctgcggcagtaaaatcttccccttgatattgattctttttctgctcattcatcttgatgttctttttctgcatcctgagatacatgtcgttaattttaataagaatcctattgacttcctcacgggagtctgttctcctatggttgataaagctttaaatactatttaaagtggttctggtctgtacttactagcacttccctgaacagtctcaaaatagcctaaacataagaaaacaatcctgcaaagtaaaggtttttacaagcagagatgaaggaaagggagcagcagctgaccatcagatgtggtatcaggtagctggaagaggatccaggacccatcagggaagcaacgactgtacttagcaatttgggttataattacaaaaaagaaaaaatagtagaaaggatctttaccagacagtaaggtcatggtacaaatcaggtgagtgaatgttggtcagaggtagcctgacactctgatgaggacttcaagatgagaatgagaaaaatgtctattaaaatcactacatttgataatatctcagatttagaatctcttttgggattcagatagtctgattattccaattcaagtgttcagttaagttttagttactattcctataatacccaattcactaatatcatatctcctgtggaatattcattggtgcgatggcctcatccccttttttactttttattgacatggtggttataaaatgaagagacttactctattggaattttcatctacgtagtatttgggctgtcaagactaaatagcaaaagggtagaatattagatcattctcttaataagacctgatttattccttaggatgttatacaaacctttttatttcaggcctactttcttgttttttcctaaaaggatctaggatagaggagaacataatatgcctgtatacttctcccatggtttattcataagctgcttcatctcattggagatggtcattgaggagagcagtaataagtgacgatgattctgaggacttggctagactgagcggatcaatggcacacaccagcactggtagaggctgaccagaagctcatcgattccatatgctgtcacccagggtgcagatttactctcttttgctgttattttattgtttttcttaaattaagccattgtttttcatggattatttttaaaatacctaccccataattttcaggcaattgtaaaaataaaccttatttaagataacttttaatggtacatatcaactatatgtggggaaaaaatgcaattttctgggcaagagaaaccaaaggattttcaatatatgagatgccaggttgtcaattttctaaaccttttcctctagattattctggccctaggcctttcagcaaccccactaatcaattattagatcctgccccaaggagcagtggcttgggggctggatttagggaggaaaacctgattaaactgttttgcttagtactggttacagctgtagctggagaagagtttataatcataaagtacatttttgttattaccttgtggattttaattatccatcttgtctaatcttgttctctgtcatcctagataatgaggtgtttgtgggagcagagctctgcacacaccaggggatgtaataaatgtttgcacttggcccagtatattatgaatgtggcacagtaaataaagtttgtgtacaaaatactagtttatttctatgggagccattatgttcaggatatataaaatgtatctaattaaacaattttgaatctattttgtgctctagaaatgttcttttggggaaagatggaaagaaatgtataaatggagttaagattaaagtatttggggttttttttccccaaaagcttcccagttgtttagaaataatactatccaaagtaggattcggtcctgtaagtcctaactgaatttcttttgtaaaactgatacgtttaaactgtacattgcataatcattctgttaaactaaacctttgtttaatacataattgtaagagc

SEQ ID NO: 163171 - DNA, 3637 bp, Homo sapiens
  Payload ID: 12153
  Gene Symbol: OSBPL6
  Gene Name: oxysterol binding protein-like 6
  Uniprot ID: Q9BZF3
  ENST ID: ENST00000392505
  CDS Start-End: 545-3424
ctggaggcgcagcacggtcgccgccgccgctgtcggtgctggagatcgcggctcggtgcaggcggcgcccatgcctcctctcctccactagcccgcgcgccagtccgcctgccggggccggctctccgcctcctgcctcccgtcgcagccgcgcagccgccgcagagtccgcggcgccaccgctcgccctccaggttctgccacttgctgggaaaacagcaacagaaggatattaaggagccacccctataatttacccagatagccccagcaaggtcaaagacatatcatgtcccaaggagaaaagctgcaggcatctgaggataaatcactgtgaaacagctttgaccataaagctgacttggaagactttgactccaaggtgcaaggtggtttggacaccctcaatattgcctgctcttttctagtcaaacctgattcatgaaatggaatgaagctgaaaaatcatctacttctttgtttgtggatttgagagaagattgggatggtcttaagtgcataaaacgagactctaactgcagcgatgagttcagatgagaagggcatttcccctgctcataaaacatccactccaacccatagaagtgcctcctcttcaacatcctcccaaagggacagtaggcagagtattcacatactggagaggactgcttcctctagcaccgagccctctgtaagtcggcaattgctagaaccggagccagtccccctctccaaggaagctgacagctgggaaattatagaagggctgaaaataggccaaaccaatgtccagaaaccagacaaacatgagggctttatgctgaagaaaagaaaatggcctttaaaaggctggcacaagcgtttttttgtcctggataatggaatgttaaagtattcaaaggcaccactcgatattcagaaaggaaaggtccatgggagcatagatgtgggactctcagtcatgtcaattaaaaagaaagctcgaagaatagaccttgacaccgaagagcacatctatcatttgaaggtgaaatcccaggactggtttgatgcatgggtctccaaactgcgacatcatcggttgtatcgtcagaatgaaattgtgagatcaccaagagatgctagttttcacatatttccttcaacgtccacagctgaatcctcaccagctgctaatgtttctgtaatggatggaaagatgcaaccaaacagctttccgtggcagtcccctttaccatgcagcaatagcctccctgcaacgtgcacaactggccagagtaaagtggcagcctggttacaggactcggaagagatggacaggtgtgcagaagatcttgcacattgccagtcaaaccttgtggaacttagcaaactcctgcaaaatttggaaatacttcagagaactcagtcggcacctaactttactgacatgcaggctaactgtgtagatatttcaaagaaagacaagcgggtcacaagacgatggagaacaaaaagtgtcagcaaagatacaaaaatacaactgcaggaagggccacccgcgaagggccagttcagcacaactcggcgccggcagaggctagcggcagcagtggctacaacagttcctttcagtgctaccatgtcaccagttcgcttgcattcctccaaccccaacctttgtgcagatattgaatttcagactccccctagccacctcactgaccctctggaaagttcaacagattatacaaagctgcaagaagaattttgtctaatcgcacagaaagtgcattctcttttgaagtctgcatttaatagcatagctatagagaaggagaagctgaagcagatggtttccgagcaggatcacagtaaaggccacagcacgcagatggcacggctccgacagtcactgtctcaggcactcaaccagaatgctgaactaaggagtcggttgaacagaatacattcagagtctattatttgtgatcaggttgtcagtgtaaatattattcctagccctgatgaggctggtgagcaaatccatgtcagtctccccttatcacagcaagtagccaatgagagccgcctctccatgtcagagtctgtttctgagttctttgatgcccaagaggtgctcctctctgcaagttcgtcagagaatgaggcttcagatgatgagtcttacatcagtgatgtgagtgataatatatctgaagacaacaccagtgttgcagacaatatttctcggcaaatcctgaatggggagcttacaggaggggccttccgaaatgggcgtcgagcatgcctgccagctccttgtcctgacaccagtaacattaacctgtggaatatcttgaggaacaacattggtaaagacctgtctaaagtctctatgcctgtggagctaaacgagccgctcaacaccctgcagcacctctgtgaggaaatggaatacagcgagctcctggacaaggcttcggaaactgatgatccatatgagcgcatggttctcgttgccgcatttgcagtttcaggatactgctccacctatttcagagcaggaagtaagccattcaacccagtccttggggagacttatgaatgcattagagaagacaagggattccgctttttctcagaacaggttagccatcatccacccatttctgcctgtcactgtgaatcaaagaattttgtgttttggcaagatatcagatggaaaaacaagttctgggggaagtcgatggaaatcctgcctgttggaacactgaatgtcatgcttccaaagtatggagattactatgtgtggaataaagtcaccacttgcatacacaacatcctcagtgggagaagatggatagaacattatggagaagtaaccatcagaaataccaaaagcagtgtttgcatttgcaaactcacatttgtcaaggtgaattattggaattctaacatgaatgaagtccagggggtggtgatagatcaggaggggaaggcggtgtaccggctgtttggaaagtggcatgaaggactctactgtggtgtggccccctctgcaaagtgcatttggagaccaggttccatgccaacaaactatgagctgtactatggcttcacaaggtttgctattgagctcaatgagttagatccagtactaaaagatctccttccaccaacagacgcccggttccggccagatcaaagatttttggaagaaggaaatttagaagctgcagcatcagagaagcaaagagtagaggaactccagagatctcggagacgatatatggaagaaaacaatcttgaacatataccaaaattttttaaaaaagttattgatgccaatcaaagagaagcctgggtttctaacgacacctactgggagcttcgaaaggaccctgggtttagcaaagtagacagccctgttctttggtagactgggaatgtagagctagccaacatatcacattctgaatgaataaataactatgcacaattatgtttcttatagctatgtgtggtttctgggtcaactgaaaacctaccatttgcttttctattcatctttataatggactttcagaagtgcattagacaaggcccctaaccactttgggatcctttctgttttgctgcaaccatattcctt

SEQ ID NO: 163172 - DNA, 3273 bp, Homo sapiens
  Payload ID: 12153
  Gene Symbol: OSBPL6
  Gene Name: oxysterol binding protein-like 6
  Uniprot ID: Q9BZF3
  ENST ID: ENST00000409631
  CDS Start-End: 351-3047
gttctgccacttgctgggaaaacagcaacagaaggatattaaggagccacccctataatttacccagatagccccagcaaggtcaaagacatatcatgtcccaaggagaaaagctgcaggcatctgaggataaatcactgtgaaacagctttgaccataaagctgacttggaagactttgactccaaggtgcaaggtggtttggacaccctcaatattgcctgctcttttctagtcaaacctgattcatgaaatggaatgaagctgaaaaatcatctacttctttgtttgtggatttgagagaagattgggatggtcttaagtgcataaaacgagactctaactgcagcgatgagttcagatgagaagggcatttcccctgctcataaaacatccactccaacccatagaagtgcctcctcttcaacatcctcccaaagggacagtaggcagagtattcacatactggagaggactgcttcctctagcaccgagccctctgtaagtcggcaattgctagaaccggagccagtccccctctccaaggaagctgacagctgggaaattatagaagggctgaaaataggccaaaccaatgtccagaaaccagacaaacatgagggctttatgctgaagaaaagaaaatggcctttaaaaggctggcacaagcgtttttttgtcctggataatggaatgttaaagtattcaaaggcaccactcgatattcagaaaggaaaggtccatgggagcatagatgtgggactctcagtcatgtcaattaaaaagaaagctcgaagaatagaccttgacaccgaagagcacatctatcatttgaaggtgaaatcccaggactggtttgatgcatgggtctccaaactgcgacatcatcggttgtatcgtcagaatgaaattgtgagatcaccaagagatgctagttttcacatatttccttcaacgtccacagctgaatcctcaccagctgctaatgtttctgtaatggatggaaagatgcaaccaaacagctttccgtggcagtcccctttaccatgcagcaatagcctccctgcaacgtgcacaactggccagagtaaagtggcagcctggttacaggactcggaagagatggacaggtgtgcagaagatcttgcacattgccagtcaaaccttgtggaacttagcaaactcctgcaaaatttggaaatacttcagagaactcagtcggcacctaactttactgacatgcaggctaactgtgtagatatttcaaagaaagacaagcgggtcacaagacgatggagaacaaaaagtgtcagcaaagatacaaaaatacaactgcaggttcctttcagtgctaccatgtcaccagttcgcttgcattcctccaaccccaacctttgtgcagatattgaatttcagactccccctagccacctcactgaccctctggaaagttcaacagattatacaaagctgcaagaagaattttgtctaatcgcacagaaagtgcattctcttttgaagtctgcatttaatagcatagctatagagaaggagaagctgaagcagatggtttccgagcaggatcacagtaaaggccacagcacgcagatggcacggctccgacagtcactgtctcaggctggtgagcaaatccatgtcagtctccccttatcacagcaagtagccaatgagagccgcctctccatgtcagagtctgtttctgagttctttgatgcccaagaggtgctcctctctgcaagttcgtcagagaatgaggcttcagatgatgagtcttacatcagtgatgtgagtgataatatatctgaagacaacaccagtgttgcagacaatatttctcggcaaatcctgaatggggagcttacaggaggggccttccgaaatgggcgtcgagcatgcctgccagctccttgtcctgacaccagtaacattaacctgtggaatatcttgaggaacaacattggtaaagacctgtctaaagtctctatgcctgtggagctaaacgagccgctcaacaccctgcagcacctctgtgaggaaatggaatacagcgagctcctggacaaggcttcggaaactgatgatccatatgagcgcatggttctcgttgccgcatttgcagtttcaggatactgctccacctatttcagagcaggaagtaagccattcaacccagtccttggggagacttatgaatgcattagagaagacaagggattccgctttttctcagaacaggttagccatcatccacccatttctgcctgtcactgtgaatcaaagaattttgtgttttggcaagatatcagatggaaaaacaagttctgggggaagtcgatggaaatcctgcctgttggaacactgaatgtcatgcttccaaagtatggagattactatgtgtggaataaagtcaccacttgcatacacaacatcctcagtgggagaagatggatagaacattatggagaagtaaccatcagaaataccaaaagcagtgtttgcatttgcaaactcacatttgtcaaggtgaattattggaattctaacatgaatgaagtccagggggtggtgatagatcaggaggggaaggcggtgtaccggctgtttggaaagtggcatgaaggactctactgtggtgtggccccctctgcaaagtgcatttggagaccaggttccatgccaacaaactatgagctgtactatggcttcacaaggtttgctattgagctcaatgagttagatccagtactaaaagatctccttccaccaacagacgcccggttccggccagatcaaagatttttggaagaaggaaatttagaagctgcagcatcagagaagcaaagagtagaggaactccagagatctcggagacgatatatggaagaaaacaatcttgaacatataccaaaattttttaaaaaagttattgatgccaatcaaagagaagcctgggtttctaacgacacctactgggagcttcgaaaggaccctgggtttagcaaagtagacagccctgttctttggtagactgggaatgtagagctagccaacatatcacattctgaatgaataaataactatgcacaattatgtttcttatagctatgtgtggtttctgggtcaactgaaaacctaccatttgcttttctattcatctttataatggactttcagaagtgcattagacaaggcccctaaccactttgggatcctttctgttttgctgcaaccatattccttaaaaaaaaaaaaa

SEQ ID NO: 163173 - DNA, 3427 bp, Homo sapiens
  Payload ID: 12153
  Gene Symbol: OSBPL6
  Gene Name: oxysterol binding protein-like 6
  Uniprot ID: Q9BZF3
  ENST ID: ENST00000409045
  CDS Start-End: 503-3214
agatcgcggctcggtgcaggcggcgcccatgcctcctctcctccactagcccgcgcgccagtccgcctgccggggccggctctccgcctcctgcctcccgtcgcagccgcgcagccgccgcagagtccgcggcgccaccgctcgccctccaggttctgccacttgctgggaaaacagcaacagaaggatattaaggagccacccctataatttacccagatagccccagcaaggtcaaagacatatcatgtcccaaggagaaaagctgcaggcatctgaggataaatcactgtgaaacagctttgaccataaagctgacttggaagactttgactccaaggtgcaaggtggtttggacaccctcaatattgcctgctcttttctagtcaaacctgattcatgaaatggaatgaagctgaaaaatcatctacttctttgtttgtggatttgagagaagattgggatggtcttaagtgcataaaacgagactctaactgcagcgatgagttcagatgagaagggcatttcccctgctcataaaacatccactccaacccatagaagtgcctcctcttcaacatcctcccaaagggacagtaggcagagtattcacatactggagaggactgcttcctctagcaccgagccctctgtaagtcggcaattgctagaaccggagccagtccccctctccaaggaagctgacagctgggaaattatagaagggctgaaaataggccaaaccaatgtccagaaaccagacaaacatgagggctttatgctgaagaaaagaaaatggcctttaaaaggctggcacaagcgtttttttgtcctggataatggaatgttaaagtattcaaaggcaccactcgatattcagaaaggaaaggtccatgggagcatagatgtgggactctcagtcatgtcaattaaaaagaaagctcgaagaatagaccttgacaccgaagagcacatctatcatttgaaggtgaaatcccaggactggtttgatgcatgggtctccaaactgcgacatcatcggttgtatcgtcagaatgaaattgtgagatcaccaagagatgctagttttcacatatttccttcaacgtccacagctgaatcctcaccagctgctaatgtttctgtaatggatggaaagatgcaaccaaacagctttccgtggcagtcccctttaccatgcagcaatagcctccctgcaacgtgcacaactggccagagtaaagtggcagcctggttacaggactcggaagagatggacaggtgtgcagaagatcttgcacattgccagtcaaaccttgtggaacttagcaaactcctgcaaaatttggaaatacttcagagaactcagtcggcacctaactttactgacatgcaggttcctttcagtgctaccatgtcaccagttcgcttgcattcctccaaccccaacctttgtgcagatattgaatttcagactccccctagccacctcactgaccctctggaaagttcaacagattatacaaagctgcaagaagaattttgtctaatcgcacagaaagtgcattctcttttgaagtctgcatttaatagcatagctatagagaaggagaagctgaagcagatggtttccgagcaggatcacagtaaaggccacagcacgcagatggcacggctccgacagtcactgtctcaggcactcaaccagaatgctgaactaaggagtcggttgaacagaatacattcagagtctattatttgtgatcaggttgtcagtgtaaatattattcctagccctgatgaggctggtgagcaaatccatgtcagtctccccttatcacagcaagtagccaatgagagccgcctctccatgtcagagtctgtttctgagttctttgatgcccaagaggtgctcctctctgcaagttcgtcagagaatgaggcttcagatgatgagtcttacatcagtgatgtgagtgataatatatctgaagacaacaccagtgttgcagacaatatttctcggcaaatcctgaatggggagcttacaggaggggccttccgaaatgggcgtcgagcatgcctgccagctccttgtcctgacaccagtaacattaacctgtggaatatcttgaggaacaacattggtaaagacctgtctaaagtctctatgcctgtggagctaaacgagccgctcaacaccctgcagcacctctgtgaggaaatggaatacagcgagctcctggacaaggcttcggaaactgatgatccatatgagcgcatggttctcgttgccgcatttgcagtttcaggatactgctccacctatttcagagcaggaagtaagccattcaacccagtccttggggagacttatgaatgcattagagaagacaagggattccgctttttctcagaacaggttagccatcatccacccatttctgcctgtcactgtgaatcaaagaattttgtgttttggcaagatatcagatggaaaaacaagttctgggggaagtcgatggaaatcctgcctgttggaacactgaatgtcatgcttccaaagtatggagattactatgtgtggaataaagtcaccacttgcatacacaacatcctcagtgggagaagatggatagaacattatggagaagtaaccatcagaaataccaaaagcagtgtttgcatttgcaaactcacatttgtcaaggtgaattattggaattctaacatgaatgaagtccagggggtggtgatagatcaggaggggaaggcggtgtaccggctgtttggaaagtggcatgaaggactctactgtggtgtggccccctctgcaaagtgcatttggagaccaggttccatgccaacaaactatgagctgtactatggcttcacaaggtttgctattgagctcaatgagttagatccagtactaaaagatctccttccaccaacagacgcccggttccggccagatcaaagatttttggaagaaggaaatttagaagctgcagcatcagagaagcaaagagtagaggaactccagagatctcggagacgatatatggaagaaaacaatcttgaacatataccaaaattttttaaaaaagttattgatgccaatcaaagagaagcctgggtttctaacgacacctactgggagcttcgaaaggaccctgggtttagcaaagtagacagccctgttctttggtagactgggaatgtagagctagccaacatatcacattctgaatgaataaataactatgcacaattatgtttcttatagctatgtgtggtttctgggtcaactgaaaacctaccatttgcttttctattcatctttataatggactttcagaagtgcattagacaaggcccctaaccactttgggatcctttctgttttgctgcaaccatattcctt

SEQ ID NO: 163174 - DNA, 3640 bp, Homo sapiens
  Payload ID: 12154
  Gene Symbol: OSBPL7
  Gene Name: oxysterol binding protein-like 7
  Uniprot ID: Q9BZF2
  ENST ID: ENST00000007414
  CDS Start-End: 193-2721
tgccactgctcagcgcggtgaggagggagccggtgactcggagacggtgactcagaggcagagcggcgcaagggccaaggagtactggcgtccatggaccctggggaccccgtcaggagcaggtgacatccttccccttccaccctgctccctgctctacatccccagcagggagtggcctctcccttctccatggacttccaagagagggacccgcccttcctgcctgagagcgctcagtcctcaaagcccagcagtgctcagcaggcctctgagctgtgggaggtggtggaggagcctcgggtcaggctggggacagagggtgtcatgcctgagaggcaggaaggtcacctgctcaagaagaggaagtggcctctgaagggctggcacaagagatactttgtgctcgaggacgggatccttcattatgcaacaacccggcaagacatcaccaaggggaagctccatggctccatcgatgtccggctgtcggtcatgtccatcaacaaaaaggcccagcgcattgaccttgacactgaagacaacatctaccacctcaagatcaaatcccaggacctattccagagctgggtggcgcagctgcgtgcccaccgcctagcccaccgcctggacatgccccgtggctcactgcccagtactgctcaccggaaggttcctggtgcccagcttccaacagcagctactgcctcagccctacctgggcttggaccgcgggagaaagtgtcttcctggctgagggacagtgatgggctggaccgctgctctcatgagctctctgagtgtcaggggaagctccaggaactacacaggctcctccagagcctggagtccctgcaccgaatcccctcagcccctgttatccccacacaccaggcctcagtgacaaccgaaagacccaagaaggggaaacggacaagccgcatgtggtgcacccagagctttgccaaggatgacaccattggacgggttggtcgtctccatggctctgttcccaacctgtctcgctacctggagtctcgggactcctcgggcacccgtgggctgccacccacagactatgcccacctgcagcgcagcttctgggccctggcccagaaggtgcacagctccctcagcagcgtcctggccgccctcaccatggaacgggaccaactgagggacatgcaccagggctcagagttgtcaagaatgggggtctctgaggcctccactggccagaggcgcctccactcactgtccacctcctccgacaccacggcggactctttcagctccctcaaccctgaggagcaagaagctctgtacatgaaggggcgcgagctcaccccccagctatcgcagaccagcatcctgtcccttgctgattcccacacggagttcttcgatgcctgcgaggttctcctctccgccagctcttctgagaatgagggctcagaggaggaggagtcctgtaccagtgaaatcaccaccagcctgtctgaggagatgctggacctcaggggagctgagcgctgtcagaaaggggggtgtgttccagggagacccatggggccaccccgccgtcgctgcctgccggcggccagcgggcctggggctgacgtgagcctgtggaacattctgcgcaacaacatcggcaaagacctgtccaaggtgtcaatgcctgtgcagctcaacgagccgctcaacactctgcagcggctctgcgaggagctggagtacagcagcctcctggaccaggccagccgcatcgccgacccctgcgagcgcatggtgtacatcgcagcctttgctgtctcggcctactcctccacataccaccgagccggctgcaagcccttcaaccctgtcctgggggagacctacgagtgtgagcggcctgaccgaggcttccgcttcatcagtgagcaggtctcccaccacccccctatctcggcctgccatgcagagtctgagaacttcgccttctggcaagatatgaagtggaagaacaagttctggggcaaatccctggagattgtgcctgtgggaacagtcaacgtcagcctgcccaggtttggggaccactttgagtggaacaaggtgacatcctgcattcacaatgtcctgagtggtcagcgctggatcgagcactatggggaggtgctcatccgaaacacacaggacagctcctgccactgcaagatcaccttctgcaaggccaagtactggagttccaatgtccacgaggtgcagggcgctgtgctcagtcggagtggccgtgtcctccaccgactctttgggaagtggcacgaggggctgtaccggggacccacgccaggtggccagtgcatctggaaacccaactcaatgccccccgaccatgagcgaaacttcggcttcacccagtttgccttggagctgaatgagctgacagcagagctgaaacggtcgctgccttccaccgacacgagactccggccagaccagaggtacctggaggaggggaacatacaggccgctgaggcccagaagagaaggatcgagcagctgcagcgagacaggcgcaaagtcatggaggaaaacaacatcgtacaccaggctcgcttcttcaggcggcagacggatagcagcgggaaagagtggtgggtgaccaacaatacctactggaggctgcgggccgagccaggctatgggaacatggatggggccgtgctctggtagccctggccccgggggcaggaggctctggttcctcactcctcctgcctccaccccctaccatggacacatgggtgaggccgggctccccgcctcactgcccttgagaccaaaggggcagccctggccctccctcccctctgctggccagagggtctgcatctcagcccacccccaaccccaccgtttggggtgagaagcagaatctgtgcttccccagtctccttgccccagacaaccagcatgtaagacccttcccgcttcaccattccgattcctgtcccctttggggtacttgggggagactctggctcccaggatctgttccctatttcagtgccttcctaggacacaggggactccttgacgctccccaggctttctgtgcccaggcctctgtccccagcggtgaggttgcagtgagtgaaggagaggaggtgatctgttctccctccccttctgcccatctccagcatcttcttccccttccctggccctgcagggccttctccagctccctttggttagtccctggccatccctcctgtcctggatcccttctccctaactgcaaaatgcctgcagcttccagctccttcgtccctgatcctcaagcggttccctcccgtctcagctcagcggatcccccagagtggaggaggcctctccatgaggaggggagcagcccaaggcacctgtcctctgacccaccggcagcgagtgcgcaggtgtgagtgtaagttcatgtaggagagtgtatgcgtgtgcgcctgtgccctgcttgcaggcaagcagggctccctcatgtagccccgccttccccctgctgggggtccaccacatcgctgctctttctcacagtctgcctctgatgagggcgaattgctatgacattccaagctccaataaagactgtcccaga

SEQ ID NO: 163175 - DNA, 3349 bp, Homo sapiens
  Payload ID: 12154
  Gene Symbol: OSBPL7
  Gene Name: oxysterol binding protein-like 7
  Uniprot ID: Q9BZF2
  ENST ID: ENST00000392507
  CDS Start-End: 257-2785
ggggagatccggctagaggggaggctctgacatctccttccttcctggttcctgcagcagctgctgccactgctcagcgcggtgaggagggagccggtgactcggagacggtgactcagaggcagagcggcgcaagggccaaggagtactggcgtccatggaccctggggaccccgtcaggagcaggtgacatccttccccttccaccctgctccctgctctacatccccagcagggagtggcctctcccttctccatggacttccaagagagggacccgcccttcctgcctgagagcgctcagtcctcaaagcccagcagtgctcagcaggcctctgagctgtgggaggtggtggaggagcctcgggtcaggctggggacagagggtgtcatgcctgagaggcaggaaggtcacctgctcaagaagaggaagtggcctctgaagggctggcacaagagatactttgtgctcgaggacgggatccttcattatgcaacaacccggcaagacatcaccaaggggaagctccatggctccatcgatgtccggctgtcggtcatgtccatcaacaaaaaggcccagcgcattgaccttgacactgaagacaacatctaccacctcaagatcaaatcccaggacctattccagagctgggtggcgcagctgcgtgcccaccgcctagcccaccgcctggacatgccccgtggctcactgcccagtactgctcaccggaaggttcctggtgcccagcttccaacagcagctactgcctcagccctacctgggcttggaccgcgggagaaagtgtcttcctggctgagggacagtgatgggctggaccgctgctctcatgagctctctgagtgtcaggggaagctccaggaactacacaggctcctccagagcctggagtccctgcaccgaatcccctcagcccctgttatccccacacaccaggcctcagtgacaaccgaaagacccaagaaggggaaacggacaagccgcatgtggtgcacccagagctttgccaaggatgacaccattggacgggttggtcgtctccatggctctgttcccaacctgtctcgctacctggagtctcgggactcctcgggcacccgtgggctgccacccacagactatgcccacctgcagcgcagcttctgggccctggcccagaaggtgcacagctccctcagcagcgtcctggccgccctcaccatggaacgggaccaactgagggacatgcaccagggctcagagttgtcaagaatgggggtctctgaggcctccactggccagaggcgcctccactcactgtccacctcctccgacaccacggcggactctttcagctccctcaaccctgaggagcaagaagctctgtacatgaaggggcgcgagctcaccccccagctatcgcagaccagcatcctgtcccttgctgattcccacacggagttcttcgatgcctgcgaggttctcctctccgccagctcttctgagaatgagggctcagaggaggaggagtcctgtaccagtgaaatcaccaccagcctgtctgaggagatgctggacctcaggggagctgagcgctgtcagaaaggggggtgtgttccagggagacccatggggccaccccgccgtcgctgcctgccggcggccagcgggcctggggctgacgtgagcctgtggaacattctgcgcaacaacatcggcaaagacctgtccaaggtgtcaatgcctgtgcagctcaacgagccgctcaacactctgcagcggctctgcgaggagctggagtacagcagcctcctggaccaggccagccgcatcgccgacccctgcgagcgcatggtgtacatcgcagcctttgctgtctcggcctactcctccacataccaccgagccggctgcaagcccttcaaccctgtcctgggggagacctacgagtgtgagcggcctgaccgaggcttccgcttcatcagtgagcaggtctcccaccacccccctatctcggcctgccatgcagagtctgagaacttcgccttctggcaagatatgaagtggaagaacaagttctggggcaaatccctggagattgtgcctgtgggaacagtcaacgtcagcctgcccaggtttggggaccactttgagtggaacaaggtgacatcctgcattcacaatgtcctgagtggtcagcgctggatcgagcactatggggaggtgctcatccgaaacacacaggacagctcctgccactgcaagatcaccttctgcaaggccaagtactggagttccaatgtccacgaggtgcagggcgctgtgctcagtcggagtggccgtgtcctccaccgactctttgggaagtggcacgaggggctgtaccggggacccacgccaggtggccagtgcatctggaaacccaactcaatgccccccgaccatgagcgaaacttcggcttcacccagtttgccttggagctgaatgagctgacagcagagctgaaacggtcgctgccttccaccgacacgagactccggccagaccagaggtacctggaggaggggaacatacaggccgctgaggcccagaagagaaggatcgagcagctgcagcgagacaggcgcaaagtcatggaggaaaacaacatcgtacaccaggctcgcttcttcaggcggcagacggatagcagcgggaaagagtggtgggtgaccaacaatacctactggaggctgcgggccgagccaggctatgggaacatggatggggccgtgctctggtagccctggccccgggggcaggaggctctggttcctcactcctcctgcctccaccccctaccatggacacatgggtgaggccgggctccccgcctcactgcccttctgcccatctccagcatcttcttccccttccctggccctgcagggccttctccagctccctttggttagtccctggccatccctcctgtcctggatcccttctccctaactgcaaaatgcctgcagcttccagctccttcgtccctgatcctcaagcggttccctcccgtctcagctcagcggatcccccagagtggaggaggcctctccatgaggaggggagcagcccaaggcacctgtcctctgacccaccggcagcgagtgcgcaggtgtgagtgtaagttcatgtaggagagtgtatgcgtgtgcgcctgtgccctgcttgcaggcaagcagggctccctcatgtagccccgccttccccctgctgggggtccaccacatcgctgctctttctcacagtctgcctctgatgagggcgaattgctatgacattccaagctccaataaagactgtcccag

SEQ ID NO: 163176 - DNA, 4104 bp, Homo sapiens
  Payload ID: 12154
  Gene Symbol: OSBPL7
  Gene Name: oxysterol binding protein-like 7
  ENST ID: ENST00000579728
  CDS Start-End: 581-1843
ggctggggagttttctgcaagatcatggcagagaagtctctgagctacggtggcagggtggaggggtcctgaaggcagaggcagctggattgaggaggtctcgcttgtccagtctctgaacccctctgtctcttcttggagcctcttctgtcactcccttgcttcacctctgagcactcccagggaagcctctaaagaaagcactgaatgtttcttggagccccagagtatgtgcccaaggcggggctgggcatatgtcttgtggttttccctgggcacctgcccgtctgctgtgtgctagttcactctcagggcagtgtccatatcaggtgaaaatgggtggggtcgggacagaggggcagacttgggagaggcttggcaggtgagcagagggtatgttggggagcccttatctcagagggtgtgggaggggctggaggtggggaaggtgatagcagagtttgcgttaagggggtctttctcttgcttcaaggaccccgtcaggagcaggtgacatccttccccttccaccctgctccctgctctacatccccagcagggagtggcctctcccttctccatggacttccaagagagggacccgcccttcctgcctgagagcgctcagtcctcaaagcccagcagtgctcagcaggcctctgagctgtgggaggtggtggaggagcctcgggtcaggctggggacagagggtgtcatgcctgagaggcaggaaggtcacctgctcaagaagaggaagtggcctctgaagggctggcacaagagatactttgtgctcgaggacgggatccttcattatgcaacaacccggcaagacatcaccaaggggaagctccatggctccatcgatgtccggctgtcggtcatgtccatcaacaaaaaggcccagcgcattgaccttgacactgaagacaacatctaccacctcaagatcaaatcccaggacctattccagagctgggtggcgcagctgcgtgcccaccgcctagcccaccgcctggacatgccccgtggctcactgcccagtactgctcaccggaaggttcctggtgcccagcttccaacagcagctactgcctcagccctacctgggcttggaccgcgggagaaagtgtcttcctggctgagggacagtgatgggctggaccgctgctctcatgagctctctgagtgtcaggggaagctccaggaactacacaggctcctccagagcctggagtccctgcaccgaatcccctcagcccctgttatccccacacaccaggcctcagtgacaaccgaaagacccaagaaggggaaacggacaagccgcatgtggtgcacccagagctttgccaaggatgacaccattggacgggttggtcgtctccatggctctgttcccaacctgtctcgctacctggagtctcgggactcctcgggcacccgtgggctgccacccacagactatgcccacctgcagcgcagcttctgggccctggcccagaaggtgcacagctccctcagcagcgtcctggccgccctcaccatggaacgggaccaactgagggacatgcaccagggctcagagttgtcaagaatgggggtctctgaggcctccactggccagaggcgcctccactcactgtccacctcctccgacaccacggcggactctttcagctccctcaaccctgaggagcaagaagctctgtacatgaaggggcgcgagctcaccccccagctatcgcagaccagcatcctgtcccttgctgattcccacacggagttcttcgatgcctgcgaggttctcctctccgccagctcttctgagaatgagggctagttgggcagattcttgccaggccctgggcactgcccagctgcccgggggaggcccagtctgcccggcctgtcatctgtcctggcccagggctcagaggaggaggagtcctgtaccagtgaaatcaccaccagcctgtctgaggagatgctggacctcaggggagctgagcgctgtcagaaagggagacccatggggccaccccgccgtcgctgcctgccggcggccagcgggcctggggctgacgtgagcctgtggaacattctgcgcaacaacatcggcaaagacctgtccaaggtgtcaatgcctgtgcagctcaacgagccgctcaacactctgcagcggctctgcgaggagctggagtacagcagcctcctggaccaggccagccgcatcgccgacccctgcgagcgcatggtgtacatcgcagcctttgctgtctcggcctactcctccacataccaccgagccggctgcaagcccttcaaccctgtcctgggggagacctacgagtgtgagcggcctgaccgaggcttccgcttcatcagtgagcaggtctcccaccacccccctatctcggcctgccatgcagagtctgagaacttcgccttctggcaagatatgaagtggaagaacaagttctggggcaaatccctggagattgtgcctgtgggaacagtcaacgtcagcctgcccaggtttggggaccactttgagtggaacaaggtgacatcctgcattcacaatgtcctgagtggtcagcgctggatcgagcactatggggaggtgctcatccgaaacacacaggacagctcctgccactgcaagatcaccttctgcaaggccaagtactggagttccaatgtccacgaggtgcagggcgctgtgctcagtcggagtggccgtgtcctccaccgactctttgggaagtggcacgaggggctgtaccggggacccacgccaggtggccagtgcatctggaaacccaactcaatgccccccgaccatgagcgaaacttcggcttcacccagtttgccttggagctgaatgagctgacagcagagctgaaacggtcgctgccttccaccgacacgagactccggccagaccagaggtacctggaggaggggaacatacaggccgctgaggcccagaagagaaggatcgagcagctgcagcgagacaggcgcaaagtcatggaggaaaacaacatcgtacaccaggctcgcttcttcaggcggcagacggatagcagcgggaaagagtggtgggtgaccaacaatacctactggaggctgcgggccgagccaggctatgggaacatggatggggccgtgctctggtagccctggccccgggggcaggaggctctggttcctcactcctcctgcctccaccccctaccatggacacatgggtgaggccgggctccccgcctcactgcccttgagaccaaaggggcagccctggccctccctcccctctgctggccagagggtctgcatctcagcccacccccaaccccaccgtttggggtgagaagcagaatctgtgcttccccagtctccttgccccagacaaccagcatgtaagacccttcccgcttcaccattccgattcctgtcccctttggggtacttgggggagactctggctcccaggatctgttccctatttcagtgccttcctaggacacaggggactccttgacgctccccaggctttctgtgcccaggcctctgtccccagcggtgaggttgcagtgagtgaaggagaggaggtgatctgttctccctccccttctgcccatctccagcatcttcttccccttccctggccctgcagggccttctccagctccctttggttagtccctggccatccctcctgtcctggatcccttctccctaactgcaaaatgcctgcagcttccagctccttcgtccctgatcctcaagcggttccctcccgtctcagctcagcggatcccccagagtggaggaggcctctccatgaggaggggagcagcccaaggcacctgtcctctgacccaccggcagcgagtgcgcaggtgtgagtgtaagttcatgtaggagagtgtatgcgtgtgcgcctgtgccctgcttgcaggcaagcagggctccctcatgtagccccgccttccccctgctgggggtccaccacatcgctgctctttctcacagtctgcctctgatgagggcgaattgctatgacattccaagctccaataaagactgtccca

SEQ ID NO: 163177 - DNA, 430 bp, Homo sapiens
  Payload ID: 12154
  Gene Symbol: OSBPL7
  Gene Name: oxysterol binding protein-like 7
  ENST ID: ENST00000578461
  CDS Start-End: 1-60
cggggacccacgccaggtggccagtgcatctggaaacccatttgccttggagctgaatgagctgacagcagagctgaaacggtcgctgccttccaccgacacgagactccggccagaccagaggtacctggaggaggggaacatacaggccgctgaggcccagaagagaaggatcgagcagctgcagcgagacaggcgcaaagtcatggaggaaaacaacatcgtacaccaggctcgcttcttcaggcggcagacggatagcagcgggaaagagtggtgggtgaccaacaatacctactggaggctgcgggccgagccaggctatgggaacatggatggggccgtgctctggtagccctggccccgggggcaggaggctctggttcctcactcctcctgcctccaccccctaccatggacacatgggtga

SEQ ID NO: 163178 - DNA, 2836 bp, Homo sapiens
  Payload ID: 12154
  Gene Symbol: OSBPL7
  Gene Name: oxysterol binding protein-like 7
  Uniprot ID: Q9BZF2
  ENST ID: ENST00000613735
  CDS Start-End: 203-1276
cagcagctgctgccactgctcagcgcggtgaggagggagccggtgactcggagacggtgactcagaggcagagcggcgcaagggccaaggagtactggcgtccatggaccctggggaccccgtcaggagcaggtgacatccttccccttccaccctgctccctgctctacatccccagcagggagtggcctctcccttctccatggacttccaagagagggacccgcccttcctgcctgagagcgctcagtcctcaaagcccagcagtgctcagcaggcctctgagctgtgggaggtggtggaggagcctcgggtcaggctggggacagagggtgtcatgcctgagaggcaggaaggtcacctgctcaagaagaggaagtggcctctgaagggctggcacaagagatactttgtgctcgaggacgggatccttcattatgcaacaacccggcaagacatcaccaaggggaagctccatggctccatcgatgtccggctgtcggtcatgtccatcaacaaaaaggcccagcgcattgaccttgacactgaagacaacatctaccacctcaagatcaaatcccaggacctattccagagctgggtggcgcagctgcgtgcccaccgcctagcccaccgcctggacatgccccgtggctcactgcccagtactgctcaccggaaggttcctggtgcccagcttccaacagcagctactgcctcagccctacctgggcttggaccgcgggagaaagtgtcttcctggctgagggacagtgatgggctggaccgctgctctcatgagctctctgagtgtcaggggaagctccaggaactacacaggctcctccagagcctggagtccctgcaccgaatcccctcagcccctgttatccccacacaccaggcctcagtgacaaccgaaagacccaagaaggggaaacggacaagccgcatgtggtgcacccagagctttgccaaggatgacaccattggacgggttggtcgtctccatggctctgttcccaacctgtctcgctacctggagtctcgggactcctcgggcacccgtgggctgccacccacagactatgcccacctgcagcgcagcttctgggccctggcccagaaggtgcacagctccctcagcagcgtcctggccgccctcaccatggaacgggaccaactgagggacatgcaccagggctcagagttgtcaagaatgggggtgaggcctgggggacagggtgactggtgcggggagagggcttcaagctgaggactgccagcctggggtccgatagcagatctgggtcagggtggggggttggcagaggcagtctctgcagagatgcggcaaggtggggaggacctcatcctcctggcaccgtgtccctcaccctctccctgcaggtctctgaggcctccactggccagaggcgcctccactcactgtccacctcctccgacaccacggcggactctttcagctccctcaaccctgaggagcaagaagctctgtaccggggacccacgccaggtggccagtgcatctggaaacccaactcaatgccccccgaccatgagcgaaacttcggcttcacccagtttgccttggagctgaatgagctgacagcagagctgaaacggtcgctgccttccaccgacacgagactccggccagaccagaggtacctggaggaggggaacatacaggccgctgaggcccagaagagaaggatcgagcagctgcagcgagacaggcgcaaagtcatggaggaaaacaacatcgtacaccaggctcgcttcttcaggcggcagacggatagcagcgggaaagagtggtgggtgaccaacaatacctactggaggctgcgggccgagccaggctatgggaacatggatggggccgtgctctggtagccctggccccgggggcaggaggctctggttcctcactcctcctgcctccaccccctaccatggacacatgggtgaggccgggctccccgcctcactgcccttgagaccaaaggggcagccctggccctccctcccctctgctggccagagggtctgcatctcagcccacccccaaccccaccgtttggggtgagaagcagaatctgtgcttccccagtctccttgccccagacaaccagcatgtaagacccttcccgcttcaccattccgattcctgtcccctttggggtacttgggggagactctggctcccaggatctgttccctatttcagtgccttcctaggacacaggggactccttgacgctccccaggctttctgtgcccaggcctctgtccccagcggtgaggttgcagtgagtgaaggagaggaggtgatctgttctccctccccttctgcccatctccagcatcttcttccccttccctggccctgcagggccttctccagctccctttggttagtccctggccatccctcctgtcctggatcccttctccctaactgcaaaatgcctgcagcttccagctccttcgtccctgatcctcaagcggttccctcccgtctcagctcagcggatcccccagagtggaggaggcctctccatgaggaggggagcagcccaaggcacctgtcctctgacccaccggcagcgagtgcgcaggtgtgagtgtaagttcatgtaggagagtgtatgcgtgtgcgcctgtgccctgcttgcaggcaagcagggctccctcatgtagccccgccttccccctgctgggggtccaccacatcgctgctctttctcacagtctgcctctgatgagggcgaattgctatgacattccaagctccaataaagactgtccc

SEQ ID NO: 163179 - DNA, 7239 bp, Homo sapiens
  Payload ID: 12155
  Gene Symbol: OSBPL8
  Gene Name: oxysterol binding protein-like 8
  Uniprot ID: Q9BZF1
  ENST ID: ENST00000261183
  CDS Start-End: 481-3150
cactagaatgtgaaggatcttcgcggttctgggtgcccagaaaggcggcgacgcggcggatgacaacattaggccgcgacgcgctcctggccaggcggcggctgtagtgttagctttggacgccgcagtagccgctgccggtagcaagccgactgagggaaggtgggggtccgcccgggctggtggacctcggggccgaaagttcccgccccgctcgggggctgagccggcagtgcctccgcggccgctgggcagcgcccttcgtccaggctcgcgccccagctgccgccgacgacagcggccgagagaagttggggtctgactagacgcttacggggcctcggaccccggcgccgcggcgacctcggaggaaccggctccttgcgtcccgcctccctgggagctccgcacgggatttgcagatttacagaatggctgcacattaatggaaagagaagcataaacctatcttctttcattatggagggaggtttggcagatggagaacctgatcgaacttcgcttcttggtgatagcaaagatgtccttgggccatcaactgttgtagcaaacagtgacgaatctcagcttctgacaccaggaaagatgagtcagcgccaaggaaaagaagcttatccaacgccaaccaaagatttgcatcagccatctcttagtccagcaagtcctcatagccagggttttgaaagagggaaggaagatatttctcaaaataaagatgaatcttcactttctatgtcaaagagcaagtctgaatctaaactttataatggctcagagaaggacagttcaacttcaagcaaactcacaaaaaaagaatctcttaaggtacaaaagaaaaattaccgagaagaaaagaaaagagccacaaaggagctgctcagtacaatcacagatccttctgttattgttatggctgattggttaaagattcgtggtactctaaagagctggaccaagttatggtgtgtgttgaaacctggggtgctactgatctataaaacccaaaaaaatggtcagtgggtaggaacagttcttctgaatgcctgtgaaatcattgaacgtccatcaaaaaaggatggcttttgtttcaaacttttccatcctttggagcaatctatttgggcagtgaagggtccaaaaggtgaagcggttggatccattactcaacccttacctagcagttatttgatcatccgagctacttcagagtcagatggaaggtgctggatggatgctttggagttggctttgaaatgttctagtcttcttaaacgtacaatgatcagagaaggaaaggaacatgacctgagcgtttcatcagatagcacacatgtgactttctatggcttactacgtgctaacaatctccacagtggtgataacttccagttaaatgatagtgaaattgaacgacaacattttaaggaccaagatatgtattctgataaatctgataaagaaaatgatcaagaacatgatgagtctgataatgaggtgatggggaaaagtgaagaaagtgacacagatacatcagaaagacaagatgactcatatatcgaacctgagcctgttgagcctttaaaggagactacctacactgaacagagccatgaagaacttggagaggcaggtgaggcttctcaaacagaaactgtatctgaagaaaacaaaagccttatctggacactattgaaacaagtccgtcctggcatggacctatccaaggtggttctgcctacatttattttggaaccccgttctttcctggataaactttcagattactactatcatgcagatttcctatctgaggcagctcttgaagaaaatccttatttccgtttgaagaaagtagtgaaatggtatttgtcaggattctataaaaagccaaagggactgaagaaaccttataatcctatacttggcgagactttccgttgtttatggattcatcccagaacaaacagcaaaactttttatattgctgaacaggtgtcccatcatccaccaatatctgccttttatgttagtaatcgaaaagatggattttgccttagcggtagtatcctggctaagtctaagttttatggaaactcattatctgcaatattagagggagaagcacggttaactttcttgaatagaggtgaagattatgtaatgacaatgccatacgctcattgtaaaggaattctttatggtacaatgacactggagcttggtggaacagtcaatattacatgtcaaaaaactggatacagtgcaatacttgaatttaaactaaagccattcctagggagtagtgactgtgttaatcaaatatcagggaaacttaaactgggaaaagaagtcctagctactttggaaggtcattgggatagtgaagtttttattactgataaaaagactgataattcagaggttttctggaatccaacacctgacattaagcaatggagattaataaggcacactgtaaaatttgaagaacagggagattttgaatcagagaaactctggcaacgggtaactcgagccataaatgccaaagaccaaactgaagctacccaagagaagtatgttttggaagaagctcaaagacaagctgccagggatcggaaaacaaaaaatgaagagtggtcttgcaaattatttgaacttgatccactcacaggagaatggcattacaagtttgcagatacccgaccatgggacccacttaatgatatgatacagtttgaaaaagatggtgttattcagaccaaagtgaaacatcgtactccaatggttagcgtccccaaaatgaaacataagccaaccaggcaacagaagaaagtagcaaaaggctattcctccccagaacctgacattcaagactcctctggaagtgaagctcaatcagtaaaaccaagtacaagaagaaagaaaggaatagaactgggagacattcagagttccatcgaatctataaaacaaacacaggaagaaattaaaagaaatattatggctcttcgaaatcatttagtttcaagcacaccggccacggattattttctgcaacaaaaagactacttcatcattttcctcctgattttgcttcaagtcataataaacttcatgttcaagtagaagttctctaccattgaatcagtgaactagaaagatctgatttggcctgggaccagtgttcaagttggtttggtctttattaaaaatcacaatattccgaaaacaaaaaaacctaggagataaatgtagaggtattgacttttcgtatcttttatcttcacactgaaacaagagctatcctatttgattattaaagtgagctatgtgttaagtgccaggacatttctagcttttgtgagaatgtgtctacatatgagtataataaacccacatgtatacacaattgtctcttatgtactcctacctgacagtagtctttgtattctatagtatgttctgagatataatgttaacattgttcataacaaaaaatgctatcaatcttataaatatatgtaatctattttcttcataaaacaggcacaaaagttttatcagtaaggaattacagattgagaaatgatggaataatagacataattaattcaatacactactgttaaaatcatttgcaaagcactcagctcaattatcttcttagaaagaaagaaaaagtatgaatggtcaaaatgaatacatcgagagagataaatggcaaattgcttttttaaaagtttacataagttttttttaacccctagaatttaatatttgtagatgcaggtaaatatatatacttacgtgtatatcagtataaaaacactggtgtgcaattaattggattgattataataccaccttaagcacttgctgaaaaaagtgtggtcaaaattgattgctgtccttttgtcttatttttgtttttcttaagtcagctggttcataacataggccaaattctagagatgtttatagagcatttgaagtgctgataatttatgttttttcattatgaaaacttattttagctttagactccagtgtgttcagtgaataagtagaatataaaaaaatataaccagtattttacttcaaaagccaaaaagaggcaataagaaaagacactttgtggtggcctttatgtgtgcattaaaattggtttctgtaaaacgtgtaataagttgagtatctacgaagagtatcaagttctgaagtttaatttttttattatcctcctctcttcttagtaacttctttctgtggcaaaaccacaattctttaagattcctattgttcaggctaaggcaaatttttttgtttgtttcttcagtttaatattttgattttgtgtttttacgtaaatatttatattccttgaaagcaatttttgccaaggtagttcagtttaggaatatgttgttctaaaatatgtcttagaatcctgaaagcatagattttgaaatgtttttttaatgaaaatgaaggtcagagagaataattgccctgaccacatttgcctttcagtaggaggaggctgtgaaatagtaaaattataatcgtttatgccatgataaatacaagattggtaaataaatacattgattggtaaattatgagaatcaaaatgataaaaagagcctgcttttttccctaaccaatatagctatcttaagtatccttaggtttctgtgaagaaccatttcccatgttttcttggcaaaataatgctgtattccatatgtacatgtgaaatgatgttttaaattgataaaagcttaaataagatctacctatacccagtattttcatgatattagaacaaatgggtttttggttatattttatatttgtcaatataatttttgtattcacattctgttacactctgcctattcattgatatatgatattctgtaaatattgtacaatttgatcttttttatggtttaaattagttaattacatacaaattgattggcttatcacaaaaatcatttcatcagtaaaccttgttaacattttgtactggtgacccacctcttaggactttggtcttatccacgtgtatgttgttttcatttggtccaaataatattttatttgtatgggtatcttctaagactaaataggtagttgtgttctttatttttaaaatttctttttagagcaaatgttatgggttcttacccaaagagtcaaaaactatttcttaagaaagagcagagttattcatgactgttctttatacactaaaagcatgcatctaatctaatagtcctcttattatgcttttagttgtatgagtctctttctatgaactgaacacaaaactcaggaattggtggcttaattttagatcagtgcttgtactaggcttagttatatgaatctttataacacataattactaactttgtagccatatatgtaattgactttgaatgttatttacctgaaattaatcttccttcacacatggaccgtaaacggttcccagttgtctgagagcctcatgagggtttctaggatttatgaccttatgaccagtttttttcatttaccaagattttattttcctacatgaaaatttaattgagtaataattattcacatgtgcattttctttttagctgttaaatgtactatgccatcatccaccatttagtaaaatgtagctggcccaggacatgtaaaaaaaaaaaaaaaacaacaacaataaatagggcatgtgaaatgttaagttacagcaatagatattttatttgtatttcatgttagtacttttttgttttatatcacttataaaggtacagtgtactctttgtcacagctcagttggtaaccgcattccattgaaaagttggccttgtaaaatacaactctcatttaatattcatgcttttgtgcctttaagaaaatattttttgtcattttttgtgttacagaactataatgtgattcaaggtgtttataggcttgtcataaaagggtcatttctgtgtgttactttctttttatatagctatagtatatttaaacaataatactatcttttataggggtttgtctatttacctattctttactcagacattgatgtagacttgtcagattattctgagtattgttaacagtgccttttcgatggaatcacactttttggctgtcaccttgtgccatatacacacaaaattttgtggaaggcagttttaactttctgaagaatatctgtcaaaatttaagaaaacaaatgtataaaattccattttttccagtgtttagcatttctagtaagcagtgaggttgtttgacatacagtgatgatggcattattgataagccatacatgagactgcagattatattgaatcatattaaatgtacagaaataaaatattagatttatatcaaattttccaatttgaaccagtggggaaaatcccacagaaatcagtaagtttacatttcaatttctatcttatttgactaagtggaaagagattctttaaaatgtataacctgccattatgtaatttggtttcattttattctacctgttgtgtgagtttagtatatttaatttactttttgttactctttacatactgtttatttttgttagtttttaattgaagatggactgttgaaattgtataggaccagtgtcttattaatatgattaatatatttagaagagccacgtgaaacccatgacaaaatgaatgtgaatattctttctaaaaatttagaaaatgttatctttttgcatttattatgtaaaactgttttacagtatcaaaatttttcacttaaagaaaaaaaatgccatgaaacatttgaactgatgagccacagaacttcagttgaaatttttttcactttttagcatgctaaatatacatctgagtttaaatgttctgtttaatggccattcataaattcaagcactaccactggtcagttttgtgtgatagaataaaaatatgttacctgcagtgtaagtacagcacactgtcaaattcttttccttaaggtgcacagtaaatgtacagatagttataggccactgttttgtaatgtagtacatttctaatctattattcctaacctattataactgtttgcagaaagaaaagaatttttctaataatctgtaaaattatgctaacttctacaagtaggcttctaaataaaatttttaaaaagagc

SEQ ID NO: 163180 - DNA, 7047 bp, Homo sapiens
  Payload ID: 12155
  Gene Symbol: OSBPL8
  Gene Name: oxysterol binding protein-like 8
  Uniprot ID: Q9BZF1
  ENST ID: ENST00000393249
  CDS Start-End: 412-2955
cgccccagctgccgccgacgacagcggccgagagaagttggggtctgactagacgcttacggggcctcggaccccggcgccgcggcgacctcggaggaaccggctccttgcgtcccgcctccctgggagctccgcacggcaatctccattggtgctactgcgtttaaagaactgtggctaacctccaagagactgaagctggtaattaaacattcctatccttgcctgaagcagtcttttgcaggaacatttgaggatttgcagatttacagaatggctgcacattaatggaaagagaagcataaacctatcttctttcattatggagggaggtttggcagatggagaacctgatcgaacttcgctgttgtagcaaacagtgacgaatctcagcttctgacaccaggaaagatgagtcagcgccaaggaaaagaagcttatccaacgccaaccaaagatttgcatcagccatctcttagtccagcaagtcctcatagccagggttttgaaagagggaaggaagatatttctcaaaataaagatgaatcttcactttctatgtcaaagagcaagtctgaatctaaactttataatggctcagagaaggacagttcaacttcaagcaaactcacaaaaaaagaatctcttaaggtacaaaagaaaaattaccgagaagaaaagaaaagagccacaaaggagctgctcagtacaatcacagatccttctgttattgttatggctgattggttaaagattcgtggtactctaaagagctggaccaagttatggtgtgtgttgaaacctggggtgctactgatctataaaacccaaaaaaatggtcagtgggtaggaacagttcttctgaatgcctgtgaaatcattgaacgtccatcaaaaaaggatggcttttgtttcaaacttttccatcctttggagcaatctatttgggcagtgaagggtccaaaaggtgaagcggttggatccattactcaacccttacctagcagttatttgatcatccgagctacttcagagtcagatggaaggtgctggatggatgctttggagttggctttgaaatgttctagtcttcttaaacgtacaatgatcagagaaggaaaggaacatgacctgagcgtttcatcagatagcacacatgtgactttctatggcttactacgtgctaacaatctccacagtggtgataacttccagttaaatgatagtgaaattgaacgacaacattttaaggaccaagatatgtattctgataaatctgataaagaaaatgatcaagaacatgatgagtctgataatgaggtgatggggaaaagtgaagaaagtgacacagatacatcagaaagacaagatgactcatatatcgaacctgagcctgttgagcctttaaaggagactacctacactgaacagagccatgaagaacttggagaggcaggtgaggcttctcaaacagaaactgtatctgaagaaaacaaaagccttatctggacactattgaaacaagtccgtcctggcatggacctatccaaggtggttctgcctacatttattttggaaccccgttctttcctggataaactttcagattactactatcatgcagatttcctatctgaggcagctcttgaagaaaatccttatttccgtttgaagaaagtagtgaaatggtatttgtcaggattctataaaaagccaaagggactgaagaaaccttataatcctatacttggcgagactttccgttgtttatggattcatcccagaacaaacagcaaaactttttatattgctgaacaggtgtcccatcatccaccaatatctgccttttatgttagtaatcgaaaagatggattttgccttagcggtagtatcctggctaagtctaagttttatggaaactcattatctgcaatattagagggagaagcacggttaactttcttgaatagaggtgaagattatgtaatgacaatgccatacgctcattgtaaaggaattctttatggtacaatgacactggagcttggtggaacagtcaatattacatgtcaaaaaactggatacagtgcaatacttgaatttaaactaaagccattcctagggagtagtgactgtgttaatcaaatatcagggaaacttaaactgggaaaagaagtcctagctactttggaaggtcattgggatagtgaagtttttattactgataaaaagactgataattcagaggttttctggaatccaacacctgacattaagcaatggagattaataaggcacactgtaaaatttgaagaacagggagattttgaatcagagaaactctggcaacgggtaactcgagccataaatgccaaagaccaaactgaagctacccaagagaagtatgttttggaagaagctcaaagacaagctgccagggatcggaaaacaaaaaatgaagagtggtcttgcaaattatttgaacttgatccactcacaggagaatggcattacaagtttgcagatacccgaccatgggacccacttaatgatatgatacagtttgaaaaagatggtgttattcagaccaaagtgaaacatcgtactccaatggttagcgtccccaaaatgaaacataagccaaccaggcaacagaagaaagtagcaaaaggctattcctccccagaacctgacattcaagactcctctggaagtgaagctcaatcagtaaaaccaagtacaagaagaaagaaaggaatagaactgggagacattcagagttccatcgaatctataaaacaaacacaggaagaaattaaaagaaatattatggctcttcgaaatcatttagtttcaagcacaccggccacggattattttctgcaacaaaaagactacttcatcattttcctcctgattttgcttcaagtcataataaacttcatgttcaagtagaagttctctaccattgaatcagtgaactagaaagatctgatttggcctgggaccagtgttcaagttggtttggtctttattaaaaatcacaatattccgaaaacaaaaaaacctaggagataaatgtagaggtattgacttttcgtatcttttatcttcacactgaaacaagagctatcctatttgattattaaagtgagctatgtgttaagtgccaggacatttctagcttttgtgagaatgtgtctacatatgagtataataaacccacatgtatacacaattgtctcttatgtactcctacctgacagtagtctttgtattctatagtatgttctgagatataatgttaacattgttcataacaaaaaatgctatcaatcttataaatatatgtaatctattttcttcataaaacaggcacaaaagttttatcagtaaggaattacagattgagaaatgatggaataatagacataattaattcaatacactactgttaaaatcatttgcaaagcactcagctcaattatcttcttagaaagaaagaaaaagtatgaatggtcaaaatgaatacatcgagagagataaatggcaaattgcttttttaaaagtttacataagttttttttaacccctagaatttaatatttgtagatgcaggtaaatatatatacttacgtgtatatcagtataaaaacactggtgtgcaattaattggattgattataataccaccttaagcacttgctgaaaaaagtgtggtcaaaattgattgctgtccttttgtcttatttttgtttttcttaagtcagctggttcataacataggccaaattctagagatgtttatagagcatttgaagtgctgataatttatgttttttcattatgaaaacttattttagctttagactccagtgtgttcagtgaataagtagaatataaaaaaatataaccagtattttacttcaaaagccaaaaagaggcaataagaaaagacactttgtggtggcctttatgtgtgcattaaaattggtttctgtaaaacgtgtaataagttgagtatctacgaagagtatcaagttctgaagtttaatttttttattatcctcctctcttcttagtaacttctttctgtggcaaaaccacaattctttaagattcctattgttcaggctaaggcaaatttttttgtttgtttcttcagtttaatattttgattttgtgtttttacgtaaatatttatattccttgaaagcaatttttgccaaggtagttcagtttaggaatatgttgttctaaaatatgtcttagaatcctgaaagcatagattttgaaatgtttttttaatgaaaatgaaggtcagagagaataattgccctgaccacatttgcctttcagtaggaggaggctgtgaaatagtaaaattataatcgtttatgccatgataaatacaagattggtaaataaatacattgattggtaaattatgagaatcaaaatgataaaaagagcctgcttttttccctaaccaatatagctatcttaagtatccttaggtttctgtgaagaaccatttcccatgttttcttggcaaaataatgctgtattccatatgtacatgtgaaatgatgttttaaattgataaaagcttaaataagatctacctatacccagtattttcatgatattagaacaaatgggtttttggttatattttatatttgtcaatataatttttgtattcacattctgttacactctgcctattcattgatatatgatattctgtaaatattgtacaatttgatcttttttatggtttaaattagttaattacatacaaattgattggcttatcacaaaaatcatttcatcagtaaaccttgttaacattttgtactggtgacccacctcttaggactttggtcttatccacgtgtatgttgttttcatttggtccaaataatattttatttgtatgggtatcttctaagactaaataggtagttgtgttctttatttttaaaatttctttttagagcaaatgttatgggttcttacccaaagagtcaaaaactatttcttaagaaagagcagagttattcatgactgttctttatacactaaaagcatgcatctaatctaatagtcctcttattatgcttttagttgtatgagtctctttctatgaactgaacacaaaactcaggaattggtggcttaattttagatcagtgcttgtactaggcttagttatatgaatctttataacacataattactaactttgtagccatatatgtaattgactttgaatgttatttacctgaaattaatcttccttcacacatggaccgtaaacggttcccagttgtctgagagcctcatgagggtttctaggatttatgaccttatgaccagtttttttcatttaccaagattttattttcctacatgaaaatttaattgagtaataattattcacatgtgcattttctttttagctgttaaatgtactatgccatcatccaccatttagtaaaatgtagctggcccaggacatgtaaaaaaaaaaaaaaaacaacaacaataaatagggcatgtgaaatgttaagttacagcaatagatattttatttgtatttcatgttagtacttttttgttttatatcacttataaaggtacagtgtactctttgtcacagctcagttggtaaccgcattccattgaaaagttggccttgtaaaatacaactctcatttaatattcatgcttttgtgcctttaagaaaatattttttgtcattttttgtgttacagaactataatgtgattcaaggtgtttataggcttgtcataaaagggtcatttctgtgtgttactttctttttatatagctatagtatatttaaacaataatactatcttttataggggtttgtctatttacctattctttactcagacattgatgtagacttgtcagattattctgagtattgttaacagtgccttttcgatggaatcacactttttggctgtcaccttgtgccatatacacacaaaattttgtggaaggcagttttaactttctgaagaatatctgtcaaaatttaagaaaacaaatgtataaaattccattttttccagtgtttagcatttctagtaagcagtgaggttgtttgacatacagtgatgatggcattattgataagccatacatgagactgcagattatattgaatcatattaaatgtacagaaataaaatattagatttatatcaaattttccaatttgaaccagtggggaaaatcccacagaaatcagtaagtttacatttcaatttctatcttatttgactaagtggaaagagattctttaaaatgtataacctgccattatgtaatttggtttcattttattctacctgttgtgtgagtttagtatatttaatttactttttgttactctttacatactgtttatttttgttagtttttaattgaagatggactgttgaaattgtataggaccagtgtcttattaatatgattaatatatttagaagagccacgtgaaacccatgacaaaatgaatgtgaatattctttctaaaaatttagaaaatgttatctttttgcatttattatgtaaaactgttttacagtatcaaaatttttcacttaaagaaaaaaaatgccatgaaacatttgaactgatgagccacagaacttcagttgaaatttttttcactttttagcatgctaaatatacatctgagtttaaatgttctgtttaatggccattcataaattcaagcactaccactggtcagttttgtgtgatagaataaaaatatgttacctgcagtgtaagtacagcacactgtcaaattcttttccttaaggtgcacagtaaatgtacagatagttataggccactgttttgtaatgtagtacatttctaatctattattcctaacctattataactgtttgcagaaagaaaagaatttttctaataatctgtaaaattatgctaacttctacaagtaggcttctaaataaaatttttaaaaagagcaaa

SEQ ID NO: 163181 - DNA, 3157 bp, Homo sapiens
  Payload ID: 12155
  Gene Symbol: OSBPL8
  Gene Name: oxysterol binding protein-like 8
  Uniprot ID: Q9BZF1
  ENST ID: ENST00000393250
  CDS Start-End: 561-3104
cactagaatgtgaaggatcttcgcggttctgggtgcccagaaaggcggcgacgcggcggatgacaacattaggccgcgacgcgctcctggccaggcggcggctgtagtgttagctttggacgccgcagtagccgctgccggtagcaagccgactgagggaaggtgggggtccgcccgggctggtggacctcggggccgaaagttcccgccccgctcgggggctgagccggcagtgcctccgcggccgctgggcagcgcccttcgtccaggctcgcgccccagctgccgccgacgacagcggccgagagaagttggggtctgactagacgcttacggggcctcggaccccggcgccgcggcgacctcggaggaaccggctccttgcgtcccgcctccctgggagctccgcacgggatttgcagatttacagaatggctgcacattaatggaaagagaagcataaacctatcttctttcattatggagggaggtttggcagatggagaacctgatcgaacttcgcaaacagtgacgaatctcagcttctgacaccaggaaagatgagtcagcgccaaggaaaagaagcttatccaacgccaaccaaagatttgcatcagccatctcttagtccagcaagtcctcatagccagggttttgaaagagggaaggaagatatttctcaaaataaagatgaatcttcactttctatgtcaaagagcaagtctgaatctaaactttataatggctcagagaaggacagttcaacttcaagcaaactcacaaaaaaagaatctcttaaggtacaaaagaaaaattaccgagaagaaaagaaaagagccacaaaggagctgctcagtacaatcacagatccttctgttattgttatggctgattggttaaagattcgtggtactctaaagagctggaccaagttatggtgtgtgttgaaacctggggtgctactgatctataaaacccaaaaaaatggtcagtgggtaggaacagttcttctgaatgcctgtgaaatcattgaacgtccatcaaaaaaggatggcttttgtttcaaacttttccatcctttggagcaatctatttgggcagtgaagggtccaaaaggtgaagcggttggatccattactcaacccttacctagcagttatttgatcatccgagctacttcagagtcagatggaaggtgctggatggatgctttggagttggctttgaaatgttctagtcttcttaaacgtacaatgatcagagaaggaaaggaacatgacctgagcgtttcatcagatagcacacatgtgactttctatggcttactacgtgctaacaatctccacagtggtgataacttccagttaaatgatagtgaaattgaacgacaacattttaaggaccaagatatgtattctgataaatctgataaagaaaatgatcaagaacatgatgagtctgataatgaggtgatggggaaaagtgaagaaagtgacacagatacatcagaaagacaagatgactcatatatcgaacctgagcctgttgagcctttaaaggagactacctacactgaacagagccatgaagaacttggagaggcaggtgaggcttctcaaacagaaactgtatctgaagaaaacaaaagccttatctggacactattgaaacaagtccgtcctggcatggacctatccaaggtggttctgcctacatttattttggaaccccgttctttcctggataaactttcagattactactatcatgcagatttcctatctgaggcagctcttgaagaaaatccttatttccgtttgaagaaagtagtgaaatggtatttgtcaggattctataaaaagccaaagggactgaagaaaccttataatcctatacttggcgagactttccgttgtttatggattcatcccagaacaaacagcaaaactttttatattgctgaacaggtgtcccatcatccaccaatatctgccttttatgttagtaatcgaaaagatggattttgccttagcggtagtatcctggctaagtctaagttttatggaaactcattatctgcaatattagagggagaagcacggttaactttcttgaatagaggtgaagattatgtaatgacaatgccatacgctcattgtaaaggaattctttatggtacaatgacactggagcttggtggaacagtcaatattacatgtcaaaaaactggatacagtgcaatacttgaatttaaactaaagccattcctagggagtagtgactgtgttaatcaaatatcagggaaacttaaactgggaaaagaagtcctagctactttggaaggtcattgggatagtgaagtttttattactgataaaaagactgataattcagaggttttctggaatccaacacctgacattaagcaatggagattaataaggcacactgtaaaatttgaagaacagggagattttgaatcagagaaactctggcaacgggtaactcgagccataaatgccaaagaccaaactgaagctacccaagagaagtatgttttggaagaagctcaaagacaagctgccagggatcggaaaacaaaaaatgaagagtggtcttgcaaattatttgaacttgatccactcacaggagaatggcattacaagtttgcagatacccgaccatgggacccacttaatgatatgatacagtttgaaaaagatggtgttattcagaccaaagtgaaacatcgtactccaatggttagcgtccccaaaatgaaacataagccaaccaggcaacagaagaaagtagcaaaaggctattcctccccagaacctgacattcaagactcctctggaagtgaagctcaatcagtaaaaccaagtacaagaagaaagaaaggaatagaactgggagacattcagagttccatcgaatctataaaacaaacacaggaagaaattaaaagaaatattatggctcttcgaaatcatttagtttcaagcacaccggccacggattattttctgcaacaaaaagactacttcatcattttcctcctgattttgcttcaagtcataataaacttcatgttcaagtagaagttctctaccattgaatcagtgaactagaaagatctgatttggcctgggac

SEQ ID NO: 163182 - DNA, 542 bp, Homo sapiens
  Payload ID: 12155
  Gene Symbol: OSBPL8
  Gene Name: oxysterol binding protein-like 8
  ENST ID: ENST00000548341
  CDS Start-End: 72-542
gaagaaaatgggtgtggaaattcttggcttatgaagaaggctgttgtcacattgatttaaatgaaaaacggatgcttcttggtgatagcaaagatgtccttgggccatcaactgttgtagcaaacagtgacgaatctcagcttctgacaccaggaaagatgagtcagcgccaaggaaaagaagcttatccaacgccaaccaaagatttgcatcagccatctcttagtccagcaagtcctcatagccagggttttgaaagagggaaggaagatatttctcaaaataaagatgaatcttcactttctatgtcaaagagcaagtctgaatctaaactttataatggctcagagaaggacagttcaacttcaagcaaactcacaaaaaaagaatctcttaaggtacaaaagaaaaattaccgagaagaaaagaaaagagccacaaaggagctgctcagtacaatcacagatccttctgttattgttatggctgattggttaaagattcgtggtactctaaagagctggaccaagttatggtgtgtg

SEQ ID NO: 163183 - DNA, 363 bp, Homo sapiens
  Payload ID: 12155
  Gene Symbol: OSBPL8
  Gene Name: oxysterol binding protein-like 8
  ENST ID: ENST00000547544
  CDS Start-End: 206-363
gagaagttggggtctgactagacgcttacggggcctcggaccccggcgccgcggcgacctcggaggaaccggctccttgcgtcccgcctccctgggagctccgcacggcaatctccattggtgctactgcgtttaaaggatttgcagatttacagaatggctgcacattaatggaaagagaagcataaacctatcttctttcattatggagggaggtttggcagatggagaacctgatcgaacttcgcttcttggtgatagcaaagatgtccttgggccatcaacaaacagtgacgaatctcagcttctgacaccaggaaagatgagtcagcgccaaggaaaagaagcttatccaacgccaac

SEQ ID NO: 163184 - DNA, 561 bp, Homo sapiens
  Payload ID: 12155
  Gene Symbol: OSBPL8
  Gene Name: oxysterol binding protein-like 8
  ENST ID: ENST00000550628
  CDS Start-End: 477-561
agaatgtgaaggatcttcgcggttctgggtgcccagaaaggcggcgacgcggcggatgacaacattaggccgcgacgcgctcctggccaggcggcggctgtagtgttagctttggacgccgcagtagccgctgccggtagcaagccgactgagggaaggtgggggtccgcccgggctggtggacctcggggccgaaagttcccgccccgctcgggggctgagccggcagtgcctccgcggccgctgggcagcgcccttcgtccaggctcgcgccccagctgccgccgacgacagcggccgagagaagttggggtctgactagacgcttacggggcctcggaccccggcgccgcggcgacctcggaggaaccggctccttgcgtcccgcctccctgggagctccgcacgggatttgcagatttacagaatggctgcacattaatggaaagagaagcataaacctatcttctttcattatggagggaggtttggcagatggagaacctgatcgaacttcgtctgaatctaaactttataatggctcagagaaggacagttcaa

SEQ ID NO: 163185 - DNA, 531 bp, Homo sapiens
  Payload ID: 12155
  Gene Symbol: OSBPL8
  Gene Name: oxysterol binding protein-like 8
  ENST ID: ENST00000551927
  CDS Start-End: 357-531
gcggccgctgggcagcgcccttcgtccaggctcgcgccccagctgccgccgacgacagcggccgagagaagttggggtctgactagacgcttacggggcctcggaccccggcgccgcggcgacctcggaggaaccggctccttgcgtcccgcctccctgggagctccgcacggcaatctccattggtgctactgcgtttaaagaactgtggctaacctccaagagactgaagctggtaattaaacattcctatccttgcctgaagcagtcttttgcaggaacatttgaggatttgcagatttacagaatggctgcacattaatggaaagagaagcataaacctatcttctttcattatggagggaggtttggcagatggagaacctgatcgaacttcgcttcttggtgatagcaaagatgtccttgggccatcaactgttgtagcaaacagtgacgaatctcagcttctgacaccaggaaagatgagtcagcgccaaggaaaagaagcttatccaacgccaaccaaagatt

SEQ ID NO: 163186 - DNA, 2698 bp, Homo sapiens
  Payload ID: 12155
  Gene Symbol: OSBPL8
  Gene Name: oxysterol binding protein-like 8
  ENST ID: ENST00000546946
  CDS Start-End: 615-2698
tgttggaatccatcaacgttgtgcttgaaagagtatctttccttatgaatgtttaatcatggctgaggcaagctgtagattagatataaatctagaagcttcagggaagataaaaagcattatgtttatatccatctttgaagtaagtaaaagctgggaaggaaggagtcggaagaggtgggaagtgtggccggatagtacagaaacataatggatatgataaaaggattgcatttctgagaagagaaaatgactttattgcttcatcttgaattgctaagtattgatcttgttttgttttcctaaagcagcaattcagtgcagggtggtttgataaaaaggtaaaacattagtagaatagcctttcatgtttatcagttcctttttttaaaaaatcagcagcatggtttaatgctttttctgtcaggctttctctatctgtttattgctgatttgacagtctttggtccttctcctttgctgttaaatgtgtgtgttctttgtttgtgctggtgggttttgctacagttggatgtgagagaaaagcctgtctttgccatattggtctaattagcctttgggtgagcatatacattaaatagaccttctgagctatgaaagaagagagctcacaacgtagattttcttcctgtactggggttttgcctgttttatttcctccccggattgatggccgaaagcttgttcggaatgcttcatttggaggatacaatgaactttctccttcattgccaggttttgaaagagggaaggaagatatttctcaaaataaagatgaatcttcactttctatgtcaaagagcaagtctgaatctaaactttataatggctcagagaaggacagttcaacttcaagcaaactcacaaaaaaagaatctcttaaggtacaaaagaaaaattaccgagaagaaaagaaaagagccacaaaggagctgctcagtacaatcacagatccttctgttattgttatggctgattggttaaagattcgtggtactctaaagagctggaccaagttatggtgtgtgttgaaacctggggtgctactgatctataaaacccaaaaaaatggtcagtgggtaggaacagttcttctgaatgcctgtgaaatcattgaacgtccatcaaaaaaggatggcttttgtttcaaacttttccatcctttggagcaatctatttgggcagtgaagggtccaaaaggtgaagcggttggatccattactcaacccttacctagcagttatttgatcatccgagctacttcagagtcagatggaaggtgctggatggatgctttggagttggctttgaaatgttctagtcttcttaaacgtacaatgatcagagaaggaaaggaacatgacctgagcgtttcatcagatagcacacatgtgactttctatggcttactacgtgctaacaatctccacagtggtgataacttccagttaaatgatagtgaaattgaacgacaacattttaaggaccaagatatgtattctgataaatctgataaagaaaatgatcaagaacatgatgagtctgataatgaggtgatggggaaaagtgaagaaagtgacacagatacatcagaaagacaagatgactcatatatcgaacctgagcctgttgagcctttaaaggagactacctacactgaacagagccatgaagaacttggagaggcaggtgaggcttctcaaacagaaactgtatctgaagaaaacaaaagccttatctggacactattgaaacaagtccgtcctggcatggacctatccaaggtggttctgcctacatttattttggaaccccgttctttcctggataaactttcagattactactatcatgcagatttcctatctgaggcagctcttgaagaaaatccttatttccgtttgaagaaagtagtgaaatggtatttgtcaggattctataaaaagccaaagggactgaagaaaccttataatcctatacttggcgagactttccgttgtttatggattcatcccagaacaaacagcaaaactttttatattgctgaacaggtgtcccatcatccaccaatatctgccttttatgttagtaatcgaaaagatggattttgccttagcggtagtatcctggctaagtctaagttttatggaaactcattatctgcaatattagagggagaagcacggttaactttcttgaatagaggtgaagattatgtaatgacaatgccatacgctcattgtaaaggaattctttatggtacaatgacactggagcttggtggaacagtcaatattacatgtcaaaaaactggatacagtgcaatacttgaatttaaactaaagccattcctagggagtagtgactgtgttaatcaaatatcagggaaacttaaactgggaaaagaagtcctagctactttggaaggtcattgggatagtgaagtttttattactgataaaaagactgataattcagaggttttctggaatccaacacctgacattaagcaatggagattaataaggcacactgtaaaatttgaagaacagggagattttgaatcagagaaactctggcaacgggtaactcgagccataaatgccaaagaccaaactgaagctacccaagagaagtatgttttggaagaagctcaaagacaagctgccagggatcg

SEQ ID NO: 163187 - DNA, 588 bp, Homo sapiens
  Payload ID: 12155
  Gene Symbol: OSBPL8
  Gene Name: oxysterol binding protein-like 8
  ENST ID: ENST00000549646
  CDS Start-End: 465-588
atcttcgcggttctgggtgcccagaaaggcggcgacgcggcggatgacaacattaggccgcgacgcgctcctggccaggcggcggctgtagtgttagctttggacgccgcagtagccgctgccggtagcaagccgactgagggaaggtgggggtccgcccgggctggtggacctcggggccgaaagttcccgccccgctcgggggctgagccggcagtgcctccgcggccgctgggcagcgcccttcgtccaggctcgcgccccagctgccgccgacgacagcggccgagagaagttggggtctgactagacgcttacggggcctcggaccccggcgccgcggcgacctcggaggaaccggctccttgcgtcccgcctccctgggagctccgcacgggatttgcagatttacagaatggctgcacattaatggaaagagaagcataaacctatcttctttcattatggagggaggtttggcagatggagaacctgatcgaacttcggttttgaaagagggaaggaagatatttctcaaaataaagatgaatcttcactttctatgtcaaagagcaagtctgaatctaa

SEQ ID NO: 163188 - DNA, 902 bp, Homo sapiens
  Payload ID: 12155
  Gene Symbol: OSBPL8
  Gene Name: oxysterol binding protein-like 8
  ENST ID: ENST00000553139
  CDS Start-End: 569-902
actagaatgtgaaggatcttcgcggttctgggtgcccagaaaggcggcgacgcggcggatgacaacattaggccgcgacgcgctcctggccaggcggcggctgtagtgttagctttggacgccgcagtagccgctgccggtagcaagccgactgagggaaggtgggggtccgcccgggctggtggacctcggggccgaaagttcccgccccgctcgggggctgagccggcagtgcctccgcggccgctgggcagcgcccttcgtccaggctcgcgccccagctgccgccgacgacagcggccgagagaagttggggtctgactagacgcttacggggcctcggaccccggcgccgcggcgacctcggaggaaccggctccttgcgtcccgcctccctgggagctccgcacgggatttgcagatttacagaatggctgcacattaatggaaagagaagcataaacctatcttctttcattatggagggaggtttggcagatggagaacctgatcgaacttcgctgttgtagcaaacagtgacgaatctcagcttctgacaccaggaaagatgagtcagcgccaaggaaaagaagcttatccaacgccaaccaaagatttgcatcagccatctcttagtccagcaagtcctcatagccagggttttgaaagagggaaggaagatatttctcaaaataaagatgaatcttcactttctatgtcaaagagcaagtctgaatctaaactttataatggctcagagaaggacagttcaacttcaagcaaactcacaaaaaaagaatctcttaaggtacaaaagaaaaattaccgagaagaaaagaaaagagccacaaaggagctgctcagtacaatcacagatccttctgttattgttatggctgatt

SEQ ID NO: 163189 - DNA, 732 bp, Homo sapiens
  Payload ID: 12155
  Gene Symbol: OSBPL8
  Gene Name: oxysterol binding protein-like 8
  ENST ID: ENST00000549570
  CDS Start-End: 503-732
gcggctgtagtgttagctttggacgccgcagtagccgctgccggtagcaagccgactgagggaaggtgggggtccgcccgggctggtggacctcggggccgaaagttcccgccccgctcgggggctgagccggcagtgcctccgcggccgctgggcagcgcccttcgtccaggctcgcgccccagctgccgccgacgacagcggccgagagaagttggggtctgactagacgcttacggggcctcggaccccggcgccgcggcgacctcggaggaaccggctccttgcgtcccgcctccctgggagctccgcacggcaatctccattggtgctactgcgtttaaaggatttgcagatttacagaatggctgcacattaatggaaagagaagcataaacctatcttctttcattatggagggaggtttggcagatggagaacctgatcgaacttcgctgttgtagcaaacagtgacgaatctcagcttctgacaccaggaaagatgagtcagcgccaaggaaaagaagcttatccaacgccaaccaaagatttgcatcagccatctcttagtccagcaagtcctcatagccagggttttgaaagagggaaggaagatatttctcaaaataaagatgaatcttcactttctatgtcaaagagcaagtctgaatctaaactttataatggctcagagaaggacagttcaacttcaagcaaactcacaaaaaaaga

SEQ ID NO: 163190 - DNA, 2583 bp, Homo sapiens
  Payload ID: 12155
  Gene Symbol: OSBPL8
  Gene Name: oxysterol binding protein-like 8
  ENST ID: ENST00000547540
  CDS Start-End: 420-2583
gacaacattaggccgcgacgcgctcctggccaggcggcggctgtagtgttagctttggacgccgcagtagccgctgccggtagcaagccgactgagggaaggtgggggtccgcccgggctggtggacctcggggccgaaagttcccgccccgctcgggggctgagccggcagtgcctccgcggccgctgggcagcgcccttcgtccaggctcgcgccccagctgccgccgacgacagcggccgagagaagttggggtctgactagacgcttacggggcctcggaccccggcgccgcggcgacctcggaggaaccggctccttgcgtcccgcctccctgggagctccgcacgggatttgcagatttacagaatggctgcacattaatggaaagagaagcataaacctatcttctttcattatggagggaggtttggcagatggagaacctgatcgaacttcgcttcttggtgatagcaaagatgtccttgggccatcaactgttgtagcaaacagtgacgaatctcagcttctgacaccaggaaagatgagtcagcgccaaggaaaagaagcttatccaacgccaaccaaagatttgcatcagccatctcttagtccagcaagtcctcatagccagggttttgaaagagggaaggaagatatttctcaaaataaagatgaatcttcactttctatgtcaaagagcaagtctgaatctaaactttataatggctcagagaaggacagttcaacttcaagcaaactcacaaaaaaagaatctcttaaggtacaaaagaaaaattaccgagaagaaaagaaaagagccacaaaggagctgctcagtacaatcacagatccttctgttattgttatggctgattggttaaagattcgtggtactctaaagagctggaccaagttatggtgtgtgttgaaacctggggtgctactgatctataaaacccaaaaaaatggtcagtgggtaggaacagttcttctgaatgcctgtgaaatcattgaacgtccatcaaaaaaggatggcttttgtttcaaacttttccatcctttggagcaatctatttgggcagtgaagggtccaaaaggtgaagcggttggatccattactcaacccttacctagcagttatttgatcatccgagctacttcagagtcagatggaaggtgctggatggatgctttggagttggctttgaaatgttctagtcttcttaaacgtacaatgatcagagaaggaaaggaacatgacctgagcgtttcatcagatagcacacatgtgactttctatggcttactacgtgctaacaatctccacagtggtgataacttccagttaaatgatagtgaaattgaacgacaacattttaaggaccaagatatgtattctgataaatctgataaagaaaatgatcaagaacatgatgagtctgataatgaggtgatggggaaaagtgaagaaagtgacacagatacatcagaaagacaagatgactcatatatcgaacctgagcctgttgagcctttaaaggagactacctacactgaacagagccatgaagaacttggagaggcaggtgaggcttctcaaacagaaactgtatctgaagaaaacaaaagccttatctggacactattgaaacaagtccgtcctggcatggacctatccaaggtggttctgcctacatttattttggaaccccgttctttcctggataaactttcagattactactatcatgcagatttcctatctgaggcagctcttgaagaaaatccttatttccgtttgaagaaagtagtgaaatggtatttgtcaggattctataaaaagccaaagggactgaagaaaccttataatcctatacttggcgagactttccgttgtttatggattcatcccagaacaaacagcaaaactttttatattgctgaacaggtgtcccatcatccaccaatatctgccttttatgttagtaatcgaaaagatggattttgccttagcggtagtatcctggctaagtctaagttttatggaaactcattatctgcaatattagagggagaagcacggttaactttcttgaatagaggtgaagattatgtaatgacaatgccatacgctcattgtaaaggaattctttatggtacaatgacactggagcttggtggaacagtcaatattacatgtcaaaaaactggatacagtgcaatacttgaatttaaactaaagccattcctagggagtagtgactgtgttaatcaaatatcagggaaacttaaactgggaaaagaagtcctagctactttggaaggtcattgggatagtgaagtttttattactgataaaaagactgataattcagaggttttctggaatccaacacctgacattaagcaatggagattaataaggcacactgtaaaatttgaagaacagggagattttgaatcagagaaactctggcaacgggtaactcgagccataaatgccaaagaccaaactgaagctacccaagagaagtatgttttggaagaagctcaaagacaagctgccagggatcggaaaa

SEQ ID NO: 163191 - DNA, 7239 bp, Homo sapiens; identical to SEQ ID NO: 163179
  Payload ID: 12155
  Gene Symbol: OSBPL8
  Gene Name: oxysterol binding protein-like 8
  Uniprot ID: Q9BZF1
  ENST ID: ENST00000611266
  CDS Start-End: 607-3150

SEQ ID NO: 163192 - DNA, 2721 bp, Homo sapiens
  Payload ID: 12156
  Gene Symbol: OSBPL9
  Gene Name: oxysterol binding protein-like 9
  Uniprot ID: Q96SU4
  ENST ID: ENST00000361556
  CDS Start-End: 161-2041
gaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggattacagtttaattaattattcttagtgcttaaggcttcataaagtaatttttccaaccttttttttaaaaa

SEQ ID NO: 163193 - DNA, 3352 bp, Homo sapiens
  Payload ID: 12156
  Gene Symbol: OSBPL9
  Gene Name: oxysterol binding protein-like 9
  Uniprot ID: Q96SU4
  ENST ID: ENST00000371714
  CDS Start-End: 501-2672
atgattataagcttcctgaggcctccctagaagctgagcagatggcagaaccatgcttcctgtaaatcctgcagaatcaagaaggaactgagtctctaagatggaggatatacaactgacaagtagtaaagtcaagatacacagccagacagtgtctcagtctggcatccaactcaggctggagtgcagtgacatgatcttggctcactgcagtcttgacctcctgggctcaagcaatcctcctgcctcagcttcctgagtagattataaataatcttaatagcagtattcacgtttgcattctcgcatccgtggcatggagtcctacacacaataggcgccctaagaaagcgtgtttgacttgatcgctggagcatctgccggcaccgcccaggacccgcccaggacccgccccgccccctgcggccccgccccccgcatgctgaatgccatataggcgagtgacgtcaggccgtttgttgtcattggcggctcccaagatggcgtccatcatggaagggccgctgagcaaatggactaacgtgatgaagggctggcagtaccgttggttcgtgctggactacaatgcaggactgctctcctactacacgtccaaggacaaaatgatgagaggctctcgcagaggatgtgttagactcagaggagctgtgattggtatagacgatgaggacgacagcaccttcacaataactgttgatcagaaaaccttccatttccaggcccgtgatgctgatgagcgagagaagtggatccatgccttagaagaaacaattcttcgacatactctccagcttcaaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggattacagtttaattaattattcttagtgcttaaggcttcataaagtaatttttccaaccttttttttaaaaa

SEQ ID NO: 163194 - DNA, 2670 bp, Homo sapiens
  Payload ID: 12156
  Gene Symbol: OSBPL9
  Gene Name: oxysterol binding protein-like 9
  ENST ID: ENST00000435274
  CDS Start-End: 20-370
gtcattggcggctcccaagatggcgtccatcatggaagggccgctgagcaaatggactaacgtgatgaagggctggcagtaccgttggttcgtgctggactacaatgcaggactgctctcctactacacgtccaaggacaaaatgatgagaggctctcgcagaggatgtgttagactcagaggagctgtgattggtatagacgatgaggacgacagcaccttcacaataactgttgatcagaaaaccttccatttccagggtgagctgaaagaagagattctttctcttcatagtcccatctgcttcttttcttctcttttgggttgtttgctggatgacttgaatggttttgcaactgatcctgcatgaacgagtgcataggaacattctggatgaagtggtactgcaggttaggcagggatttgtatctgcaatggatgtagatcgatttgaaacgactgtggatctggctgcagttggagatgaaaattttaaaggataaaaatcagtgaagggagagagtaatgggctgctgctgctgctggcttgtgtttacagaagcccgtgatgctgatgagcgagagaagtggatccatgccttagaagaaacaattcttcgacatactctccagcttcaaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttccctttt

SEQ ID NO: 163195 - DNA, 2893 bp, Homo sapiens
  Payload ID: 12156
  Gene Symbol: OSBPL9
  Gene Name: oxysterol binding protein-like 9
  Uniprot ID: Q96SU4
  ENST ID: ENST00000428468
  CDS Start-End: 3-2213
agatggcgtccatcatggaagggccgctgagcaaatggactaacgtgatgaagggctggcagtaccgttggttcgtgctggactacaatgcaggactgctctcctactacacgtccaaggacaaaatgatgagaggctctcgcagaggatgtgttagactcagaggagctgtgattggtatagacgatgaggacgacagcaccttcacaataactgttgatcagaaaaccttccatttccaggcccgtgatgctgatgagcgagagaagtggatccatgccttagaagaaacaattcttcgacatactctccagcttcaaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggattacagtttaattaattattcttagtgcttaaggcttcataaagtaatttttccaaccttttttttaaaaa

SEQ ID NO: 163196 - DNA, 2940 bp, Homo sapiens
  Payload ID: 12156
  Gene Symbol: OSBPL9
  Gene Name: oxysterol binding protein-like 9
  Uniprot ID: Q96SU4
  ENST ID: ENST00000447887
  CDS Start-End: 20-2260
gtcattggcggctcccaagatggcgtccatcatggaagggccgctgagcaaatggactaacgtgatgaagggctggcagtaccgttggttcgtgctggactacaatgcaggactgctctcctactacacgtccaaggacaaaatgatgagaggctctcgcagaggatgtgttagactcagaggagctgtgattggtatagacgatgaggacgacagcaccttcacaataactgttgatcagaaaaccttccatttccaggcccgtgatgctgatgagcgagagaagtggatccatgccttagaagaaacaattcttcgacatactctccagcttcaaatcagtaccacacttgcttttttccagtcttctggtatctctccagttcttgaattttcaaaaataattggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggattacagtttaattaattattcttagtgcttaaggcttcataaagtaatttttccaaccttttttttaaaaa

SEQ ID NO: 163197 - DNA, 2842 bp, Homo sapiens
  Payload ID: 12156
  Gene Symbol: OSBPL9
  Gene Name: oxysterol binding protein-like 9
  Uniprot ID: Q96SU4
  ENST ID: ENST00000453295
  CDS Start-End: 3-2162
agatggcgtccatcatggaagggccgctgagcaaatggactaacgtgatgaagggctggcagtaccgttggttcgtgctggactacaatgcaggactgctctcctactacacgggagctgtgattggtatagacgatgaggacgacagcaccttcacaataactgttgatcagaaaaccttccatttccaggcccgtgatgctgatgagcgagagaagtggatccatgccttagaagaaacaattcttcgacatactctccagcttcaaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggattacagtttaattaattattcttagtgcttaaggcttcataaagtaatttttccaaccttttttttaaaaa

SEQ ID NO: 163198 - DNA, 595 bp, Homo sapiens
  Payload ID: 12156
  Gene Symbol: OSBPL9
  Gene Name: oxysterol binding protein-like 9
  ENST ID: ENST00000533884
  CDS Start-End: 143-382
gtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagatgggattctgctatgttgcctaggctggtctcctagcctcaagcgatcctccttccttggcctaccaaagcagtgggattacagagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccag

SEQ ID NO: 163199 - DNA, 2529 bp, Homo sapiens
  Payload ID: 12156
  Gene Symbol: OSBPL9
  Gene Name: oxysterol binding protein-like 9
  Uniprot ID: Q96SU4
  ENST ID: ENST00000486942
  CDS Start-End: 173-1849
cggcccctacccctgagtccccggggtcccggccgccaggccggagcgcgaatgtcgtgctcaccctgcctccttcccgccgccccctgggctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggattacagtttaattaattattcttagtgcttaaggcttcataaagtaatttttccaaccttttttttaaaaa

SEQ ID NO: 163200 - DNA, 779 bp, Homo sapiens
  Payload ID: 12156
  Gene Symbol: OSBPL9
  Gene Name: oxysterol binding protein-like 9
  ENST ID: ENST00000528603
  CDS Start-End: 1-105
gaatcaattaaacactgcattgtgttgctgcagattgccaaagaccagagtaatgcggagaagcacgcagatggaatgatactatattgtgtttctttattttagagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgag

SEQ ID NO: 163201 - DNA, 581 bp, Homo sapiens
  Payload ID: 12156
  Gene Symbol: OSBPL9
  Gene Name: oxysterol binding protein-like 9
  ENST ID: ENST00000532975
  CDS Start-End: 254-581
atcaaggtgaaactccggggaccaggctccacagctgccataaactggatggcacgttagaagccggtgggtgtagggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctctt

SEQ ID NO: 163202 - DNA, 2210 bp, Homo sapiens
  Payload ID: 12156
  Gene Symbol: OSBPL9
  Gene Name: oxysterol binding protein-like 9
  Uniprot ID: Q96SU4
  ENST ID: ENST00000531828
  CDS Start-End: 495-2210
ggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattag

SEQ ID NO: 163203 - DNA, 2755 bp, Homo sapiens
  Payload ID: 12156
  Gene Symbol: OSBPL9
  Gene Name: oxysterol binding protein-like 9
  Uniprot ID: Q96SU4
  ENST ID: ENST00000462759
  CDS Start-End: 399-2075
agaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggattacagtttaattaattattcttagtgcttaaggcttcataaagtaatttttccaaccttttttttaaaaa

SEQ ID NO: 163204 - DNA, 530 bp, Homo sapiens
  Payload ID: 12156
  Gene Symbol: OSBPL9
  Gene Name: oxysterol binding protein-like 9
  ENST ID: ENST00000531061
  CDS Start-End: 1-350
tagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagaacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatcc

SEQ ID NO: 163205 - DNA, 1012 bp, Homo sapiens
  Payload ID: 12156
  Gene Symbol: OSBPL9
  Gene Name: oxysterol binding protein-like 9
  ENST ID: ENST00000489990
  CDS Start-End: 1-591
gcgtccatcatggaagggccgctgagcaaatggactaacgtgatgaagggctggcagtaccgttggttcgtgctggactacaatgcaggactgctctcctactacacgtccaaggacaaaatgatgagaggctctcgcagaggatgtgttagactcagaggagctgtgattggtatagacgatgaggacgacagcaccttcacaataactgttgatcagaaaaccttccatttccaggcccgtgatgctgatgagcgagagaagtggatccatgccttagaagaaacaattcttcgacatactctccagcttcaaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaagcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtt

SEQ ID NO: 163206 - DNA, 563 bp, Homo sapiens
  Payload ID: 12156
  Gene Symbol: OSBPL9
  Gene Name: oxysterol binding protein-like 9
  ENST ID: ENST00000527631
  CDS Start-End: 288-563
ggacgccctcccgccgctgcgcacccctcccgcgagctgccagctccctcggcctctccacccaaaactggcccaaccgccaatcgtctgcctctcacctcctacagcagggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaat

SEQ ID NO: 163207 - DNA, 630 bp, Homo sapiens
  Payload ID: 12156
  Gene Symbol: OSBPL9
  Gene Name: oxysterol binding protein-like 9
  ENST ID: ENST00000481937
  CDS Start-End: 533-630
agtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagatgggattctgctatgttgcctaggctggtctcctagcctcaagcgatcctccttccttggcctaccaaagcagtgggattacagagcatggtagaatcaattaaacactgcattgtgttgctgcagattgccaaagaccagagtaatgcggagaagcacgcagatggaatgatagtaagtttaat

SEQ ID NO: 163208 - DNA, 2831 bp, Homo sapiens
  Payload ID: 12156
  Gene Symbol: OSBPL9
  Gene Name: oxysterol binding protein-like 9
  ENST ID: ENST00000495776
  CDS Start-End: 1-223
gtcattggcggctcccaagatggcgtccatcatggaagggccgctgagcaaatggactaacgtgatgaagggctggcagtaccgttggttcgtgctggactacaatgcaggactgctctcctactacacgtccaaggacaaaatgatgagaggctctcgcagaggatgtgttagactcagacccgtgatgctgatgagcgagagaagtggatccatgccttagaagaaacaattcttcgacatactctccagcttcaaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggattacagtttaattaattattcttagtgcttaaggcttcataaagtaatttttccaaccttttttttaaaaa

SEQ ID NO: 163209 - DNA, 663 bp, Homo sapiens
  Payload ID: 12156
  Gene Symbol: OSBPL9
  Gene Name: oxysterol binding protein-like 9
  ENST ID: ENST00000526917
  CDS Start-End: 94-333
cggggatcgggtcgaggggagaagaaaaaggggtgctcgggagcagcccccggctacctcccctggaggcacagagggcgggggccttggcgaatggctttcttgctggccacttgcggaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagatgggattctgctatgttgcctaggctggtctcctagcctcaagcgatcctccttccttggcctaccaaagcagtgggattacagagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcact

SEQ ID NO: 163210 - DNA, 575 bp, Homo sapiens
  Payload ID: 12156
  Gene Symbol: OSBPL9
  Gene Name: oxysterol binding protein-like 9
  ENST ID: ENST00000534040
  CDS Start-End: 254-379
atcaaggtgaaactccggggaccaggctccacagctgccataaactggatggcacgttagaagccggtgggtgtagggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaaagtacaatcttggtgaggaatttgctcgtcttaccacttgtattagtctgcatgggctgccataacaaaataccatagactgggtggcttaaagaacagaagtttattttctcaccgttctggaagccagaagtccaagatcaacattctggcctgttcagtttctgatgagggtccttctcttggcctgtagatagccatgtcttcacatagtctttccttgagtactattaatcccgtagatgcaatatatcaacctagtcctttggaacct

SEQ ID NO: 163211 - DNA, 863 bp, Homo sapiens
  Payload ID: 12156
  Gene Symbol: OSBPL9
  Gene Name: oxysterol binding protein-like 9
  ENST ID: ENST00000625138
  CDS Start-End: 1-390
gagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattagggatgagttctcactgtgttgcctggactggtctcgaaatcctgaccttaagtaatgcttctgccttggcctcccaaaatgctgaaattacaggcgtgagccatcattcccagcccagcagtcttcatcttaagaagaaagctgcccagcatcagaggggtcaggttcccttctaaacagaatatgataatgctggcctgccaaaactacagcttcccctttaggaaagaactatggcaattccagagttcacaactgcattcagacctggcctacagagcatctcacactcactgtgcttgtgacattcccttgtaccaggccctccacaaagagctgggatttgaattctttgacgaagctcagcagagactcaagggaaaggccgtccatcaaagcctggtacttgtcaatcatagaccaacgggcatattccaagattaaaagccgtacatctctgtacagagggcaga

SEQ ID NO: 163212 - DNA, 4364 bp, Homo sapiens
  Payload ID: 12157
  Gene Symbol: OXTR
  Gene Name: oxytocin receptor
  Uniprot ID: P30559
  ENST ID: ENST00000316793
  CDS Start-End: 626-1795
atttgttaaggctctgggaccaacgctgggcgaaccagctccgctccggaggggtctgcgcggctggcctcgcccgccccctagcggacccgtgcgatagtgcagcctcagccccagcgcacagcgccgcatccagacgctgtccgcgcgcgcagcctgggaggcgctcctcgctcgcctcctgtacccatccagcgaccagccaggctgcggcgaggggattccaaccgaggctccagtgagagacctcagcttagcatcacattaggtgcagccggcaggccatcccaactcgggccgggagcgcacgcgtcactggggccgtcagtcgccgtgcaacttccccggggggagtcaactttaggttcgcctgcggactcggtgcagtggaagccgctgaacatcccgaggaactggcacgctgggggctctgggcttgtggccggtagaggattcccgctcatttgcagtggctcagaggagggtggacccagcagatccgtccgtggagtctccaggagtggagccccgggcgcccctacaccctccgacacgccggatccggcccagccgcgccaagccgtaaagggctcgaaggccggggcgcaccgctgccgccagggtcatggagggcgcgctcgcagccaactggagcgccgaggcagccaacgccagcgccgcgccgccgggggccgagggcaaccgcaccgccggacccccgcggcgcaacgaggccctggcgcgcgtggaggtggcggtgctgtgtctcatcctgctcctggcgctgagcgggaacgcgtgtgtgctgctggcgctgcgcaccacacgccagaagcactcgcgcctcttcttcttcatgaagcacctaagcatcgccgacctggtggtggcagtgtttcaggtgctgccgcagttgctgtgggacatcaccttccgcttctacgggcccgacctgctgtgccgcctggtcaagtacttgcaggtggtgggcatgttcgcctccacctacctgctgctgctcatgtccctggaccgctgcctggccatctgccagccgctgcgctcgctgcgccgccgcaccgaccgcctggcagtgctcgccacgtggctcggctgcctggtggccagcgcgccgcaggtgcacatcttctctctgcgcgaggtggctgacggcgtcttcgactgctgggccgtcttcatccagccctggggacccaaggcctacatcacatggatcacgctagctgtctacatcgtgccggtcatcgtgctcgctgcctgctacggccttatcagcttcaagatctggcagaacttgcggctcaagaccgctgcagcggcggcggccgaggcgccagagggcgcggcggctggcgatggggggcgcgtggccctggcgcgtgtcagcagcgtcaagctcatctccaaggccaagatccgcacggtcaagatgactttcatcatcgtgctggccttcatcgtgtgctggacgcctttcttcttcgtgcagatgtggagcgtctgggatgccaacgcgcccaaggaagcctcggccttcatcatcgtcatgctcctggccagcctcaacagctgctgcaacccctggatctacatgctgttcacgggccacctcttccacgaactcgtgcagcgcttcctgtgctgctccgccagctacctgaagggcagacgcctgggagagacgagtgccagcaaaaagagcaactcgtcctcctttgtcctgagccatcgcagctccagccagaggagctgctcccagccatccacggcgtgacccaccagccagggccagggctgcagcctgaggctcaggctgtgctggcataagtgctctgctcctaggtgatggcgtatgtttgtgtataaggtacctatcagtttgtatccctcccctccttggggtggcttcagtggggtggagagtggcctccatgatggaagatgataggggactcagccatcagacaacaccctggcctcctacacgtacttctaccaccctgaacccactgctgccctgggcagtgagtggcttgttttttctcctggacttgtaatttcactccagtatatttttacttcttcattctgggatattgtgaaaagcggtaaatataggattggtgaccaattgggtcaggaagtccagtgttctggacttggggtaagcagtggggttgggacctcagatgggaagggtggtgctaagatcctcctgacctcaaagtgtatttgcctttaagcgaacaaatgctggggtccttggggaccagcttgtcagagggtagccctaagagaaggggattaccttgtaagaccatctggcgcagtggacctattagaacttgggttaaaaatgtttaagaagctaatgtttaagaagcatttgggaaagaaaaagaaataaatgtatccagataggaaaagaagaagtaaaactatttgcagatgacacagttttgtatatagaaaatcctaaggaactcacacacacacacacacacacacacgcacacagctattagaactaataagcaagttccgcaaggtttcaagatacaagatcaatatacaaaaatgaattgtatttctttatactagcaacaaacaatatgaaaacgaagttaaataattccatttataataccatcagaaagaataaaataggaatcaacttaacaaaacaagtgcaagactgaaaactacaaaattggaaagaaattaaagaaggcttaaataaatggaaagacatcctgtgttcatggatcagacttagtattgttaagatggcaatactatcctaactgacatgcagattcagtgcaatccttatgaaaatcatagctggcttctttacagaaattgataagctagtcccaaaattcataaagaaatgcaagggacccagaatatccaaataagccttgaaaaagaacaaagttggtggattcacacttcctgatttcataatttacgataaaggtaatcagctcagtgtgttactggtttaaggatagacatacggagcagaataaagagtacagatatgaacacttatacttacggtcaattgatttttgacaaggttcccaagacaattcaatagagaaaggagagtcttttcaacaaatggcaccgagacaatgatatgcaagtgcaaaagaatgaggttggacctttactcacactatgtgcaaaaatcaactcaaaacgcatccaagatctaaatataagagctgaaactataaaatcttagaaagaaacataggcatagatctttgtaaccttgaattaggcagtggtttcttagatatgataccaaagacacaagcaaccaatggaaaaataggtaaattggacttaatcaagatttgaagcttttgtgattgaaaagaccctatcaagaaggtgaaaagataacctgcagaatgggagaaaatatttgcgagtcatatatatgataaggggcttgtatctggaatatataaataactcttataacacaacaataaggagaaaaataaatcaatttaaaaaatgggctaacggtttgaatagacatttctccaaagaagatatgcaaatggctactaagcacatgaaaaaatactcaacattattattcattagggaaatgcaagtcaaaatcacaatgagattccagtttacaatcactaggatggctacaataaaaagatggacaagaacgagtgtcggtgaggatgtagagaaactggtagaaatttaaattgttggtgggaatgtaaatggtgcacctgctttgaaaaacagtttggcagtacctcaaaaagttaaacgtagagtgaccatatgacccaggaatgccactcctaggtatttacccaagagaaatgaaaacgtacatacacacaaaaacttgtacaccaatgttcatagcaacattatttgtaatagccaaaaagtggaaacaacccaaatgtctaccaactgatgaatgggaaataaaatgtggtctgtccacgcaatggaacattattagactctaaaaagaaatgaagtactcacacatgccacaacatggatgagccttgaaaacttgctaagtgaaagaagccaggtgcaaaagcccacatattgtctgactgcattgaaatgcaatgtctaaaatggacgaatctatatagagtgaatatagattagcgtttgccagggcctggaggctgtgagagatgaggcatgactactaagggtttggggtttctttttcgggtgatgaaaatgttctgaaattagtggtgattgtgcacgattttgagaatgtactaaaaaccaatgaactttaaaaaataaaaataaacaaa

SEQ ID NO: 163213 - DNA, 600 bp, Homo sapiens
  Payload ID: 12157
  Gene Symbol: OXTR
  Gene Name: oxytocin receptor
  ENST ID: ENST00000449615
  CDS Start-End: 325-600
tggagattccctcggggaggtgatttggttttagattcccactcccggaggaacgttgctgattttgaccctcccttctcccccagtggaagccgctgaacatcccgaggaactggcacgctgggggctctgggcttgtggccggtagaggattcccgctcatttgcagtggctcagaggagggtggacccagcagatccgtccgtggagtctccaggagtggagccccgggcgcccctacaccctccgacacgccggatccggcccagccgcgccaagccgtaaagggctcgaaggccggggcgcaccgctgccgccagggtcatggagggcgcgctcgcagccaactggagcgccgaggcagccaacgccagcgccgcgccgccgggggccgagggcaaccgcaccgccggacccccgcggcgcaacgaggccctggcgcgcgtggaggtggcggtgctgtgtctcatcctgctcctggcgctgagcgggaacgcgtgtgtgctgctggcgctgcgcaccacacgccagaagcactcgcgcctcttcttcttcatgaagcacctaagcatcgccgacctggtggtggcagtgtttcag

SEQ ID NO: 163214 - DNA, 743 bp, Homo sapiens
  Payload ID: 12157
  Gene Symbol: OXTR
  Gene Name: oxytocin receptor
  ENST ID: ENST00000431493
  CDS Start-End: 614-743
aaaataaacccatttgttaaggctctgggaccaacgctgggcgaaccagctccgctccggaggggtctgcgcggctggcctcgcccgccccctagcggacccgtgcgatagtgcagcctcagccccagcgcacagcgccgcatccagacgctgtccgcgcgcgcagcctgggaggcgctcctcgctcgcctcctgtacccatccagcgaccagccaggctgcggcgaggggattccaaccgaggctccagtgagagacctcagcttagcatcacattaggtgcagccggcaggccatcccaactcgggccgggagcgcacgcgtcactggggccgtcagtcgccgtgcaacttccccggggggagtcaactttagtggaagccgctgaacatcccgaggaactggcacgctgggggctctgggcttgtggccggtagaggattcccgctcatttgcagtggctcagaggagggtggacccagcagatccgtccgtggagtctccaggagtggagccccgggcgcccctacaccctccgacacgccggatccggcccagccgcgccaagccgtaaagggctcgaaggccggggcgcaccgctgccgccagggtcatggagggcgcgctcgcagccaactggagcgccgaggcagccaacgccagcgccgcgccgccgggggccgagggcaaccgcaccgccggacccccgcggcgcaacgaggccctggcgcgcgtggaggtgg

SEQ ID NO: 163215 - DNA, 513 bp, Homo sapiens
  Payload ID: 12158
  Gene Symbol: OXT
  Gene Name: oxytocin/neurophysin I prepropeptide
  Uniprot ID: P01178
  ENST ID: ENST00000217386
  CDS Start-End: 37-414
accagtcacggaccctggacccagcgcacccgcaccatggccggccccagcctcgcttgctgtctgctcggcctcctggcgctgacctccgcctgctacatccagaactgccccctgggaggcaagagggccgcgccggacctcgacgtgcgcaagtgcctcccctgcggccccgggggcaaaggccgctgcttcgggcccaatatctgctgcgcggaagagctgggctgcttcgtgggcaccgccgaagcgctgcgctgccaggaggagaactacctgccgtcgccctgccagtccggccagaaggcgtgcgggagcgggggccgctgcgcggtcttgggcctctgctgcagcccggacggctgccacgccgaccctgcctgcgacgcggaagccaccttctcccagcgctgaaacttgatggctccgaacaccctcgaagcgcgccactcgcttcccccatagccaccccagaaatggtgaaaataaaataaagcaggtttttctcctcta

SEQ ID NO: 163216 - DNA, 665 bp, Homo sapiens
  Payload ID: 12159
  Gene Symbol: PAGE1
  Gene Name: P antigen family, member 1 (prostate associated)
  Uniprot ID: O75459
  ENST ID: ENST00000376150
  CDS Start-End: 134-574
gcccacgtggagaacgccagggagctgtgagagtgtgcagtcgcgttcctgctgtccggacacttttttcctctactgagactcatctggtagatccgcaggccagtcctcccaggggctgaagttgtgaaatatgggttttctaagaagattaatctatcggcgtagaccaatgatctatgtagaatcttctgaggagtccagtgatgagcaacctgacgaagtggaatcaccaactcaaagtcaggattctacacctgctgaagagagagaggatgagggagcatctgcagctcaagggcaggagcctgaagctgatagccaggaactggttcagccaaagactgggtgtgagcttggagatggtcctgataccaagagggtgtgcctgcgaaatgaagagcagatgaaactgcccgcagaagggccagagcctgaagcggatagccaggaacaggttcacccgaagactgggtgtgagcgcggagatggtcctgatgtccaggagttgggcctgccaaatccagaggaggtgaaaacacctgaggaagatgaagggcaatcacagccttaaaagaagacacgctgaaatggttcaggctgctcctgtgttggaaatttgaccattaaaattctcccaataaagctttacagccttctgcaaa

SEQ ID NO: 163217 - DNA, 456 bp, Homo sapiens
  Payload ID: 12160
  Gene Symbol: PAGE2
  Gene Name: P antigen family, member 2 (prostate associated)
  ENST ID: ENST00000374965
  CDS Start-End: 61-345
tcttcattctttccgccatcttgattctttctcactgaccaagactcagccgtgggaaatatgagtgagcttctaagagcaagatcccaatcctcagaaagaggaaatgaccaagagtcttcccagccggttggatctgtgattgtccaggagcccactgaggaaaaacgtcaagaagaggaaccaccaactgataatcaggggcctgacatggaagcttttcaacaggaactggctctgcttaagatagaggatgagcctggagatggtcctgatgtcagggagggtattatgcccacttttgatctcactaaagtgctggaagcaggtgatgcgcaaccataggtttcaagcaagacaaatgaagactgaaaccaagaacgttattcttaatctggaaatttgactgataatattctcttaataaagttttaagttttctgcaaagaatcctta

SEQ ID NO: 163218 - DNA, 551 bp, Homo sapiens
  Payload ID: 12160
  Gene Symbol: PAGE2
  Gene Name: P antigen family, member 2 (prostate associated)
  Uniprot ID: Q7Z2X7
  ENST ID: ENST00000374968
  CDS Start-End: 105-440
tgcccgtcttgtgtccgcacagaggtctgcaaggagagagagtgtcttcattctttccgccatcttgattctttctcactgaccaagactcagccgtgggaaatatgagtgagcttctaagagcaagatcccaatcctcagaaagaggaaatgaccaagagtcttcccagccggttggatctgtgattgtccaggagcccactgaggaaaaacgtcaagaagaggaaccaccaactgataatcagggtattgcacctagtggggagattgaaaatcaagcagtgcctgcttttcaagggcctgacatggaagcttttcaacaggaactggctctgcttaagatagaggatgagcctggagatggtcctgatgtcagggagggtattatgcccacttttgatctcactaaagtgctggaagcaggtgatgcgcaaccataggtttcaagcaagacaaatgaagactgaaaccaagaacgttattcttaatctggaaatttgactgataatattctcttaataaagttttaagttttctgcaaagaatcctta

SEQ ID NO: 163219 - DNA, 311 bp, Homo sapiens
  Payload ID: 12160
  Gene Symbol: PAGE2
  Gene Name: P antigen family, member 2 (prostate associated)
  ENST ID: ENST00000449097
  CDS Start-End: 119-311
agttgtgagagaatgtgtggaggagccagctggctttggacaggtcctgcggcacagtctgtggcttctgagggaaaagggcctcggggccgtcatccagctcctcccagtgggaaatatgagtgagcttctaagagcaagatcccaatcctcagaaagaggaaatgaccaagagtcttcccagccggttggatctgtgattgtccaggagcccactgaggaaaaacgtcaagaagaggaaccaccaactgataatcagggtattgcacctagtggggagattgaaaatcaagcagtgcctgcttttcaag

SEQ ID NO: 163220 - DNA, 493 bp, Homo sapiens
  Payload ID: 12161
  Gene Symbol: PAGE2B
  Gene Name: P antigen family, member 2B
  Uniprot ID: Q5JRK9
  ENST ID: ENST00000374971
  CDS Start-End: 53-388
ctttccgccatcttgattctttgtcactgaccgagactcagccgtgggaaatatgagtgagcatgtgagaacaagatcccaatcctcagaaagaggaaatgaccaagagtcttcccagccagttggatctgtgattgtccaggagcccactgaggaaaaacgtcaagaagaggaaccaccaactgataatcagggtattgcacctagtggggagatcgaaaatgaaggagcacctgccgttcaagggcctgacatggaagcttttcaacaggaactggctctgcttaagatagaggatgagcctggagatggtcctgatgtcagggaggggattatgcccacttttgatctcactaaagtgctggaagcaggtgatgcgcaaccataggtttcaagcaagacaaatgaagactgaaaccaagaacgttattcttaatctggaaatttgactgataatattctcttaataaagttttaagttttctgcaaagaa

SEQ ID NO: 163221 - DNA, 456 bp, Homo sapiens
  Payload ID: 12161
  Gene Symbol: PAGE2B
  Gene Name: P antigen family, member 2B
  ENST ID: ENST00000374974
  CDS Start-End: 61-345
tcttcattctttccgccatcttgattctttgtcactgaccgagactcagccgtgggaaatatgagtgagcatgtgagaacaagatcccaatcctcagaaagaggaaatgaccaagagtcttcccagccagttggatctgtgattgtccaggagcccactgaggaaaaacgtcaagaagaggaaccaccaactgataatcaggggcctgacatggaagcttttcaacaggaactggctctgcttaagatagaggatgagcctggagatggtcctgatgtcagggaggggattatgcccacttttgatctcactaaagtgctggaagcaggtgatgcgcaaccataggtttcaagcaagacaaatgaagactgaaaccaagaacgttattcttaatctggaaatttgactgataatattctcttaataaagttttaagttttctgcaaagaatcctta

SEQ ID NO: 163222 - DNA, 745 bp, Homo sapiens
  Payload ID: 12162
  Gene Symbol: PAGE3
  Gene Name: P antigen family, member 3 (prostate associated)
  Uniprot ID: Q5JUK9
  ENST ID: ENST00000374951
  CDS Start-End: 310-651
cttcattctttctcactgactgggactcagctggtaggtccgcagatcagtcctcctgggaatttagttgtgagtgaatgtgaaggggagccagcgggctttggacaggtcctgcggcacagaaaccacagtccgtggcttctgagagaaaagggcctcgccgtcgacgtccggctcctcccaggtcgcgacgccccatgggcctttgtcgtcgtttctgggccaggacgacggaggaaggtggaccgtagaggggaggaatcacgtgaagatggggcgagtgctgggcgtgctgttggagagtgaaacatgagtggacatcaaagaacaagatccagatctagagaaagaagagatgatcaagactctaatcatccagtaggggctgtggttgcccaggagctgcccagtaatgaccagcttcaacaagaggaaccaccaattgaaagtcaggattatacacctggtcaagagagagacgagggagcactggacttccaagtgctaggcctggcagcctatctctgggaactgactcggtcaaagactgggggtgaacgtggagatggtcctaatgtcaagggagaatttctgccaaatctggagcctgttaaaataccagaagcaggtgaagggcaaccatcggtttaaatgaagacaagctgaaaccatacatgcagtctttatgttggaaacttcaccagtaaaattctctcaataaagtttcacaattgtctgcaaagaa

SEQ ID NO: 163223 - DNA, 577 bp, Homo sapiens
  Payload ID: 12162
  Gene Symbol: PAGE3
  Gene Name: P antigen family, member 3 (prostate associated)
  Uniprot ID: Q5JUK9
  ENST ID: ENST00000519203
  CDS Start-End: 208-549
gcacagaaaccacagtccgtggcttctgagagaaaagggcctcgccgtcgacgtccggctcctcccaggtcgcgacgccccatgggcctttgtcgtcgtttctgggccaggacgacggaggaaggtggaccgtagaggggaggaatcacgtgaagatggggcgagtgctgggcgtgctgttggagtatgccactttcagagtgaaacatgagtggacatcaaagaacaagatccagatctagagaaagaagagatgatcaagactctaatcatccagtaggggctgtggttgcccaggagctgcccagtaatgaccagcttcaacaagaggaaccaccaattgaaagtcaggattatacacctggtcaagagagagacgagggagcactggacttccaagtgctaggcctggcagcctatctctgggaactgactcggtcaaagactgggggtgaacgtggagatggtcctaatgtcaagggagaatttctgccaaatctggagcctgttaaaataccagaagcaggtgaagggcaaccatcggtttaaatgaagacaagctgaaaccatacatgca

SEQ ID NO: 163224 - DNA, 499 bp, Homo sapiens
  Payload ID: 12163
  Gene Symbol: PAGE4
  Gene Name: P antigen family, member 4 (prostate associated)
  Uniprot ID: O60829
  ENST ID: ENST00000218068
  CDS Start-End: 80-388
gccacttctcttcccttcattcttcgccaggctctctgctgactcaagttcttcagttcacgatcttctagttgcagcgatgagtgcacgagtgagatcaagatccagaggaagaggagatggtcaggaggctcccgatgtggttgcattcgtggctcccggtgaatctcagcaagaggaaccaccaactgacaatcaggatattgaacctggacaagagagagaaggaacacctccgatcgaagaacgtaaagtagaaggtgattgccaggaaatggatctggaaaagactcggagtgagcgtggagatggctctgatgtaaaagagaagactccacctaatcctaagcatgctaagactaaagaagcaggagatgggcagccataagttaaaaagaagacaagctgaagctacacacatggctgatgtcacattgaaaatgtgactgaaaatttgaaaattctctcaataaagtttgagttttctctgaagaagtca

SEQ ID NO: 163225 - DNA, 487 bp, Homo sapiens
  Payload ID: 12163
  Gene Symbol: PAGE4
  Gene Name: P antigen family, member 4 (prostate associated)
  Uniprot ID: O60829
  ENST ID: ENST00000376141
  CDS Start-End: 68-376
tgacactgctgaggtctaaacaaggaggcagaagtagtcttcagttcacgatcttctagttgcagcgatgagtgcacgagtgagatcaagatccagaggaagaggagatggtcaggaggctcccgatgtggttgcattcgtggctcccggtgaatctcagcaagaggaaccaccaactgacaatcaggatattgaacctggacaagagagagaaggaacacctccgatcgaagaacgtaaagtagaaggtgattgccaggaaatggatctggaaaagactcggagtgagcgtggagatggctctgatgtaaaagagaagactccacctaatcctaagcatgctaagactaaagaagcaggagatgggcagccataagttaaaaagaagacaagctgaagctacacacatggctgatgtcacattgaaaatgtgactgaaaatttgaaaattctctcaataaagtttgagttttctctgaagaagtca

SEQ ID NO: 163226 - DNA, 741 bp, Homo sapiens
  Payload ID: 12164
  Gene Symbol: PAGE5
  Gene Name: P antigen family, member 5 (prostate associated)
  Uniprot ID: Q96GU1
  ENST ID: ENST00000289619
  CDS Start-End: 246-638
aggcagagctctgcaaggagaggttgtgtcttcgttctttccgccatcttcgttctttccaacatcttcgttctttctcactgaccgagactcagccggtaggtctgcagagtggtcttcctggtaatttagttgtgagtgaatgtgtggaggagccagcgggcttaggacaggtcccgtggcacagtccgtggctttgagggaaaagggcctcgcggtggtcctccgccttcccccaggtcctgatgcaggcgccatgggccggtaatcgtggctgggctggaacgagggaggaagtgagagatatgagtgagcatgtaacaagatcccaatcctcagaaagaggaaatgaccaagagtcttcccagccagttggacctgtgattgtccagcagcccactgaggaaaaacgtcaagaagaggaaccaccaactgataatcagggtattgcacctagtggggagatcaaaaatgaaggagcacctgctgttcaagggactgatgtggaagcttttcaacaggaactggctctgcttaagatagaggatgcacctggagatggtcctgatgtcagggaggggactctgcccacttttgatcccactaaagtgctggaagcaggtgaagggcaactataggtttaaaccaagacaaatgaagactgaaaccaagaatattgttcttatgctggaaatttgactgctaacattctcttaataaagttttacagttttctgcaaa

SEQ ID NO: 163227 - DNA, 428 bp, Homo sapiens
  Payload ID: 12164
  Gene Symbol: PAGE5
  Gene Name: P antigen family, member 5 (prostate associated)
  ENST ID: ENST00000374952
  CDS Start-End: 42-323
cttcgttctttctcactgaccgagactcagccgtgagagatatgagtgagcatgtaacaagatcccaatcctcagaaagaggaaatgaccaagagtcttcccagccagttggacctgtgattgtccagcagcccactgaggaaaaacgtcaagaagaggaaccaccaactgataatcaggggactgatgtggaagcttttcaacaggaactggctctgcttaagatagaggatgcacctggagatggtcctgatgtcagggaggggactctgcccacttttgatcccactaaagtgctggaagcaggtgaagggcaactataggtttaaaccaagacaaatgaagactgaaaccaagaatattgttcttatgctggaaatttgactgctaacattctcttaataaagttttacagttttctgcaaaga

SEQ ID NO: 163228 - DNA, 540 bp, Homo sapiens
  Payload ID: 12164
  Gene Symbol: PAGE5
  Gene Name: P antigen family, member 5 (prostate associated)
  Uniprot ID: Q96GU1
  ENST ID: ENST00000374955
  CDS Start-End: 105-437
gcagagctctgcaaggagaggttgtgtcttcgttctttccgccatcttcgttctttccaacatcttcgttctttctcactgaccgagactcagccgtgagagatatgagtgagcatgtaacaagatcccaatcctcagaaagaggaaatgaccaagagtcttcccagccagttggacctgtgattgtccagcagcccactgaggaaaaacgtcaagaagaggaaccaccaactgataatcagggtattgcacctagtggggagatcaaaaatgaaggagcacctgctgttcaagggactgatgtggaagcttttcaacaggaactggctctgcttaagatagaggatgcacctggagatggtcctgatgtcagggaggggactctgcccacttttgatcccactaaagtgctggaagcaggtgaagggcaactataggtttaaaccaagacaaatgaagactgaaaccaagaatattgttcttatgctggaaatttgactgctaacattctcttaataaagttttacagttttctgcaaa

SEQ ID NO: 163229 - DNA, 2543 bp, Homo sapiens
  Payload ID: 12165
  Gene Symbol: PAK1
  Gene Name: p21 protein (Cdc42/Rac)-activated kinase 1
  Uniprot ID: Q13153
  ENST ID: ENST00000278568
  CDS Start-End: 531-2192
cctcccgcggctgcagccggagccgaaggtggtggctgcacagtagacgccccctcacggcttcccccacacgctcccgccccctcgctcgcccatcgcgcttccctcacaggctctgcagtcctcccccacagacgccttcccccttggactctcattcccttttccacggagccccgcgctttcgtgagccccctcgaggaacctggtctccgcatccagttaccacctcctgcctcagaggccatctgagcccttcgcacctcgcccctcagtccccccttccccccccgcccgcgtcgcctcgctccctcccgcccccccatcatcccttccctcgcagttcccctgtcctgaggggagccccgccacgggcagcgcggcggcggcggcaggagggagaaagtgaagcggtagctcgcgcacactcgcgccctcactcccggctaggcggcacccaccgccgggaggaggaggaggagccgagaggagctgagcgagcgcggaagtagctgctgctggtggtgacaatgtcaaataacggcctagacattcaagacaaacccccagcccctccgatgagaaataccagcactatgattggagccggcagcaaagatgctggaaccctaaaccatggttctaaacctctgcctccaaacccagaggagaagaaaaagaaggaccgattttaccgatccattttacctggagataaaacaaataaaaagaaagagaaagagcggccagagatttctctcccttcagattttgaacacacaattcatgtcggttttgatgctgtcacaggggagtttacgggaatgccagagcagtgggcccgcttgcttcagacatcaaatatcactaagtcggagcagaagaaaaacccgcaggctgttctggatgtgttggagttttacaactcgaagaagacatccaacagccagaaatacatgagctttacagataagtcagctgaggattacaattcttctaatgccttgaatgtgaaggctgtgtctgagactcctgcagtgccaccagtttcagaagatgaggatgatgatgatgatgatgctaccccaccaccagtgattgctccacgcccagagcacacaaaatctgtatacacacggtctgtgattgaaccacttcctgtcactccaactcgggacgtggctacatctcccatttcacctactgaaaataacaccactccaccagatgctttgacccggaatactgagaagcagaagaagaagcctaaaatgtctgatgaggagatcttggagaaattacgaagcatagtgagtgtgggcgatcctaagaagaaatatacacggtttgagaagattggacaaggtgcttcaggcaccgtgtacacagcaatggatgtggccacaggacaggaggtggccattaagcagatgaatcttcagcagcagcccaagaaagagctgattattaatgagatcctggtcatgagggaaaacaagaacccaaacattgtgaattacttggacagttacctcgtgggagatgagctgtgggttgttatggaatacttggctggaggctccttgacagatgtggtgacagaaacttgcatggatgaaggccaaattgcagctgtgtgccgtgagtgtctgcaggctctggagttcttgcattcgaaccaggtcattcacagagacatcaagagtgacaatattctgttgggaatggatggctctgtcaagctaactgactttggattctgtgcacagataaccccagagcagagcaaacggagcaccatggtaggaaccccatactggatggcaccagaggttgtgacacgaaaggcctatgggcccaaggttgacatctggtccctgggcatcatggccatcgaaatgattgaaggggagcctccatacctcaatgaaaaccctctgagagccttgtacctcattgccaccaatgggaccccagaacttcagaacccagagaagctgtcagctatcttccgggactttctgaaccgctgtctcgagatggatgtggagaagagaggttcagctaaagagctgctacaggtgagaaaactgaggtttcaagtgtttagtaacttttccatgatagctgcatcaattcctgaagattgccaagcccctctccagcctcactccactgattgctgcagctaaggaggcaacaaagaacaatcactaaaaccacactcaccccagcctcattgtgccaagccttctgtgagataaatgcacatttcagaaattccaactcctgatgccctcttctccttgccttgcttctcccatttcctgatctagcactcctcaagactttgatccttggaaaccgtgtgtccagcattgaagagaactgcaactgaatgactaatcagatgatggccatttctaaataaggaatttcctcccaattcatggatatgagggtggtttatgattaagggtttatataaataaatgtttctagtcttccgtgtgtcaaaatcctcacctccttcataaccatct

SEQ ID NO: 163230 - DNA, 3737 bp, Homo sapiens
  Payload ID: 12165
  Gene Symbol: PAK1
  Gene Name: p21 protein (Cdc42/Rac)-activated kinase 1
  Uniprot ID: Q13153
  ENST ID: ENST00000356341
  CDS Start-End: 533-2170
gccctcccgcggctgcagccggagccgaaggtggtggctgcacagtagacgccccctcacggcttcccccacacgctcccgccccctcgctcgcccatcgcgcttccctcacaggctctgcagtcctcccccacagacgccttcccccttggactctcattcccttttccacggagccccgcgctttcgtgagccccctcgaggaacctggtctccgcatccagttaccacctcctgcctcagaggccatctgagcccttcgcacctcgcccctcagtccccccttccccccccgcccgcgtcgcctcgctccctcccgcccccccatcatcccttccctcgcagttcccctgtcctgaggggagccccgccacgggcagcgcggcggcggcggcaggagggagaaagtgaagcggtagctcgcgcacactcgcgccctcactcccggctaggcggcacccaccgccgggaggaggaggaggagccgagaggagctgagcgagcgcggaagtagctgctgctggtggtgacaatgtcaaataacggcctagacattcaagacaaacccccagcccctccgatgagaaataccagcactatgattggagccggcagcaaagatgctggaaccctaaaccatggttctaaacctctgcctccaaacccagaggagaagaaaaagaaggaccgattttaccgatccattttacctggagataaaacaaataaaaagaaagagaaagagcggccagagatttctctcccttcagattttgaacacacaattcatgtcggttttgatgctgtcacaggggagtttacgggaatgccagagcagtgggcccgcttgcttcagacatcaaatatcactaagtcggagcagaagaaaaacccgcaggctgttctggatgtgttggagttttacaactcgaagaagacatccaacagccagaaatacatgagctttacagataagtcagctgaggattacaattcttctaatgccttgaatgtgaaggctgtgtctgagactcctgcagtgccaccagtttcagaagatgaggatgatgatgatgatgatgctaccccaccaccagtgattgctccacgcccagagcacacaaaatctgtatacacacggtctgtgattgaaccacttcctgtcactccaactcgggacgtggctacatctcccatttcacctactgaaaataacaccactccaccagatgctttgacccggaatactgagaagcagaagaagaagcctaaaatgtctgatgaggagatcttggagaaattacgaagcatagtgagtgtgggcgatcctaagaagaaatatacacggtttgagaagattggacaaggtgcttcaggcaccgtgtacacagcaatggatgtggccacaggacaggaggtggccattaagcagatgaatcttcagcagcagcccaagaaagagctgattattaatgagatcctggtcatgagggaaaacaagaacccaaacattgtgaattacttggacagttacctcgtgggagatgagctgtgggttgttatggaatacttggctggaggctccttgacagatgtggtgacagaaacttgcatggatgaaggccaaattgcagctgtgtgccgtgagtgtctgcaggctctggagttcttgcattcgaaccaggtcattcacagagacatcaagagtgacaatattctgttgggaatggatggctctgtcaagctaactgactttggattctgtgcacagataaccccagagcagagcaaacggagcaccatggtaggaaccccatactggatggcaccagaggttgtgacacgaaaggcctatgggcccaaggttgacatctggtccctgggcatcatggccatcgaaatgattgaaggggagcctccatacctcaatgaaaaccctctgagagccttgtacctcattgccaccaatgggaccccagaacttcagaacccagagaagctgtcagctatcttccgggactttctgaaccgctgtctcgagatggatgtggagaagagaggttcagctaaagagctgctacagcatcaattcctgaagattgccaagcccctctccagcctcactccactgattgctgcagctaaggaggcaacaaagaacaatcactaaaaccacactcaccccagcctcattgtgccaagccttctgtgagataaatgcacatttcagaaattccaactcctgatgccctcttctccttgccttgcttctcccatttcctgatctagcactcctcaagactttgatccttggaaaccgtgtgtccagcattgaagagaactgcaactgaatgactaatcagatgatggccatttctaaataaggaatttcctcccaattcatggatatgagggtggtttatgattaagggtttatataaataaatgtttctagtcttccgtgtgtcaaaatcctcacctccttcataaccatctcccacaattaattcttgactatataaatttatggtttgataatattatcaatttgtaatcaattgagatttctttagtgcttgcttttctgtgactcaactgcccagacacctcattgtacttgaaaactggaacagcttgggaatgccatggggtttgataatctgccagggacatgaagaggctcagcttcctggaccatgactttggctcagctgatcctgacatgggagaacaaccacatttttctttgtgtgtgcttctagcagctgttcgggaggaccttgacccaatagtgttcccatgctgtttcttgtgaaatgctctcggctatgtagcagcttttgattccctgcataccctaggctgctgcccctatcctgtcccttgtttataacattgagaggttttctagggcacatactgagtgagagcagtgttgagaagtcggggaaaatggtgactacttttagagcaaggctgggcatcagcacctgtccagctctacttgtgtgatgtttcaggaactcagcccctttttctgcctaggataaggagctgaaagattaacttggatcttctaatggtccaaatcttttggtcacaataaagagtctccaaattagagactgcatgttagttctggatggatttggtggcctgacatgataccctgccagctgtgaggggaccccgtttttaagatgcatggccaagctctctgcaaatggaaatgcttacactgggtgttggggatgtttgctacctcctgctatttttgtggttttggttctcccactatggtaggacccctggccagcattgtggcttgtcatgtcagccccattgactaccttctcatgctctgaggtactactgcctctgcagcacaaatttctatttctgtcaataaaaggagatgaaaatattctattggagtatgcctttcttttttctcttcgttttttctttccttttctaattttttatatgaaataatgagtagtttcttcctgaaccatttgagagtggtaagttgcagatagaatgcccctttaccactatatacctgaatgtgtattctttctttttaacacttttattttaaatataaattaagagaaatgggccaaaaccatttgtattgtttaaagaataattataaacacacttgtatccaccaaatcaagaaatggaacactgacagtaagaaccttctctatcttgtccttcctttctca

SEQ ID NO: 163231 - DNA, 878 bp, Homo sapiens
  Payload ID: 12165
  Gene Symbol: PAK1
  Gene Name: p21 protein (Cdc42/Rac)-activated kinase 1
  ENST ID: ENST00000533285
  CDS Start-End: 1-733
tgcttcaggcaccgtgtacacagcaatggatgtggccacaggacaggaggtggccattaagcagatgaatcttcagcagcagcccaagaaagagctgattattaatgagatcctggtcatgagggaaaacaagaacccaaacattgtgaattacttggacagttacctcgtgggagatgagctgtgggttgttatggaatacttggctggaggctccttgacagatgtggtgacagaaacttgcatggatgaaggccaaattgcagctgtgtgccgtgagtgtctgcaggctctggagttcttgcattcgaaccaggtcattcacagagacatcaagagtgacaatattctgttgggaatggatggctctgtcaagctaactgactttggattctgtgcacagataaccccagagcagagcaaacggagcaccatggtaggaaccccatactggatggcaccagaggttgtgacacgaaaggcctatgggcccaaggttgacatctggtccctgggcatcatggccatcgaaatgattgaaggggagcctccatacctcaatgaaaaccctctgagagccttgtacctcattgccaccaatgggaccccagaacttcagaacccagagaagctgtcagctatcttccgggactttctgaaccgctgtctcgagatggatgtggagaagagaggttcagctaaagagctgctacaggctttggtatcaggatgatgctggcctcataaaatgagttagggaggattccctctttttctgttgattggaatagtttcagaaggaatggtaccatttcctccttgtacctctggtacaattcggctgtgaatccatctggtcctggactctttttggttgg

SEQ ID NO: 163232 - DNA, 1047 bp, Homo sapiens
  Payload ID: 12165
  Gene Symbol: PAK1
  Gene Name: p21 protein (Cdc42/Rac)-activated kinase 1
  ENST ID: ENST00000527457
  CDS Start-End: 1-503
caaatatcactaagtcggagcagaagaaaaacccgcaggctgttctggatgtgttggagttttacaactcgaagaagacatccaacagccagaaatacatgagctttacagataagtcagctgaggattacaattcttctaatgccttgaatgtgaaggctgtgtctgagactcctgcagtgccaccagtttcagaagatgaggatgatgatgatgatgatgctaccccaccaccagtgattgctccacgcccagagcacacaaaatctgtatacacacggtctgtgattgaaccacttcctgtcactccaactcgggacgtggctacatctcccatttcacctactgaaaataacaccactccaccagatgctttgacccggaatactgagaagcagaagaagaagcctaaaatgtctgatgaggagatcttggagaaattacttacctcgtgggagatgagctgtgggttgttatggaatacttggctggaggctccttgacagatgtggtgacagaaacttgcatggatgaaggccaaattgcagctgtgtgccgtgagctgactttggattctgtgcacagataaccccagagcagagcaaacggagcaccatggtaggaaccccatactggatggcaccagaggttgtgacacgaaaggcctatgggcccaaggttgacatctggtccctgggcatcatggccatcgaaatgattgaaggggagcctccatacctcaatgaaaaccctctgagagccttgtacctcattgccaccaatgggaccccagaacttcagaacccagagaagctgtcagctatcttccgggactttctgaaccgctgtctcgagatggatgtggagaagagaggttcagctaaagagctgctacagcatcaattcctgaagattgccaagcccctctccagcctcactccactgattgctgcagctaaggaggcaacaaagaacaatcactaaaaccacactcaccccagcctcattgtgccaagccttctgtgagataaatgcacatttcagaaa

SEQ ID NO: 163233 - DNA, 559 bp, Homo sapiens
  Payload ID: 12165
  Gene Symbol: PAK1
  Gene Name: p21 protein (Cdc42/Rac)-activated kinase 1
  ENST ID: ENST00000524847
  CDS Start-End: 263-559
tcatcccttccctcgcagttcccctgtcctgaggggagccccgccacgggcagcgcggcggcggcggcaggagggagaaagtgaagcggtagctcgcgcacactcgcgccctcactcccggctaggcggcacccaccgccgggaggaggaggaggagccgagaggagctgagcgagcgcggaagatgacatacccctcattcttcagagctcagtctcctgtcaagtctttcttcctttattagctgctgctggtggtgacaatgtcaaataacggcctagacattcaagacaaacccccagcccctccgatgagaaataccagcactatgattggagccggcagcaaagatgctggaaccctaaaccatggttctaaacctctgcctccaaacccagaggagaagaaaaagaaggaccgattttaccgatccattttacctggagataaaacaaataaaaagaaagagaaagagcggccagagatttctctcccttcagattttgaacacacaattcatgtcggttttgatgctgtcacaggggagtttacgggaatg

SEQ ID NO: 163234 - DNA, 581 bp, Homo sapiens
  Payload ID: 12165
  Gene Symbol: PAK1
  Gene Name: p21 protein (Cdc42/Rac)-activated kinase 1
  ENST ID: ENST00000528592
  CDS Start-End: 314-581
acctcgggagctggcggctgagctgccaggagcccagcccagctgaatcgagcggagccggtggagcaggggccttgtgggtacccggttgggcagggagaggtgcggctctgcgacggaaacaatcgccagagatgccggggctagccttccccaccaggatggatagaatggtgctatctgagctgttataatgttggcctcatgcctagctttatattgcagcacgtctgaggcattggtttttcatccttccaaacttttggtctacagagactattagaagattaagtagctgctgctggtggtgacaatgtcaaataacggcctagacattcaagacaaacccccagcccctccgatgagaaataccagcactatgattggagccggcagcaaagatgctggaaccctaaaccatggttctaaacctctgcctccaaacccagaggagaagaaaaagaaggaccgattttaccgatccattttacctggagataaaacaaataaaaagaaagagaaagagcggccagagatttctctcccttcagattttgaacacacaattcatgtcggttttg

SEQ ID NO: 163235 - DNA, 1878 bp, Homo sapiens
  Payload ID: 12165
  Gene Symbol: PAK1
  Gene Name: p21 protein (Cdc42/Rac)-activated kinase 1
  ENST ID: ENST00000528203
  CDS Start-End: 236-1603
gagcccagcccagctgaatcgagcggagccggtggagcaggggccttgtgggtacccggttgggcagggagaggtgcggctctgcgacggaaacaatcgccagagatgccggggctagccttccccaccagcaaataaaaagaaagagaaagagcggccagagatttctctcccttcagattttgaacacacaattcatgtcggttttgatgctgtcacaggggagtttacgggaatgccagagcagtgggcccgcttgcttcagacatcaaatatcactaagtcggagcagaagaaaaacccgcaggctgttctggatgtgttggagttttacaactcgaagaagacatccaacagccagaaatacatgagctttacagataagtcagctgaggattacaattcttctaatgccttgaatgtgaaggctgtgtctgagactcctgcagtgccaccagtttcagaagatgaggatgatgatgatgatgatgctaccccaccaccagtgattgctccacgcccagagcacacaaaatctgtatacacacggtctgtgattgaaccacttcctgtcactccaactcgggacgtggctacatctcccatttcacctactgaaaataacaccactccaccagatgctttgacccggaatactgagaagcagaagaagaagcctaaaatgtctgatgaggagatcttggagaaattacgaagcatagtgagtgtgggcgatcctaagaagaaatatacacggtttgagaagattggacaaggtgcttcaggcaccgtgtacacagcaatggatgtggccacaggacaggaggtggccattaagcagatgaatcttcagcagcagcccaagaaagagctgattattaatgagatcctggtcatgagggaaaacaagaacccaaacattgtgaattacttggacagttacctcgtgggagatgagctgtgggttgttatggaatacttggctggaggctccttgacagatgtggtgacagaaacttgcatggatgaaggccaaattgcagctgtgtgccgtgagtgtctgcaggctctggagttcttgcattcgaaccaggtcattcacagagacatcaagagtgacaatattctgttgggaatggatggctctgtcaagctaactgactttggattctgtgcacagataaccccagagcagagcaaacggagcaccatggtaggaaccccatactggatggcaccagaggttgtgacacgaaaggcctatgggcccaaggttgacatctggtccctgggcatcatggccatcgaaatgattgaaggggagcctccatacctcaatgaaaaccctctgagagccttgtacctcattgccaccaatgggaccccagaacttcagaacccagagaagctgtcagctatcttccgggactttctgaaccgctgtctcgagatggatgtggagaagagaggttcagctaaagagctgctacaggtgagaaaactgaggtttcaagtgtttagtaacttttccatgatagctgcatcaattcctgaagattgccaagcccctctccagcctcactccactgattgctgcagctaaggaggcaacaaagaacaatcactaaaaccacactcaccccagcctcattgtgccaagccttctgtgagataaatgcacatttcagaaattccaactcctgatgccctcttctccttgccttgcttctcccatttcctgatctagcactcctcaagactttgatccttggaaaccgtgtgtccagcattgaagagaactgcaactgaatgactaatcagatgatggccatttctaaataaggaatttcctcccaattcatggatatgagggtggtt

SEQ ID NO: 163236 - DNA, 3001 bp, Homo sapiens
  Payload ID: 12165
  Gene Symbol: PAK1
  Gene Name: p21 protein (Cdc42/Rac)-activated kinase 1
  ENST ID: ENST00000530617
  CDS Start-End: 313-1881
tgctttgcagaaaaggagaagcgcgcggcttcctcccgcctccttccctcctttcttcccccgccccttctgtttcgccaaccccgacgcggcgccttcgctgccgccctgcgagagcgcgagcgtgctgcacctcgggagctggcggctgagctgccaggagcccagcccagctgaatcgagcggagccggtggagcaggggccttgtgggtacccggttgggcagggagaggtgcggctctgcgacggaaacaatcgccagagatgccggggctagccttccccaccagtagctgctgctggtggtgacaatgtcaaataacggcctagacattcaagacaaacccccagcccctccgatgagaaataccagcactatgattggagccggcagcaaagatgctggaaccctaaaccatggttctaaacctctgcctccaaacccagaggagaagaaaaagaaggaccgattttaccgatccattttacctggagataaaacaaataaaaagaaagagaaagagcggccagagatttctctcccttcagattttgaacacacaattcatgtcggttttgatgctgtcacaggggagtttacgggaatgccagagcagtgggcccgcttgcttcagacatcaaatatcactaagtcggagcagaagaaaaacccgcaggctgttctggatgtgttggagttttacaactcgaagaagacatccaacagccagaaatacatgagctttacagataagtcagctgaggattacaattcttctaatgccttgaatgtgaaggctgtgtctgagactcctgcagtgccaccagtttcagaagatgaggatgatgatgatgatgatgctaccccaccaccagtgattgctccacgcccagagcacacaaaatctgtatacacacggtctgtgattgaaccacttcctgtcactccaactcgggacgtggctacatctcccatttcacctactgaaaataacaccactccaccagatgctttgacccggaatactgagaagcagaagaagaagcctaaaatgtctgatgaggagatcttggagaaattacgaagcatagtgagtgtgggcgatcctaagaagaaatatacacggtttgagaagattggacaaggtgcttcaggcaccgtgtacacagcaatggatgtggccacaggacaggaggtggccattaagcagatgaatcttcagcagcagcccaagaaagagctgattattaatgagatcctggtcatgagggaaaacaagaacccaaacattgtgaattacttggacagttacctcgtgggagatgagctgtgggttgttatggaatacttggctggaggctccttgacagatgtggtgacagaaacttgcatggatgaaggccaaattgcagctgtgtgccgtgagtgtctgcaggctctggagttcttgcattcgaaccaggtcattcacagagacatcaagagtgacaatattctgttgggaatggatggctctgtcaagctaactgactttggattctgtgcacagataaccccagagcagagcaaacggagcaccatggtaggaaccccatactggatggcaccagaggttgtgacacgaaaggcctatgggcccaaggttgacatctggtccctgggcatcatggccatcgaaatgattgaaggggagcctccatacctcaatgaaaaccctctgagagccttgtacctcattgccaccaatgggaccccagaacttcagaacccagagaagctgtcagctatcttccgggactttctgaaccgctgtctcgagatggatgtggagaagagaggttcagctaaagagctgctacagcactcctcaagactttgatccttggaaaccgtgtgtccagcattgaagagaactgcaactgaatgactaatcagatgatggccatttctaaataaggaatttcctcccaattcatggatatgagggtggtttatgattaagggtttatataaataaatgtttctagtcttccgtgtgtcaaaatcctcacctccttcataaccatctcccacaattaattcttgactatataaatttatggtttgataatattatcaatttgtaatcaattgagatttctttagtgcttgcttttctgtgactcaactgcccagacacctcattgtacttgaaaactggaacagcttgggaatgccatggggtttgataatctgccagggacatgaagaggctcagcttcctggaccatgactttggctcagctgatcctgacatgggagaacaaccacatttttctttgtgtgtgcttctagcagctgttcgggaggaccttgacccaatagtgttcccatgctgtttcttgtgaaatgctctcggctatgtagcagcttttgattccctgcataccctaggctgctgcccctatcctgtcccttgtttataacattgagaggttttctagggcacatactgagtgagagcagtgttgagaagtcggggaaaatggtgactacttttagagcaaggctgggcatcagcacctgtccagctctacttgtgtgatgtttcaggaactcagcccctttttctgcctaggataaggagctgaaagattaacttggatcttctaatggtccaaatcttttggtcacaataaagagtctccaaattagagactgcatgttagttctggatggatttggtggcctgacatgataccctgccagctgtgaggggaccccgtttttaagatgcatggccaagctctctgcaaatggaaatgcttacactgggtgttggggatgtttgctacctcctgctatttttgtggttttggttctcccactatggtaggacccctggccagcattgtggcttgtcatgtcagccccattgactaccttctcatgctctgaggtactactgcctctgcagcacaaatttctatttctgtcaataaaaggagatgaaaatattc

SEQ ID NO: 163237 - DNA, 576 bp, Homo sapiens
  Payload ID: 12165
  Gene Symbol: PAK1
  Gene Name: p21 protein (Cdc42/Rac)-activated kinase 1
  ENST ID: ENST00000529248
  CDS Start-End: 257-574
gagcgtgctgcacctcgggagctggcggctgagctgccaggagcccagcccagctgaatcgagcggagccggtggagcaggggccttgtgggtacccggttgggcagggagaggtgcggctctgcgacggaaacaatcgccagagatgccggggctagccttccccaccagcacgtctgaggcattggtttttcatccttccaaacttttggtctacagagactattagaagattaagctgctgctggtggtgacaatgtcaaataacggcctagacattcaagacaaacccccagcccctccgatgagaaataccagcactatgattggagccggcagcaaagatgctggaaccctaaaccatggttctaaacctctgcctccaaacccagaggagaagaaaaagaaggaccgattttaccgatccattttacctggagataaaacaaataaaaagaaagagaaagagcggccagagatttctctcccttcagattttgaacacacaattcatgtcggttttgatgctgtcacaggggagtttacgggaatgccagagcagtgggcccgcttgct

SEQ ID NO: 163238 - DNA, 502 bp, Homo sapiens
  Payload ID: 12165
  Gene Symbol: PAK1
  Gene Name: p21 protein (Cdc42/Rac)-activated kinase 1
  ENST ID: ENST00000526968
  CDS Start-End: 425-502
acacgacatcggatagttttcaaattcagcccttgacaacgagctcatagatgcggtggtgctttgttaacctgaaaaggaccctcagcgccggaagttagccgtctttctccatcctgactactacagtagccctcccagaaatcgtcccaaaattgtctgatagaaaggctgcacggaaacaacccgccacggacagcggaccgagaacagtgacgcgacgcgatgacgtcacgcagcaagcgggtgattccccagcctctggcgtcacgcgccgatgacgtaatcccaggcgttcgccctcatgcgggccagggtttggcctcgctcccacggcacgtctgaggcattggtttttcatccttccaaacttttggtctacagagactattagaagattaagtagctgctgctggtggtgacaatgtcaaataacggcctagacattcaagacaaacccccagcccctccgatgagaaataccagcactatgattggagcc

SEQ ID NO: 163239 - DNA, 450 bp, Homo sapiens
  Payload ID: 12165
  Gene Symbol: PAK1
  Gene Name: p21 protein (Cdc42/Rac)-activated kinase 1
  ENST ID: ENST00000528633
  CDS Start-End: 261-450
acctcgggagctggcggctgagctgccaggagcccagcccagctgaatcgagcggagccggtggagcaggggccttgtgggtacccggttgggcagggagaggtgcggctctgcgacggaaacaatcgccagagatgccggggctagccttccccaccaggttggtggcgatacaaaaattgaaactggcctcagttgttgctctcaaatgcagatcaaggaatgtggacgctcatgtgtagctgctgctggtggtgacaatgtcaaataacggcctagacattcaagacaaacccccagcccctccgatgagaaataccagcactatgattggagccggcagcaaagatgctggaaccctaaaccatggttctaaacctctgcctccaaacccagaggagaagaaaaagaaggaccgattttaccgatccattttacctggagataaaa

SEQ ID NO: 163240 - DNA, 576 bp, Homo sapiens
  Payload ID: 12165
  Gene Symbol: PAK1
  Gene Name: p21 protein (Cdc42/Rac)-activated kinase 1
  ENST ID: ENST00000527535
  CDS Start-End: 1-57
aaatctttattggagtccatgggatgctctcagtctttgtggccattaagcagatgaatcttcagcagcagcccaagaaagagctgattattaatgagatcctggtcatgagggaaaacaagaacccaaacattgtgaattacttggacagttacctcgtgggagatgagctgtgggttgttatggaatacttggctggaggctccttgacagatgtggtgacagaaacttgcatggatgaaggccaaattgcagctgtgtgccgtgagtgtctgcaggctctggagttcttgcattcgaaccaggtcattcacagagacatcaagagtgacaatattctgttgggaatggatggctctgtcaagctaactgactttggattctgtgcacagataaccccagagcagagcaaacggagcaccatggtaggaaccccatactggatggcaccagaggttgtgacacgaaaggcctatgggcccaaggttgacatctggtccctgggcatcatggccatcgaaatgattgaaggggagcctccatacctcaatgaaaaccctctgagagccttgtacc

SEQ ID NO: 163241 - DNA, 6139 bp, Homo sapiens
  Payload ID: 12166
  Gene Symbol: PAK2
  Gene Name: p21 protein (Cdc42/Rac)-activated kinase 2
  Uniprot ID: Q13177
  ENST ID: ENST00000327134
  CDS Start-End: 323-1897
gtcttcctcccccagggttgtggccacgcgcagcggcggcggttgttccgcttcccctccggcccgggccgtcgccattgccgaaggctccctcccctcccctccctggcgtgcgcaggactccgccgccgctgggcctagcggtagcagcggctgctccagcgcggcgtctcttcccgccccgcttccccttccctcccctcccctccccgcaccgcgcgctagcccggggcggctccgcagcccgccgggagctctgaccgaggcgcctcgctggggcggggaccttgccttgcccggggccatttcataattctgaatcatgtctgataacggagaactggaagataagcctccagcacctcctgtgcgaatgagcagcaccatctttagcactggaggcaaagaccctttgtcagccaatcacagtttgaaacctttgccctctgttccagaagagaaaaagcccaggcataaaatcatctccatattctcaggcacagagaaaggaagtaaaaagaaagaaaaggaacggccagaaatttctcctccatctgattttgagcacaccatccatgttggctttgatgctgttactggagaattcactggcatgccagaacagtgggctcgattactacagacctccaatatcaccaaactagagcaaaagaagaatcctcaggctgtgctggatgtcctaaagttctacgactccaacacagtgaagcagaaatatctgagctttactcctcctgagaaagatggctttccttctggaacaccagcactgaatgccaagggaacagaagcacccgcagtagtgacagaggaggaggatgatgatgaagagactgctcctcccgttattgccccgcgaccggatcatacgaaatcaatttacacacggtctgtaattgaccctgttcctgcaccagttggtgattcacatgttgatggtgctgccaagtctttagacaaacagaaaaagaagactaagatgacagatgaagagattatggagaaattaagaactatcgtgagcataggtgaccctaagaaaaaatatacaagatatgaaaaaattggacaaggggcttctggtacagttttcactgctactgacgttgcactgggacaggaggttgctatcaaacaaattaatttacagaaacagccaaagaaggaactgatcattaacgagattctggtgatgaaagaattgaaaaatcccaacatcgttaactttttggacagttacctggtaggagatgaattgtttgtggtcatggaataccttgctggggggtcactcactgatgtggtaacagaaacgtgcatggatgaagcacagattgctgctgtatgcagagagtgtttacaggcattggagtttttacatgctaatcaagtgatccacagagacatcaaaagtgacaatgtacttttgggaatggaaggatctgttaagctcactgactttggtttctgtgcccagatcacccctgagcagagcaaacgcagtaccatggtcggaacgccatactggatggcaccagaggtggttacacggaaagcttatggccctaaagtcgacatatggtctctgggtatcatggctattgagatggtagaaggagagcctccatacctcaatgaaaatcccttgagggccttgtacctaatagcaactaatggaaccccagaacttcagaatccagagaaactttccccaatatttcgggatttcttaaatcgatgtttggaaatggatgtggaaaaaaggggttcagccaaagaattattacagcatcctttcctgaaactggccaaaccgttatctagcttgacaccactgatcatggcagctaaagaagcaatgaagagtaaccgttaacatcactgctgtggcctcatactcttttttccattttctacaagaagccttttagtatatgaaaattattactctttttggggtttaaagaaatggtctgcataacctgaatgaaagaagcaaatgactattctctgaagacaaccaagagaaaattgcaaaaagacaagtatgacttttatatgaaccccttctttagggtccagaaggaattgtggactgaatcactagccttaggtctttcagcaaacagcctatcagggccatttatcatgtgtgagatttgcattttactttgctgactttgttgtaatagatcccattcattgtcccctttggggtatttccaatacttgaatggcagattggagtttttcagagtatgtgtttcatctgctagtctttctctccttcatagcttttcttttcctggacttgctccttttgagttgcttttgcgtttctcatgcctaggcaagtgtaatagaaattatgtagctccttatgttggcaaaggagctctatatagtttcactttgtataaaagttaggaccagctgttgttacatgtaatattttagttcagaacttgacctgaaggaagggaagaaaagtatgtgatttttaccttttttaacaaatgtgaaaaagtcagttttagaaatttcgtggtagtaagttcggcatttgttacatgtatagagagaagactaataatctctatttataactaaatcattgagatagaaaaagattcccattgactgtagacttcttcccattttgtcttcccttctgcctgtttccccttcaggcttggctctaggaaccaaagtgatttgttgttgttccaacctgggctttgtgactttggttagtgccactaccttcttccctcctttcccccttcaatttggaaataaatttctgtatatgttgcaattttaggtttaggtttgttctttttctttttcattaatcctctctcacctcacagataccccctcccatggcaaataatataataaccagtgaattttcaggaatttaaaaattagcttttttccacttaaaggagaaaaatatttgggactagcagcagaggcagtaagagatgtgaaccttggtgagctctgatacagtgagaagagattatactcatgaaagagaatgttagtgttacagagaagcagccgatagcaaatcgactgtagagacttggcggcggtggcattgccccaggtcgtcagcagtgtggtattatctatgagaacttgagcgacagagtatttcttgatgaatttatagatcatttgagatgttgagttactttagtttagttttgttttgttttttcaaataagtagagactattgtaaaaaacgagaaaggaaaatgaaatgtgcgtgttgatagcaataatttgtttcttttaaagattctaaaaggtctgagacctgtagcattaattatttgagtgccctcccttctcccctcccctcccttttctcttctcttttttcctctcctcttcttctcctttattcattgttttgcttttggagtgggtgttgttcaagtatctgtggtttggttctggcattttgttcccaccatccccttcccccattaacttcccccctgcttgccatcctgcagtagtataaatcatgaataaaaaataattttgctgttgtagtatacattggagaaactggcaggttttatttccattattttatttccactatatctatgataagatgcaattataaggagagaagtgactgttttttattgataaggcaagattttcagaaaaatgagtaaaataattaatgaaacatatttagagcacttaatggtctctgttttcaatataattcttgatttcatttttctctggaatatattggccttctacagctattactgaattatagaaactggtttatttctggcagaaagctgcagtgccacctgagttccaaattttaccattctttgtaaacagttggatggattatgataaagaagatgctaccaatgaaatagaaaaccaacgagatgagaagactgtgatcctcatgtactcagaggcacttccctcctaagtcaaagaccatcctcactgactatgtgccaacgcctcgtttcaggcttgtgactcaacaaagggcttttccattgatagaagcagtttgggatttgtagttgcgacttcttcgatagttacctgcacgtccattgctggcaactgacttgtcattaaaacctggctctttggttaagggagctacgctgtggtttattcttaagttacgtggataaactaacctctaacagaaatatactttggttaattttgaaatgtgtcatttttaaacaatcttaaaagtaatacagaattgtgatttattaattttaaaacattcagaacttgttgaaagaaaaattatatctgaatcaagattcatgttttttatttttattttttttgatacagagtctcactctgtcactcaggctggagtgcagtgacatgatctcagctcactgcaacctccgcttcctgggttcaagcaattctcatgcctcagcctcctgagtagctgagaccacaggcacccgccaccacacccagctatttttttgtatttttagtagagacagagtctcaccacattgcccaggctggtctccaactcctgagctcaggcagtctgcccaccttggcctcccaaagtgctgcagttacaggcgtgagccactgcacctggcctcatgttttttaaataattgccttttatatttaccctttttgtcatcactttagaatgaaaattcccatttaaatctgaaagttaccttaatagtcctcttgtgttattaggacagtattattatagtacttatttattttattttagatttaaagttatcttctctttttcttttttcttctgctgcttttagggacaattaaaactgggaaactatgaaacatggaacattttatcctacctgaaagtaaacgagtaattgtgaagcataagacactgaggctaatacaactctgtcttcatgtgttgactgcctggcacatagtattcattctcttccctttaacatagaagtgtccagctgcgtacagtctagtaaccagcaactgtaaacgaacctgtgcctctaacaagcgattctaaaccacctatgagtatttcttttagggctcacttaaatacatgtttgtatatactgtattctagccagaataattttagatctgatcaggtagtagctaaaattagaaaaaaacaaaatagatgcttaaagaatttgcatccatttttgagtctaaatcttttaaaatatactgagatccacatctagtgaaatgtcagtgtcaaaatattatagattatagctaaaatccagattaatactcatttggggttttttatagtggaacttcatagtaatacaaaaagcagattgtcttcctgtctccgctgctcccacagtaggtattgaaactggtaaaatcagttttttgatagtgtgtgtatataagaaaaaatagatacacacattcttttttctcagtcaacacattgattgaacactctggcaaagatgctgtggtggatgaggttggagttcgaaagaagaagcaagcgctggcctggccttgaaagaaccgaagtctttcccattcacttctctagaaagctgccaagacagaggcagaaagaaatggatgatagttctgtcaagcacacttctgttctcttagaacttagaagtgtttctaagagaacagaagtaataagagaaacagttacgtgtggaattcaacatctttggttggaacgcattggctttttttttcttgttttgatagaaatggaattaagcaaaagtagtttttgtcttttctgttgtcttcaaattttatgccttttatttttaatttaatcccgttcaattatttaattgttatacattgacattaactgctgtattttgactttgttcaataattttgttctttcagggctagaaataaactttttaaaaaaagtgtgcatttttccctttcctaaacttttattctttcttttgatcagcgtaaaagaatattttaatgtcttttgatagcataaaagaatatttaaatgtcttaataggttttcaaagaacatttagtatttttagtgataaatgttttaaaccttttaa

SEQ ID NO: 163242 - DNA, 689 bp, Homo sapiens
  Payload ID: 12166
  Gene Symbol: PAK2
  Gene Name: p21 protein (Cdc42/Rac)-activated kinase 2
  ENST ID: ENST00000426668
  CDS Start-End: 1-665
gggcttctggtacagttttcactgctactgacgttgcactgggacaggaggttgctatcaaacaaattaatttacagaaacagccaaagaaggaactgatcattaacgagattctggtgatgaaagaattgaaaaatcccaacatcgttaactttttggacagttacctggtaggagatgaattgtttgtggtcatggaataccttgctggggggtcactcactgatgtggtaacagaaacgtgcatggatgaagcacagattgctgctgtatgcagagagtgtttacaggcattggagtttttacatgctaatcaagtgatccacagagacatcaaaagtgacaatgtacttttgggaatggaaggatctgttaagctcactgactttggtttctgtgcccagatcacccctgagcagagcaaacgcagtaccatggtcggaacgccatactggatggcaccagaggtggttacacggaaagcttatggccctaaagtcgacatatggtctctgggtatcatggctattgagatggtagaaggagagcctccatacctcaatgaaaatcccttgaggcatcctttcctgaaactggccaaaccgttatctagcttgacaccactgatcatggcagctaaagaagcaatgaagagtaaccgttaacatcactgctgtggcctcatactc

SEQ ID NO: 163243 - DNA, 2178 bp, Homo sapiens
  Payload ID: 12167
  Gene Symbol: PAK3
  Gene Name: p21 protein (Cdc42/Rac)-activated kinase 3
  Uniprot ID: O75914
  ENST ID: ENST00000262836
  CDS Start-End: 28-1707
gagctgtgaaattagttgtaactgaaaatgtctgacggtctggataatgaagagaaacccccggctcctccactgaggatgaatagtaacaaccgggattcttcagcactcaaccacagctccaaaccacttcccatggcccctgaagagaagaataagaaagccaggcttcgctctatcttcccaggaggaggggataaaaccaataagaagaaggagaaagagcgcccagagatctctcttccttcagactttgagcatacgattcatgtggggtttgatgcagtcaccggggaattcactccagatctctatggctcacagatgtgcccagggaagctcccagagggaattccagagcaatgggcacgattactccaaacttccaacataacaaaattggaacagaagaagaacccacaagctgttctagatgttctcaaattctatgattccaaagaaacagtcaacaaccagaaatacatgagctttacatcaggagataaaagtgcacatggatacatagcagcccatccttcgagtacaaaaacagcatctgagcctccattggcccctcctgtgtctgaagaagaagatgaagaggaagaagaagaagaagatgaaaatgagccaccaccagttatcgcaccaagaccagagcatacaaaatcaatctatactcgttctgtggttgaatccattgcttcaccagcagtaccaaataaagaggtcacaccaccctctgctgaaaatgccaattccagtactttgtacaggaacacagatcggcaaagaaaaaaatccaagatgacagatgaggagatcttagagaagctaagaagcattgtgagtgttggggacccaaagaaaaaatacacaagatttgaaaaaattggtcaaggggcatcaggtactgtttatacagcactagacattgcaacaggacaagaggtggccataaagcagatgaaccttcaacagcaacccaagaaggaattaattattaatgaaattctggtcatgagggaaaataagaaccctaatattgttaattatttagatagctacttggtgggtgatgaactatgggtagtcatggaatacttggctggtggctctctgactgatgtggtcacagagacctgtatggatgaaggacagatagcagctgtctgcagagagtgcctgcaagctttggatttcctgcactcaaaccaggtgatccatagagatataaagagtgacaatattcttctcgggatggatggctctgttaaattgactgactttgggttctgtgcccagatcactcctgagcaaagtaaacgaagcactatggtgggaaccccatattggatggcacctgaggtggtgactcgaaaagcttatggtccgaaagttgatatctggtctcttggaattatggcaattgaaatggtggaaggtgaacccccttaccttaatgaaaatccactcagggcattgtatctgatagccactaatggaactccagagctccagaatcctgagagactgtcagctgtattccgtgactttttaaatcgctgtcttgagatggatgtggataggcgaggatctgccaaggagcttttgcagcatccatttttaaaattagccaagcctctctccagcctgactcctctgattatcgctgcaaaggaagcaattaagaacagcagccgctaagactgcaagccttacacctcaccatctccctcatgagtaagactgaaataaaactctgctgcaggaaagatggaagaaaagacagtcaaatggggtgggggttctttacctttcaaatgaatagaaacttcttataagcctttttcctactccctcagattatgtaatttatttgtaagcctgaatcgcagcccaaacagggcagcaatgttgaagtgaccataaagtggtcacttccaccgtgaagcgaaagagccagtagtgaatcccctcattttgtgcattcactttgaagaaaaaggtttctcaaagatgcacactccctcttcatagtgttgtgtttgtttttaagttagagagtagtccctcttgcattcaaacctccttcaaaactccttacccaatgtgatgtttttcacttgcattgtcattagatgtccagaaaaaaaaaagatgtcaaaatgtttttct

SEQ ID NO: 163244 - DNA, 2241 bp, Homo sapiens
  Payload ID: 12167
  Gene Symbol: PAK3
  Gene Name: p21 protein (Cdc42/Rac)-activated kinase 3
  Uniprot ID: O75914
  ENST ID: ENST00000360648
  CDS Start-End: 28-1770
gagctgtgaaattagttgtaactgaaaatgtctgacggtctggataatgaagagaaacccccggctcctccactgaggatgaatagtaacaaccgggattcttcagcactcaaccacagctccaaaccacttcccatggcccctgaagagaagaataagaaagccaggcttcgctctatcttcccaggaggaggggataaaaccaataagaagaaggagaaagagcgcccagagatctctcttccttcagactttgagcatacgattcatgtggggtttgatgcagtcaccggggaattcactaactcccctttccagacctctagacctgtgacggtcgcttcaagtcaatcagagggaaaaatgccagatctctatggctcacagatgtgcccagggaagctcccagagggaattccagagcaatgggcacgattactccaaacttccaacataacaaaattggaacagaagaagaacccacaagctgttctagatgttctcaaattctatgattccaaagaaacagtcaacaaccagaaatacatgagctttacatcaggagataaaagtgcacatggatacatagcagcccatccttcgagtacaaaaacagcatctgagcctccattggcccctcctgtgtctgaagaagaagatgaagaggaagaagaagaagaagatgaaaatgagccaccaccagttatcgcaccaagaccagagcatacaaaatcaatctatactcgttctgtggttgaatccattgcttcaccagcagtaccaaataaagaggtcacaccaccctctgctgaaaatgccaattccagtactttgtacaggaacacagatcggcaaagaaaaaaatccaagatgacagatgaggagatcttagagaagctaagaagcattgtgagtgttggggacccaaagaaaaaatacacaagatttgaaaaaattggtcaaggggcatcaggtactgtttatacagcactagacattgcaacaggacaagaggtggccataaagcagatgaaccttcaacagcaacccaagaaggaattaattattaatgaaattctggtcatgagggaaaataagaaccctaatattgttaattatttagatagctacttggtgggtgatgaactatgggtagtcatggaatacttggctggtggctctctgactgatgtggtcacagagacctgtatggatgaaggacagatagcagctgtctgcagagagtgcctgcaagctttggatttcctgcactcaaaccaggtgatccatagagatataaagagtgacaatattcttctcgggatggatggctctgttaaattgactgactttgggttctgtgcccagatcactcctgagcaaagtaaacgaagcactatggtgggaaccccatattggatggcacctgaggtggtgactcgaaaagcttatggtccgaaagttgatatctggtctcttggaattatggcaattgaaatggtggaaggtgaacccccttaccttaatgaaaatccactcagggcattgtatctgatagccactaatggaactccagagctccagaatcctgagagactgtcagctgtattccgtgactttttaaatcgctgtcttgagatggatgtggataggcgaggatctgccaaggagcttttgcagcatccatttttaaaattagccaagcctctctccagcctgactcctctgattatcgctgcaaaggaagcaattaagaacagcagccgctaagactgcaagccttacacctcaccatctccctcatgagtaagactgaaataaaactctgctgcaggaaagatggaagaaaagacagtcaaatggggtgggggttctttacctttcaaatgaatagaaacttcttataagcctttttcctactccctcagattatgtaatttatttgtaagcctgaatcgcagcccaaacagggcagcaatgttgaagtgaccataaagtggtcacttccaccgtgaagcgaaagagccagtagtgaatcccctcattttgtgcattcactttgaagaaaaaggtttctcaaagatgcacactccctcttcatagtgttgtgtttgtttttaagttagagagtagtccctcttgcattcaaacctccttcaaaactccttacccaatgtgatgtttttcacttgcattgtcattagatgtccagaaaaaaaaaagatgtcaaaatgtttttct

SEQ ID NO: 163245 - DNA, 8940 bp, Homo sapiens
  Payload ID: 12167
  Gene Symbol: PAK3
  Gene Name: p21 protein (Cdc42/Rac)-activated kinase 3
  Uniprot ID: O75914
  ENST ID: ENST00000372007
  CDS Start-End: 392-2026
agaggaaaggtcttgacggggtggctggatccgtggcagaatccagttccagattctagacttgagggttctgggctgttggtctgtagaagcgaaggagagaaggactcaaatccaggccaagtgtatggctgtctgaggtattggaacagaaggaggtccattcctgttggtgacaacaccgtggccctgttctgggatgagcaaggtgtaaaggtttcccccaagaaagagcagctgagtccttgcatcttgtggcagctggtgtgcccagcactgagtctgtaggagctgaagccagcccggacccttctcatgggcagtgcccacctgtgctgaagtcctgcagcggtggcggtgtgaggagctgtgaaattagttgtaactgaaaatgtctgacggtctggataatgaagagaaacccccggctcctccactgaggatgaatagtaacaaccgggattcttcagcactcaaccacagctccaaaccacttcccatggcccctgaagagaagaataagaaagccaggcttcgctctatcttcccaggaggaggggataaaaccaataagaagaaggagaaagagcgcccagagatctctcttccttcagactttgagcatacgattcatgtggggtttgatgcagtcaccggggaattcactggaattccagagcaatgggcacgattactccaaacttccaacataacaaaattggaacagaagaagaacccacaagctgttctagatgttctcaaattctatgattccaaagaaacagtcaacaaccagaaatacatgagctttacatcaggagataaaagtgcacatggatacatagcagcccatccttcgagtacaaaaacagcatctgagcctccattggcccctcctgtgtctgaagaagaagatgaagaggaagaagaagaagaagatgaaaatgagccaccaccagttatcgcaccaagaccagagcatacaaaatcaatctatactcgttctgtggttgaatccattgcttcaccagcagtaccaaataaagaggtcacaccaccctctgctgaaaatgccaattccagtactttgtacaggaacacagatcggcaaagaaaaaaatccaagatgacagatgaggagatcttagagaagctaagaagcattgtgagtgttggggacccaaagaaaaaatacacaagatttgaaaaaattggtcaaggggcatcaggtactgtttatacagcactagacattgcaacaggacaagaggtggccataaagcagatgaaccttcaacagcaacccaagaaggaattaattattaatgaaattctggtcatgagggaaaataagaaccctaatattgttaattatttagatagctacttggtgggtgatgaactatgggtagtcatggaatacttggctggtggctctctgactgatgtggtcacagagacctgtatggatgaaggacagatagcagctgtctgcagagagtgcctgcaagctttggatttcctgcactcaaaccaggtgatccatagagatataaagagtgacaatattcttctcgggatggatggctctgttaaattgactgactttgggttctgtgcccagatcactcctgagcaaagtaaacgaagcactatggtgggaaccccatattggatggcacctgaggtggtgactcgaaaagcttatggtccgaaagttgatatctggtctcttggaattatggcaattgaaatggtggaaggtgaacccccttaccttaatgaaaatccactcagggcattgtatctgatagccactaatggaactccagagctccagaatcctgagagactgtcagctgtattccgtgactttttaaatcgctgtcttgagatggatgtggataggcgaggatctgccaaggagcttttgcagcatccatttttaaaattagccaagcctctctccagcctgactcctctgattatcgctgcaaaggaagcaattaagaacagcagccgctaagactgcaagccttacacctcaccatctccctcatgagtaagactgaaataaaactctgctgcaggaaagatggaagaaaagacagtcaaatggggtgggggttctttacctttcaaatgaatagaaacttcttataagcctttttcctactccctcagattatgtaatttatttgtaagcctgaatcgcagcccaaacagggcagcaatgttgaagtgaccataaagtggtcacttccaccgtgaagcgaaagagccagtagtgaatcccctcattttgtgcattcactttgaagaaaaaggtttctcaaagatgcacactccctcttcatagtgttgtgtttgtttttaagttagagagtagtccctcttgcattcaaacctccttcaaaactccttacccaatgtgatgtttttcacttgcattgtcattagatgtccagaaaaaaaaaagatgtcaaaatgtttttctaaaaaaagaaagcaaaaaaagcaaggcaaaaaaaaaaaaaaaaacaaacaaaaacaaaaacaaaacaaaaacaagcaaacaaaaaataccagagcaagtactgtgtgaacatgtggaagtccatgccctaatagagttgcaattttttattcttcttctatagtggtggcttggtttgtgtacctatttttctgcatttgtattggaaaaggtttcttttaagacattttccaaaagtggagaggaatatgtgtgttcaggaagggctttcaaaaaactgtatatctaaataaagctcaaacggtgaaatcctgtcacattttcacaatgatgcttaaaagataattgagtaaaccaggttgttaatctccttaatacctgaaagaggacacactgaaactgaaactgtgacatcctgctaggtgagttcaggttctgaacctaggaaatcctcataggagaaaccacatttaaacaaagatgggactttctctgagagccaaaaccagataaatgtagaatactgaaatccttgttggacattaagtaaacaaagataatgatacctaaattaatcctctcttgtgcttatgaaacatatgcactgtaaaataggcataccaggaggaaatagatacattaatcatcatttacttatgatacaaattatttattttgacaatttataacgtttaaaaaagttttttaaagatctagagaaaggtgatatagtaaacattcaactctgtaagaaatgggaggtcagtgaaggctacatcccaatcaatatttggctctaagtacctcttcccatttttcctatgtatcacctatttctgtttcggaatatggtgtgttcatgcttagttctttgggcttttgaatatcaaaagcatattcataaatgtcttgaaattctctccagtggaaaataattttaacttacaatcatatcccaagaaatgtcagtccgacagaattccttatatgacttggggaaaataacaaaatttgactactatttcaccatatatctatttattaaaaaattcaacagttggcacttcctgaatcttctgagagtagaaaaatatctgcggagtgtctgtgtagaaaaggatatgcctctcttttgagtgtattgacaattttgtaaattacagaaagttgtttctctaagcctttgaaaaactaacaatttgtgttatagaaggcttcttaatttgcagtataaaagaatctaaacagaacttatgtacattcagccagaaggggaaagagatcagttacataggcctctctccttctttgccaaggtacatccatccatctaaccatccatatatccacatcttaaaatgaaagcactttctttagagtttcagcaaactatatagtgtacgtgtttatgttcaggagatgaccccactggtgtatttcctattttccctattgttttctttgactgtaaaagttgggagaggcttgacctcctccccttgaaaatgtccacagtgggataaaacaacaaatgtgaaaagaaaatgaaacggtaatattaatttgaagcatactatgttatactttgcaaaaacgaatctgggcctgtaatttttaatgccacactgctctaatgagagagagaggccttaattttgatttcatttaaaaataagtactttaaaaaatttttcactcatagtgccgggaaattcaatgaaatcctgggatgcaaataaaaatcagtacattagtgactgtgtcctgccagtggagagagcccaatacctggttaggaagccctattcattagttagcatcccttacatgttgagaaggccttttttttgttgttattttggagaccttggagcagtgacccttcagatcactgtaggcagagaaatggcttctctcttatgctttcagttcagcatattaacaatgaggagccaggtacttctttactaccactttgtaccaagatttgataataatatatcccaggaggcattacttttataaatttgtattcatgtaaattttcaaatgagaacagcttctaaagccccttccctgtattggagagttatgtatatttctaataagtattagaaagaagctgtttctcatgccacagtgatgctgaaggattcacatttggtacaatcgagtaacttgaacgccagattgttaacagtttattctctttccctggatttttaagctcatcttgacacaggtgagtctatccaaatctttgatgttgctagtgtgccctgagataacgagggcacatctttcaatgttgattccaaaatgtcctgagttaggaatagggcagtgggaaagtcagggaagggtgagaagcacagtagagattatttatttaaaaaaggaaagaacgttaatgttgttagcaaggatccagtgcgttgtcataatcccatgaggattttcagatgacacaatcccctcaaatcagtcaccatgttgggtaatgacttcgttcttgctgatctcgtgtgtgtgtcattgtaaatatttgtgtgtccatgttccattttggctactggatggccaagccatgtaagaagatttaactcaagtatttattctttatgttattcagatttctttcaggcttgtgaactgcaccccaatgtttgagtttaaccacctgatccttacatctatccctccccggtgaagcacattccattgctaaaagaaaaagaaacacgaaattgcttcctgttgtctgtataactgttttgatagtttgagatatttgtctataaatgatatttctcagctcaaagatcgtgtaaataattatattcctttgctcaatgggtttatttctaatgaggctgccagttctgagagattctataatatcacttttaaataacataaacagggattacaactatgtaaaaagaaatgcatatggacaaagactgggaacacagataattgaaatcagttgtgttagggtggtggaattatgtgaatttttttttctttttaaaattttatttgatattgttataatattgctttacaataaataaacagcagaaagggaactatagacacatagaaaagatgccagaagcagatgccttctggccagagcgcagagcatgcagggcagagatatttgctagttacaattattccataggctttatgcttgcctgggtgctgaggttggcacacgctcgggtatggcacacgctttcttaggagactattatctataagttaaagctagggagatgtcactattagaactccaaacacactcttctgctttaaaacaggttgtctgccctctgctttggtatggcattcgggtgtctgttttgtggttgctttagattggaggggtgaccattttattagcccccttgataacatctgttgcagatattgcctttctggaacgttttaacagactctcaggttgaattttggaggactagaaggataaaatccccagctcccaccattttcttgtccaacaggatattactgtatatcattcaggtaggattcttcttttaataaccaatagggcaagtcccactaatttcaatagaagttatgacttgcaattaaaagctgactttgaaatcattaaacaaatatgtaggactgtctctgcctgttggcattcagttatagttctgttaattttggcttgggatggtctccatgtgcttttttctgcctatttataggttgtttgcagtagttgtgatttttaaagagcaagggagaccatctaaccaaaggataacttccttctaactcaccaaagaaattttaggtgagaactttaataatgaggtagtcacctcagatatgctgcttagtttcactaaaagcagaccctatacctagagaagtcactggctttttattggtcattctcaatacagaaatacttaggggagtcttaaccctgccatccccggttgaatctcttggtctttatctaagctacttgcagttaatattcagttaagcaaaggtatggccagtagtgcaagtatctcccagtctctgagctctgaacaagaggactgaaattcagcatttgtaaactgacagtttgatgggcctgggatttgaagtgaactcagcacacaattctgaacgtgtatttgcatgtggactgggaaggaaataaatgggaacttggaaataatggaatatttctcctatgaaagaatttttcgtagaagatttgtttttgatataatctttctgttggttagcttttagtgttttcattccttttctgatccacactcctttaagtgaccaaatgaatataacccaacatgcattgggaatgtgtttaatattaaacaatgtctaactgaatctgcaaatgcgggaactgagatatcacctccatgtgcacacctgtgtgtacgagtattctatacaacttgtagcatttactgccacttaattgggttgaacttgcaagataaacttttggaaactgcttagtgccatcggagtctcctttagaagctgccatcaggcaaatgctatcccataataccagcagtaagcctggcaacatgttcaacagatttagtacccaagaggaaatcaacagcgatagtagagaatgagtcagatgtagtgggataaatactagcctaggaagaaggagccccggagtctaatatgagctttattactaaattgctatgtgacgctaggcaagtcacttaacctctccatggctgtttcctcatctgtaaaataagtgtattggactagatgatccttagggtctttccaaaagtctaacattctatggcattataggttgccttgcaaattcagcctgctatagtgatggcaaatatcacgtttaagcctgagtctcttatgttgcagttaaataaaagaactatgtaagatgatttttaaaattcaagcaaatgggccgggtgcggtggctcatacctgtaatcccagcactttgggaggccaaggcaggcggatcacctgaggtcaggagttcgagaccagcctgaccaacatagagaaaccccatctctactaaaaatacaaaattagccgggtgtggtggcgggcgcctgtaatcccagctacttgggaggctgaggtgggagaatcgcttgaacccaggaggcggaggttgtggtgagctgagatcatgccattgcactccagcctcggcaacaagagtgaaacttcgtctccaaaaaaaaaaactcaagcaaatgaagttcataataataggggatgttgataaaacttgtggcagccttccaattcatttacagttgtttcgttttgtttttgttttaatgtccattttctgttgactgttcccagttttcattttccatacagtctgtatgtaaagtctggttttcattaagctgtggccagtatttgccactacaacagaaacacactgtcacacttgctagaatataactgtacttgagcttctcctttcctgtgaagtagtgctgggctttctagagtttaattctcaagtggcacaagatagcagagcccatgcattttaatggctgagactgctaagagtgaacctaaacacttacaagttgcagagagaaatgaaaaagtaattacatgctattagcattgagaaatgttgacaaattaatttgttgggaaccaaagatagcatttctgatgacaactcccacagtgattggccagttgtatgatgagtacactgctggaaagagggtaaactgggagttagtggatggtcccaatgccctgcctacagcagagtgccaaccagccctgagtgcaaaattcaagttcaatgtgtgtgcttgtgtgtggtgtgctttatggacccgcaaataccatattcattattgatgataagatcttcacagaatcctgtagctactaatgcattgagtttttaatctcagtacatcagccaggaggagccagatcacagggtagtgatgtctactgggattatactcataacatctacacaaaacaagttgagaaggatccacgttttcattgtttatcagaattgtatctcatttggctgagcattacttttgtcagaatgtgttatctgtaaaccatgtgtagtgaaattcttctgtaactttggattaaaggtatttatggtctttttgtttgtttgatttttaagtaagttatttcttttgtagacctgctgatggtatggttccatccttctgacctcagcatccaatctttttaaggatttttgttttcaatattgttattttaaattgtggttgaagcaatagaaaattgaaatatggattgtgcatgactgtgtcttgagtgtaaaaatattgcagtttgaaacttggacctaaagtattgcaaataaaaatgacaaacatcaatga

SEQ ID NO: 163246 - DNA, 2606 bp, Homo sapiens
  Payload ID: 12167
  Gene Symbol: PAK3
  Gene Name: p21 protein (Cdc42/Rac)-activated kinase 3
  Uniprot ID: O75914
  ENST ID: ENST00000372010
  CDS Start-End: 443-2122
ctggagcgctcggaggtagaggaaaggtcttgacggggtggctggatccgtggcagaatccagttccagattctagacttgagggttctgggctgttggtctgtagaagcgaaggagagaaggccatgttagtcttgctcccctcatggttttgcagactcaaatccaggccaagtgtatggctgtctgaggtattggaacagaaggaggtccattcctgttggtgacaacaccgtggccctgttctgggatgagcaaggtgtaaaggtttcccccaagaaagagcagctgagtccttgcatcttgtggcagctggtgtgcccagcactgagtctgtaggagctgaagccagcccggacccttctcatgggcagtgcccacctgtgctgaagtcctgcagcggtggcggtgtgaggagctgtgaaattagttgtaactgaaaatgtctgacggtctggataatgaagagaaacccccggctcctccactgaggatgaatagtaacaaccgggattcttcagcactcaaccacagctccaaaccacttcccatggcccctgaagagaagaataagaaagccaggcttcgctctatcttcccaggaggaggggataaaaccaataagaagaaggagaaagagcgcccagagatctctcttccttcagactttgagcatacgattcatgtggggtttgatgcagtcaccggggaattcactccagatctctatggctcacagatgtgcccagggaagctcccagagggaattccagagcaatgggcacgattactccaaacttccaacataacaaaattggaacagaagaagaacccacaagctgttctagatgttctcaaattctatgattccaaagaaacagtcaacaaccagaaatacatgagctttacatcaggagataaaagtgcacatggatacatagcagcccatccttcgagtacaaaaacagcatctgagcctccattggcccctcctgtgtctgaagaagaagatgaagaggaagaagaagaagaagatgaaaatgagccaccaccagttatcgcaccaagaccagagcatacaaaatcaatctatactcgttctgtggttgaatccattgcttcaccagcagtaccaaataaagaggtcacaccaccctctgctgaaaatgccaattccagtactttgtacaggaacacagatcggcaaagaaaaaaatccaagatgacagatgaggagatcttagagaagctaagaagcattgtgagtgttggggacccaaagaaaaaatacacaagatttgaaaaaattggtcaaggggcatcaggtactgtttatacagcactagacattgcaacaggacaagaggtggccataaagcagatgaaccttcaacagcaacccaagaaggaattaattattaatgaaattctggtcatgagggaaaataagaaccctaatattgttaattatttagatagctacttggtgggtgatgaactatgggtagtcatggaatacttggctggtggctctctgactgatgtggtcacagagacctgtatggatgaaggacagatagcagctgtctgcagagagtgcctgcaagctttggatttcctgcactcaaaccaggtgatccatagagatataaagagtgacaatattcttctcgggatggatggctctgttaaattgactgactttgggttctgtgcccagatcactcctgagcaaagtaaacgaagcactatggtgggaaccccatattggatggcacctgaggtggtgactcgaaaagcttatggtccgaaagttgatatctggtctcttggaattatggcaattgaaatggtggaaggtgaacccccttaccttaatgaaaatccactcagggcattgtatctgatagccactaatggaactccagagctccagaatcctgagagactgtcagctgtattccgtgactttttaaatcgctgtcttgagatggatgtggataggcgaggatctgccaaggagcttttgcagcatccatttttaaaattagccaagcctctctccagcctgactcctctgattatcgctgcaaaggaagcaattaagaacagcagccgctaagactgcaagccttacacctcaccatctccctcatgagtaagactgaaataaaactctgctgcaggaaagatggaagaaaagacagtcaaatggggtgggggttctttacctttcaaatgaatagaaacttcttataagcctttttcctactccctcagattatgtaatttatttgtaagcctgaatcgcagcccaaacagggcagcaatgttgaagtgaccataaagtggtcacttccaccgtgaagcgaaagagccagtagtgaatcccctcattttgtgcattcactttgaagaaaaaggtttctcaaagatgcacactccctcttcatagtgttgtgtttgtttttaagttagagagtagtccctcttgcattcaaacctccttcaaaactccttacccaatgtgatgtttttcacttgcattgtcattagatgtccagaaaaaaaaaagatgtcaaaatgtttttctaaaaaaagaaagc

SEQ ID NO: 163247 - DNA, 2196 bp, Homo sapiens
  Payload ID: 12167
  Gene Symbol: PAK3
  Gene Name: p21 protein (Cdc42/Rac)-activated kinase 3
  Uniprot ID: O75914
  ENST ID: ENST00000417227
  CDS Start-End: 28-1725
gagctgtgaaattagttgtaactgaaaatgtctgacggtctggataatgaagagaaacccccggctcctccactgaggatgaatagtaacaaccgggattcttcagcactcaaccacagctccaaaccacttcccatggcccctgaagagaagaataagaaagccaggcttcgctctatcttcccaggaggaggggataaaaccaataagaagaaggagaaagagcgcccagagatctctcttccttcagactttgagcatacgattcatgtggggtttgatgcagtcaccggggaattcactaactcccctttccagacctctagacctgtgacggtcgcttcaagtcaatcagagggaaaaatgggaattccagagcaatgggcacgattactccaaacttccaacataacaaaattggaacagaagaagaacccacaagctgttctagatgttctcaaattctatgattccaaagaaacagtcaacaaccagaaatacatgagctttacatcaggagataaaagtgcacatggatacatagcagcccatccttcgagtacaaaaacagcatctgagcctccattggcccctcctgtgtctgaagaagaagatgaagaggaagaagaagaagaagatgaaaatgagccaccaccagttatcgcaccaagaccagagcatacaaaatcaatctatactcgttctgtggttgaatccattgcttcaccagcagtaccaaataaagaggtcacaccaccctctgctgaaaatgccaattccagtactttgtacaggaacacagatcggcaaagaaaaaaatccaagatgacagatgaggagatcttagagaagctaagaagcattgtgagtgttggggacccaaagaaaaaatacacaagatttgaaaaaattggtcaaggggcatcaggtactgtttatacagcactagacattgcaacaggacaagaggtggccataaagcagatgaaccttcaacagcaacccaagaaggaattaattattaatgaaattctggtcatgagggaaaataagaaccctaatattgttaattatttagatagctacttggtgggtgatgaactatgggtagtcatggaatacttggctggtggctctctgactgatgtggtcacagagacctgtatggatgaaggacagatagcagctgtctgcagagagtgcctgcaagctttggatttcctgcactcaaaccaggtgatccatagagatataaagagtgacaatattcttctcgggatggatggctctgttaaattgactgactttgggttctgtgcccagatcactcctgagcaaagtaaacgaagcactatggtgggaaccccatattggatggcacctgaggtggtgactcgaaaagcttatggtccgaaagttgatatctggtctcttggaattatggcaattgaaatggtggaaggtgaacccccttaccttaatgaaaatccactcagggcattgtatctgatagccactaatggaactccagagctccagaatcctgagagactgtcagctgtattccgtgactttttaaatcgctgtcttgagatggatgtggataggcgaggatctgccaaggagcttttgcagcatccatttttaaaattagccaagcctctctccagcctgactcctctgattatcgctgcaaaggaagcaattaagaacagcagccgctaagactgcaagccttacacctcaccatctccctcatgagtaagactgaaataaaactctgctgcaggaaagatggaagaaaagacagtcaaatggggtgggggttctttacctttcaaatgaatagaaacttcttataagcctttttcctactccctcagattatgtaatttatttgtaagcctgaatcgcagcccaaacagggcagcaatgttgaagtgaccataaagtggtcacttccaccgtgaagcgaaagagccagtagtgaatcccctcattttgtgcattcactttgaagaaaaaggtttctcaaagatgcacactccctcttcatagtgttgtgtttgtttttaagttagagagtagtccctcttgcattcaaacctccttcaaaactccttacccaatgtgatgtttttcacttgcattgtcattagatgtccagaaaaaaaaaagatgtcaaaatgtttttct

SEQ ID NO: 163248 - DNA, 2477 bp, Homo sapiens
  Payload ID: 12167
  Gene Symbol: PAK3
  Gene Name: p21 protein (Cdc42/Rac)-activated kinase 3
  Uniprot ID: O75914
  ENST ID: ENST00000425146
  CDS Start-End: 372-2006
aatcacagtcaaaatacacccagatgctctcacacacccagacgcgcgcgcatccccgggccatggggcgcacgtgagcccgcaccccgcgcacccagccctgcctctcgccagagcatcctcagcagctgccaccgaagcagcctcctccttctctcttcctcctcctcctaccacggccgccgccaccaccgctgcggctgtgatctcctatcccctctggtcctccttcctcccccagttcctgctcctcctcccatcccctgctcctcctgcccagcagcgaagggcagaaccctcggctgccgccctccttcgctctgaccaagaagaggctggaacaggagctgtgaaattagttgtaactgaaaatgtctgacggtctggataatgaagagaaacccccggctcctccactgaggatgaatagtaacaaccgggattcttcagcactcaaccacagctccaaaccacttcccatggcccctgaagagaagaataagaaagccaggcttcgctctatcttcccaggaggaggggataaaaccaataagaagaaggagaaagagcgcccagagatctctcttccttcagactttgagcatacgattcatgtggggtttgatgcagtcaccggggaattcactggaattccagagcaatgggcacgattactccaaacttccaacataacaaaattggaacagaagaagaacccacaagctgttctagatgttctcaaattctatgattccaaagaaacagtcaacaaccagaaatacatgagctttacatcaggagataaaagtgcacatggatacatagcagcccatccttcgagtacaaaaacagcatctgagcctccattggcccctcctgtgtctgaagaagaagatgaagaggaagaagaagaagaagatgaaaatgagccaccaccagttatcgcaccaagaccagagcatacaaaatcaatctatactcgttctgtggttgaatccattgcttcaccagcagtaccaaataaagaggtcacaccaccctctgctgaaaatgccaattccagtactttgtacaggaacacagatcggcaaagaaaaaaatccaagatgacagatgaggagatcttagagaagctaagaagcattgtgagtgttggggacccaaagaaaaaatacacaagatttgaaaaaattggtcaaggggcatcaggtactgtttatacagcactagacattgcaacaggacaagaggtggccataaagcagatgaaccttcaacagcaacccaagaaggaattaattattaatgaaattctggtcatgagggaaaataagaaccctaatattgttaattatttagatagctacttggtgggtgatgaactatgggtagtcatggaatacttggctggtggctctctgactgatgtggtcacagagacctgtatggatgaaggacagatagcagctgtctgcagagagtgcctgcaagctttggatttcctgcactcaaaccaggtgatccatagagatataaagagtgacaatattcttctcgggatggatggctctgttaaattgactgactttgggttctgtgcccagatcactcctgagcaaagtaaacgaagcactatggtgggaaccccatattggatggcacctgaggtggtgactcgaaaagcttatggtccgaaagttgatatctggtctcttggaattatggcaattgaaatggtggaaggtgaacccccttaccttaatgaaaatccactcagggcattgtatctgatagccactaatggaactccagagctccagaatcctgagagactgtcagctgtattccgtgactttttaaatcgctgtcttgagatggatgtggataggcgaggatctgccaaggagcttttgcagcatccatttttaaaattagccaagcctctctccagcctgactcctctgattatcgctgcaaaggaagcaattaagaacagcagccgctaagactgcaagccttacacctcaccatctccctcatgagtaagactgaaataaaactctgctgcaggaaagatggaagaaaagacagtcaaatggggtgggggttctttacctttcaaatgaatagaaacttcttataagcctttttcctactccctcagattatgtaatttatttgtaagcctgaatcgcagcccaaacagggcagcaatgttgaagtgaccataaagtggtcacttccaccgtgaagcgaaagagccagtagtgaatcccctcattttgtgcattcactttgaagaaaaaggtttctcaaagatgcacactccctcttcatagtgttgtgtttgtttttaagttagagagtagtccctcttgcattcaaacctccttcaaaactccttacccaatgtgatgtttttcacttgcattgtcattagatgtccagaaaaaaaaaagatgtcaaaatgtttttct

SEQ ID NO: 163249 - DNA, 573 bp, Homo sapiens
  Payload ID: 12167
  Gene Symbol: PAK3
  Gene Name: p21 protein (Cdc42/Rac)-activated kinase 3
  ENST ID: ENST00000429193
  CDS Start-End: 29-573
ggagctgtgaaattagttgtaactgaaaatgtctgacggtctggataatgaagagaaacccccggctcctccactgaggatgaatagtaacaaccgggattcttcagcactcaaccacagctccaaaccacttcccatggcccctgaagagaagaataagaaagccaggcttcgctctatcttcccaggaggaggggataaaaccaataagaagaaggagaaagagcgcccagagatctctcttccttcagactttgagcatacgattcatgtggggtttgatgcagtcaccggggaattcactaactcccctttccagacctctagacctgtgacggtcgcttcaagtcaatcagagggaaaaatgccagatctctatggctcacagatgtgcccagggaagctcccagagggaattccagagcaatgggcacgattactccaaacttccaacataacaaaattggaacagaagaagaacccacaagctgttctagatgttctcaaattctatgattccaaagaaacagtcaacaaccagaaatacatgagctttacatcaggagataaaag

SEQ ID NO: 163250 - DNA, 2550 bp, Homo sapiens
  Payload ID: 12167
  Gene Symbol: PAK3
  Gene Name: p21 protein (Cdc42/Rac)-activated kinase 3
  Uniprot ID: O75914
  ENST ID: ENST00000446737
  CDS Start-End: 445-2079
aatcacagtcaaaatacacccagatgctctcacacacccagacgcgcgcgcatccccgggccatggggcgcacgtgagcccgcaccccgcgcacccagccctgcctctcgccagagcatcctcagcagctgccaccgaagcagcctcctccttctctcttcctcctcctcctaccacggccgccgccaccaccgctgcggctgtgatctcctatcccctctggtcctccttcctcccccagttcctgctcctcctcccatcccctgctcctcctgcccagcagcgaagggcagaaccctcggctgccgccctccttcgctctgaccaagaagaggctggaacagaataacatacagaggacagctttctcttctgaggagtcagaagttcagttcgcccaacatggaatgacttgaggagctgtgaaattagttgtaactgaaaatgtctgacggtctggataatgaagagaaacccccggctcctccactgaggatgaatagtaacaaccgggattcttcagcactcaaccacagctccaaaccacttcccatggcccctgaagagaagaataagaaagccaggcttcgctctatcttcccaggaggaggggataaaaccaataagaagaaggagaaagagcgcccagagatctctcttccttcagactttgagcatacgattcatgtggggtttgatgcagtcaccggggaattcactggaattccagagcaatgggcacgattactccaaacttccaacataacaaaattggaacagaagaagaacccacaagctgttctagatgttctcaaattctatgattccaaagaaacagtcaacaaccagaaatacatgagctttacatcaggagataaaagtgcacatggatacatagcagcccatccttcgagtacaaaaacagcatctgagcctccattggcccctcctgtgtctgaagaagaagatgaagaggaagaagaagaagaagatgaaaatgagccaccaccagttatcgcaccaagaccagagcatacaaaatcaatctatactcgttctgtggttgaatccattgcttcaccagcagtaccaaataaagaggtcacaccaccctctgctgaaaatgccaattccagtactttgtacaggaacacagatcggcaaagaaaaaaatccaagatgacagatgaggagatcttagagaagctaagaagcattgtgagtgttggggacccaaagaaaaaatacacaagatttgaaaaaattggtcaaggggcatcaggtactgtttatacagcactagacattgcaacaggacaagaggtggccataaagcagatgaaccttcaacagcaacccaagaaggaattaattattaatgaaattctggtcatgagggaaaataagaaccctaatattgttaattatttagatagctacttggtgggtgatgaactatgggtagtcatggaatacttggctggtggctctctgactgatgtggtcacagagacctgtatggatgaaggacagatagcagctgtctgcagagagtgcctgcaagctttggatttcctgcactcaaaccaggtgatccatagagatataaagagtgacaatattcttctcgggatggatggctctgttaaattgactgactttgggttctgtgcccagatcactcctgagcaaagtaaacgaagcactatggtgggaaccccatattggatggcacctgaggtggtgactcgaaaagcttatggtccgaaagttgatatctggtctcttggaattatggcaattgaaatggtggaaggtgaacccccttaccttaatgaaaatccactcagggcattgtatctgatagccactaatggaactccagagctccagaatcctgagagactgtcagctgtattccgtgactttttaaatcgctgtcttgagatggatgtggataggcgaggatctgccaaggagcttttgcagcatccatttttaaaattagccaagcctctctccagcctgactcctctgattatcgctgcaaaggaagcaattaagaacagcagccgctaagactgcaagccttacacctcaccatctccctcatgagtaagactgaaataaaactctgctgcaggaaagatggaagaaaagacagtcaaatggggtgggggttctttacctttcaaatgaatagaaacttcttataagcctttttcctactccctcagattatgtaatttatttgtaagcctgaatcgcagcccaaacagggcagcaatgttgaagtgaccataaagtggtcacttccaccgtgaagcgaaagagccagtagtgaatcccctcattttgtgcattcactttgaagaaaaaggtttctcaaagatgcacactccctcttcatagtgttgtgtttgtttttaagttagagagtagtccctcttgcattcaaacctccttcaaaactccttacccaatgtgatgtttttcacttgcattgtcattagatgtccagaaaaaaaaaagatgtcaaaatgtttttct

SEQ ID NO: 163251 - DNA, 2098 bp, Homo sapiens
  Payload ID: 12167
  Gene Symbol: PAK3
  Gene Name: p21 protein (Cdc42/Rac)-activated kinase 3
  Uniprot ID: O75914
  ENST ID: ENST00000518291
  CDS Start-End: 356-2098
cagaatccagttccagattctagacttgagggttctgggctgttggtctgtagaagcgaaggagagaaggactcaaatccaggccaagtgtatggctgtctgaggtattggaacagaaggaggtccattcctgttggtgacaacaccgtggccctgttctgggatgagcaaggtgtaaaggtttcccccaagaaagagcagctgagtccttgcatcttgtggcagctggtgtgcccagcactgagtctgtaggagctgaagccagcccggacccttctcatgggcagtgcccacctgtgctgaagtcctgcagcggtggcggtgtgaggagctgtgaaattagttgtaactgaaaatgtctgacggtctggataatgaagagaaacccccggctcctccactgaggatgaatagtaacaaccgggattcttcagcactcaaccacagctccaaaccacttcccatggcccctgaagagaagaataagaaagccaggcttcgctctatcttcccaggaggaggggataaaaccaataagaagaaggagaaagagcgcccagagatctctcttccttcagactttgagcatacgattcatgtggggtttgatgcagtcaccggggaattcactaactcccctttccagacctctagacctgtgacggtcgcttcaagtcaatcagagggaaaaatgccagatctctatggctcacagatgtgcccagggaagctcccagagggaattccagagcaatgggcacgattactccaaacttccaacataacaaaattggaacagaagaagaacccacaagctgttctagatgttctcaaattctatgattccaaagaaacagtcaacaaccagaaatacatgagctttacatcaggagataaaagtgcacatggatacatagcagcccatccttcgagtacaaaaacagcatctgagcctccattggcccctcctgtgtctgaagaagaagatgaagaggaagaagaagaagaagatgaaaatgagccaccaccagttatcgcaccaagaccagagcatacaaaatcaatctatactcgttctgtggttgaatccattgcttcaccagcagtaccaaataaagaggtcacaccaccctctgctgaaaatgccaattccagtactttgtacaggaacacagatcggcaaagaaaaaaatccaagatgacagatgaggagatcttagagaagctaagaagcattgtgagtgttggggacccaaagaaaaaatacacaagatttgaaaaaattggtcaaggggcatcaggtactgtttatacagcactagacattgcaacaggacaagaggtggccataaagcagatgaaccttcaacagcaacccaagaaggaattaattattaatgaaattctggtcatgagggaaaataagaaccctaatattgttaattatttagatagctacttggtgggtgatgaactatgggtagtcatggaatacttggctggtggctctctgactgatgtggtcacagagacctgtatggatgaaggacagatagcagctgtctgcagagagtgcctgcaagctttggatttcctgcactcaaaccaggtgatccatagagatataaagagtgacaatattcttctcgggatggatggctctgttaaattgactgactttgggttctgtgcccagatcactcctgagcaaagtaaacgaagcactatggtgggaaccccatattggatggcacctgaggtggtgactcgaaaagcttatggtccgaaagttgatatctggtctcttggaattatggcaattgaaatggtggaaggtgaacccccttaccttaatgaaaatccactcagggcattgtatctgatagccactaatggaactccagagctccagaatcctgagagactgtcagctgtattccgtgactttttaaatcgctgtcttgagatggatgtggataggcgaggatctgccaaggagcttttgcagcatccatttttaaaattagccaagcctctctccagcctgactcctctgattatcgctgcaaaggaagcaattaagaacagcagccgctaa

SEQ ID NO: 163252 - DNA, 2638 bp, Homo sapiens
  Payload ID: 12167
  Gene Symbol: PAK3
  Gene Name: p21 protein (Cdc42/Rac)-activated kinase 3
  Uniprot ID: O75914
  ENST ID: ENST00000519681
  CDS Start-End: 443-2140
ctggagcgctcggaggtagaggaaaggtcttgacggggtggctggatccgtggcagaatccagttccagattctagacttgagggttctgggctgttggtctgtagaagcgaaggagagaaggccatgttagtcttgctcccctcatggttttgcagactcaaatccaggccaagtgtatggctgtctgaggtattggaacagaaggaggtccattcctgttggtgacaacaccgtggccctgttctgggatgagcaaggtgtaaaggtttcccccaagaaagagcagctgagtccttgcatcttgtggcagctggtgtgcccagcactgagtctgtaggagctgaagccagcccggacccttctcatgggcagtgcccacctgtgctgaagtcctgcagcggtggcggtgtgaggagctgtgaaattagttgtaactgaaaatgtctgacggtctggataatgaagagaaacccccggctcctccactgaggatgaatagtaacaaccgggattcttcagcactcaaccacagctccaaaccacttcccatggcccctgaagagaagaataagaaagccaggcttcgctctatcttcccaggaggaggggataaaaccaataagaagaaggagaaagagcgcccagagatctctcttccttcagactttgagcatacgattcatgtggggtttgatgcagtcaccggggaattcactaactcccctttccagacctctagacctgtgacggtcgcttcaagtcaatcagagggaaaaatgggaattccagagcaatgggcacgattactccaaacttccaacataacaaaattggaacagaagaagaacccacaagctgttctagatgttctcaaattctatgattccaaagaaacagtcaacaaccagaaatacatgagctttacatcaggagataaaagtgcacatggatacatagcagcccatccttcgagtacaaaaacagcatctgagcctccattggcccctcctgtgtctgaagaagaagatgaagaggaagaagaagaagaagatgaaaatgagccaccaccagttatcgcaccaagaccagagcatacaaaatcaatctatactcgttctgtggttgaatccattgcttcaccagcagtaccaaataaagaggtcacaccaccctctgctgaaaatgccaattccagtactttgtacaggaacacagatcggcaaagaaaaaaatccaagatgacagatgaggagatcttagagaagctaagaagcattgtgagtgttggggacccaaagaaaaaatacacaagatttgaaaaaattggtcaaggggcatcaggtactgtttatacagcactagacattgcaacaggacaagaggtggccataaagcagatgaaccttcaacagcaacccaagaaggaattaattattaatgaaattctggtcatgagggaaaataagaaccctaatattgttaattatttagatagctacttggtgggtgatgaactatgggtagtcatggaatacttggctggtggctctctgactgatgtggtcacagagacctgtatggatgaaggacagatagcagctgtctgcagagagtgcctgcaagctttggatttcctgcactcaaaccaggtgatccatagagatataaagagtgacaatattcttctcgggatggatggctctgttaaattgactgactttgggttctgtgcccagatcactcctgagcaaagtaaacgaagcactatggtgggaaccccatattggatggcacctgaggtggtgactcgaaaagcttatggtccgaaagttgatatctggtctcttggaattatggcaattgaaatggtggaaggtgaacccccttaccttaatgaaaatccactcagggcattgtatctgatagccactaatggaactccagagctccagaatcctgagagactgtcagctgtattccgtgactttttaaatcgctgtcttgagatggatgtggataggcgaggatctgccaaggagcttttgcagcatccatttttaaaattagccaagcctctctccagcctgactcctctgattatcgctgcaaaggaagcaattaagaacagcagccgctaagactgcaagccttacacctcaccatctccctcatgagtaagactgaaataaaactctgctgcaggaaagatggaagaaaagacagtcaaatggggtgggggttctttacctttcaaatgaatagaaacttcttataagcctttttcctactccctcagattatgtaatttatttgtaagcctgaatcgcagcccaaacagggcagcaatgttgaagtgaccataaagtggtcacttccaccgtgaagcgaaagagccagtagtgaatcccctcattttgtgcattcactttgaagaaaaaggtttctcaaagatgcacactccctcttcatagtgttgtgtttgtttttaagttagagagtagtccctcttgcattcaaacctccttcaaaactccttacccaatgtgatgtttttcacttgcattgtcattagatgtccagaaaaaaaaaagatgtcaaaatgtttttctaaaaaaagaaagcaaaaaaagcaaggc

SEQ ID NO: 163253 - DNA, 2130 bp, Homo sapiens
  Payload ID: 12167
  Gene Symbol: PAK3
  Gene Name: p21 protein (Cdc42/Rac)-activated kinase 3
  ENST ID: ENST00000620137
  CDS Start-End: 1-1632
atgtctgacggtctggataatgaagagaaacccccggctcctccactgaggatgaatagtaacccgggattcttcagcactcaaccacagctcaaaccacttcccatggcccctgaagagaagaataagaaagccaggcttcgctctatcttcccaggaggaggggataaaaccaataagaagaaggagaaagagcgcccagagatctctcttccttcagactttgagcatacgattcatgtggggtttgatgcagtcaccggggaattcactggaattccagagcaatgggcacgattactccaaacttccaacataacaaaattggaacagaagaagaacccacaagctgttctagatgttctcaaattctatgattccaaagaaacagtcaacaaccagaaatacatgagctttacatcaggagataaaagtgcacatggatacatagcagcccatccttcgagtacaaaaacagcatctgagcctccattggcccctcctgtgtctgaagaagaagatgaagaggaagaagaagaagaagatgaaaatgagccaccaccagttatcgcaccaagaccagagcatacaaaatcaatctatactcgttctgtggttgaatccattgcttcaccagcagtaccaaataaagaggtcacaccaccctctgctgaaaatgccaattccagtactttgtacaggaacacagatcggcaaagaaaaaaatccaagatgacagatgaggagatcttagagaagctaagaagcattgtgagtgttggggacccaaagaaaaaatacacaagatttgaaaaaattggtcaaggggcatcaggtactgtttatacagcactagacattgcaacaggacaagaggtggccataaagcagatgaaccttcaacagcaacccaagaaggaattaattattaatgaaattctggtcatgagggaaaataagaaccctaatattgttaattatttagatagctacttggtgggtgatgaactatgggtagtcatggaatacttggctggtggctctctgactgatgtggtcacagagacctgtatggatgaaggacagatagcagctgtctgcagagagtgcctgcaagctttggatttcctgcactcaaaccaggtgatccatagagatataaagagtgacaatattcttctcgggatggatggctctgttaaattgactgactttgggttctgtgcccagatcactcctgagcaaagtaaacgaagcactatggtgggaaccccatattggatggcacctgaggtggtgactcgaaaagcttatggtccgaaagttgatatctggtctcttggaattatggcaattgaaatggtggaaggtgaacccccttaccttaatgaaaatccactcagggcattgtatctgatagccactaatggaactccagagctccagaatcctgagagactgtcagctgtattccgtgactttttaaatcgctgtcttgagatggatgtggataggcgaggatctgccaaggagcttttgcagcatccatttttaaaattagccaagcctctctccagcctgactcctctgattatcgctgcaaaggaagcaattaagaacagcagccgctaagactgcaagccttacacctcaccatctccctcatgagtaagactgaaataaaactctgctgcaggaaagatggaagaaaagacagtcaaatggggtgggggttctttacctttcaaatgaatagaaacttcttataagcctttttcctactccctcagattatgtaatttatttgtaagcctgaatcgcagcccaaacagggcagcaatgttgaagtgaccataaagtggtcacttccaccgtgaagcgaaagagccagtagtgaatcccctcattttgtgcattcactttgaagaaaaaggtttctcaaagatgcacactccctcttcatagtgttgtgtttgtttttaagttagagagtagtccctcttgcattcaaacctccttcaaaactccttacccaatgtgatgtttttcacttgcattgtcattagatgtccagaaaaaaaaaagatgtcaaaatgtttttctaaaaaaagaaagcaaaaaaagcaaggc

SEQ ID NO: 163254 - DNA, 2555 bp, Homo sapiens
  Payload ID: 12168
  Gene Symbol: PAK4
  Gene Name: p21 protein (Cdc42/Rac)-activated kinase 4
  Uniprot ID: O96013
  ENST ID: ENST00000321944
  CDS Start-End: 228-1733
gggattcaacatggcggcgggagtgtccgcggtggtggcggtgcaagagagctgagggaggcgcgagggcgcggagttccaggtcgagcagttaggccgcgagcgactgcggcgccgagccgatgagtaacccgaagcccctagaggagtggtcacctgcctgagggcacttctgtcccaccagcatcagaccaggtgtgtgcaggccgcaccgagtccccggcaccatgtttgggaagaggaagaagcgggtggagatctccgcgccgtccaacttcgagcaccgcgtgcacacgggcttcgaccagcacgagcagaagttcacggggctgccccgccagtggcagagcctgatcgaggagtcggctcgccggcccaagcccctcgtcgaccccgcctgcatcacctccatccagcccggggcccccaagaccatcgtgcggggcagcaaaggtgccaaagatggggccctcacgctgctgctggacgagtttgagaacatgtcggtgacacgctccaactccctgcggagagacagcccgccgccgcccgcccgtgcccgccaggaaaatgggatgccagaggagccggccaccacggccagagggggcccagggaagggggagcctcatgacgtggcccctaacgggccatcagcggggggcctggccatcccccagtcctcctcctcctcctcccggcctcccacccgagcccgaggtgcccccagccctggagtgctgggaccccacgcctcagagccccagctggcccctccagcctgcacccccgccgcccctgctgttcctgggccccctggcccccgctcaccacagcgggagccacagcgagtatcccatgagcagttccgggctgccctgcagctggtggtggacccaggcgacccccgctcctacctggacaacttcatcaagattggcgagggctccacgggcatcgtgtgcatcgccaccgtgcgcagctcgggcaagctggtggccgtcaagaagatggacctgcgcaagcagcagaggcgcgagctgctcttcaacgaggtggtaatcatgagggactaccagcacgagaatgtggtggagatgtacaacagctacctggtgggggacgagctctgggtggtcatggagttcctggaaggaggcgccctcaccgacatcgtcacccacaccaggatgaacgaggagcagatcgcggccgtgtgccttgcagtgctgcaggccctgtcggtgctccacgcccagggcgtcatccaccgggacatcaagagcgactcgatcctgctgacccatgatggcagggtgaagctgtcagactttgggttctgcgcccaggtgagcaaggaagtgccccgaaggaagtcgctggtcggcacgccctactggatggccccagagctcatctcccgccttccctacgggccagaggtagacatctggtcgctggggataatggtgattgagatggtggacggagagcccccctacttcaacgagccacccctcaaagccatgaagatgattcgggacaacctgccaccccgactgaagaacctgcacaaggtgtcgccatccctgaagggcttcctggaccgcctgctggtgcgagaccctgcccagcgggccacggcagccgagctgctgaagcacccattcctggccaaggcagggccgcctgccagcatcgtgcccctcatgcgccagaaccgcaccagatgaggcccagcgcccttcccctcaaccaaagagccccccgggtcacccccgccccactgaggccagtagggggccaggcctcccactcctcccagcccgggagatgctccgcgtggcaccaccctccttgctgggggtagatgagaccctactactgaactccagttttgatctcgtgacttttagaaaaacacagggactcgtgggagcaagcgaggctcccaggacccccaccctctgggacaggccctcccccatgttcttctgtctccaggaagggcagcggccctcccatcactggaagtctgcagtgggggtcgctgggggtggagagaacactaagaggtgaacatgtatgagtgtgtgcacgcgtgtgagtgtgcatgtgtgtgtgtgcaaaggtccagccaccccgtcctccagcctgcaaggggtgtctggcgccttgcctgacacccagccccctctccccctgagccattgtgggggtcgatcatgaatgtccgaagagtggccttttcccgtagccctgcgccccctttctgtggctggatggggagacaggtcagggccccccaccctctccagcccctgcagcaaatgactactgcacctggacagcctcctcttttctagaagtctatttatattgtcattttataacactctagcccctgcccttattgggggacagatggtccctgtcctgcggggtggccctggcagaaccactgcctgaagaaccaggttcctgcccggtcagcgcagccccagcccgcccacccctgcctcgagttagttttacaattaaaacattgtcttgtt

SEQ ID NO: 163255 - DNA, 2739 bp, Homo sapiens
  Payload ID: 12168
  Gene Symbol: PAK4
  Gene Name: p21 protein (Cdc42/Rac)-activated kinase 4
  Uniprot ID: O96013
  ENST ID: ENST00000358301
  CDS Start-End: 141-1916
ttcaacatggcggcgggagtgtccgcggtggtggcggtgcaagagagctgagggaggcgcgagggcgcggagttccaggtcgagcagttaggccgcgagcgactgcggcgccgagccggccgcaccgagtccccggcaccatgtttgggaagaggaagaagcgggtggagatctccgcgccgtccaacttcgagcaccgcgtgcacacgggcttcgaccagcacgagcagaagttcacggggctgccccgccagtggcagagcctgatcgaggagtcggctcgccggcccaagcccctcgtcgaccccgcctgcatcacctccatccagcccggggcccccaagaccatcgtgcggggcagcaaaggtgccaaagatggggccctcacgctgctgctggacgagtttgagaacatgtcggtgacacgctccaactccctgcggagagacagcccgccgccgcccgcccgtgcccgccaggaaaatgggatgccagaggagccggccaccacggccagagggggcccagggaaggcaggcagccgaggccggttcgccggtcacagcgaggcgggtggcggcagtggtgacaggcgacgggcggggccagagaagaggcccaagtcttccagggagggctcagggggtccccaggagtcctcccgggacaaacgccccctctccgggcctgatgtcggcaccccccagcctgctggtctggccagtggggcgaaactggcagctggccggccctttaacacctacccgagggctgacacggaccacccatcccggggtgcccagggggagcctcatgacgtggcccctaacgggccatcagcggggggcctggccatcccccagtcctcctcctcctcctcccggcctcccacccgagcccgaggtgcccccagccctggagtgctgggaccccacgcctcagagccccagctggcccctccagcctgcacccccgccgcccctgctgttcctgggccccctggcccccgctcaccacagcgggagccacagcgagtatcccatgagcagttccgggctgccctgcagctggtggtggacccaggcgacccccgctcctacctggacaacttcatcaagattggcgagggctccacgggcatcgtgtgcatcgccaccgtgcgcagctcgggcaagctggtggccgtcaagaagatggacctgcgcaagcagcagaggcgcgagctgctcttcaacgaggtggtaatcatgagggactaccagcacgagaatgtggtggagatgtacaacagctacctggtgggggacgagctctgggtggtcatggagttcctggaaggaggcgccctcaccgacatcgtcacccacaccaggatgaacgaggagcagatcgcggccgtgtgccttgcagtgctgcaggccctgtcggtgctccacgcccagggcgtcatccaccgggacatcaagagcgactcgatcctgctgacccatgatggcagggtgaagctgtcagactttgggttctgcgcccaggtgagcaaggaagtgccccgaaggaagtcgctggtcggcacgccctactggatggccccagagctcatctcccgccttccctacgggccagaggtagacatctggtcgctggggataatggtgattgagatggtggacggagagcccccctacttcaacgagccacccctcaaagccatgaagatgattcgggacaacctgccaccccgactgaagaacctgcacaaggtgtcgccatccctgaagggcttcctggaccgcctgctggtgcgagaccctgcccagcgggccacggcagccgagctgctgaagcacccattcctggccaaggcagggccgcctgccagcatcgtgcccctcatgcgccagaaccgcaccagatgaggcccagcgcccttcccctcaaccaaagagccccccgggtcacccccgccccactgaggccagtagggggccaggcctcccactcctcccagcccgggagatgctccgcgtggcaccaccctccttgctgggggtagatgagaccctactactgaactccagttttgatctcgtgacttttagaaaaacacagggactcgtgggagcaagcgaggctcccaggacccccaccctctgggacaggccctcccccatgttcttctgtctccaggaagggcagcggccctcccatcactggaagtctgcagtgggggtcgctgggggtggagagaacactaagaggtgaacatgtatgagtgtgtgcacgcgtgtgagtgtgcatgtgtgtgtgtgcaaaggtccagccaccccgtcctccagcctgcaaggggtgtctggcgccttgcctgacacccagccccctctccccctgagccattgtgggggtcgatcatgaatgtccgaagagtggccttttcccgtagccctgcgccccctttctgtggctggatggggagacaggtcagggccccccaccctctccagcccctgcagcaaatgactactgcacctggacagcctcctcttttctagaagtctatttatattgtcattttataacactctagcccctgcccttattgggggacagatggtccctgtcctgcggggtggccctggcagaaccactgcctgaagaaccaggttcctgcccggtcagcgcagccccagcccgcccacccctgcctcgagttagttttacaattaaaacattgtcttgttt

SEQ ID NO: 163256 - DNA, 2855 bp, Homo sapiens
  Payload ID: 12168
  Gene Symbol: PAK4
  Gene Name: p21 protein (Cdc42/Rac)-activated kinase 4
  Uniprot ID: O96013
  ENST ID: ENST00000360442
  CDS Start-End: 253-2028
ccatctttctccaggctctctatgggatgccgccatcagaatgtctcttcctcagcccctttgttttttaaagtggctttggtcgaccatttgctctgtgcttggtactgtgtcaagggcccgattgaagaccacagatcctaaagataggggagtgtcgcgacaaggctgcctggggtgccctcttaacccaggggatcagtaaccctgtgctgagtcaatatccaaaggccgcaccgagtccccggcaccatgtttgggaagaggaagaagcgggtggagatctccgcgccgtccaacttcgagcaccgcgtgcacacgggcttcgaccagcacgagcagaagttcacggggctgccccgccagtggcagagcctgatcgaggagtcggctcgccggcccaagcccctcgtcgaccccgcctgcatcacctccatccagcccggggcccccaagaccatcgtgcggggcagcaaaggtgccaaagatggggccctcacgctgctgctggacgagtttgagaacatgtcggtgacacgctccaactccctgcggagagacagcccgccgccgcccgcccgtgcccgccaggaaaatgggatgccagaggagccggccaccacggccagagggggcccagggaaggcaggcagccgaggccggttcgccggtcacagcgaggcgggtggcggcagtggtgacaggcgacgggcggggccagagaagaggcccaagtcttccagggagggctcagggggtccccaggagtcctcccgggacaaacgccccctctccgggcctgatgtcggcaccccccagcctgctggtctggccagtggggcgaaactggcagctggccggccctttaacacctacccgagggctgacacggaccacccatcccggggtgcccagggggagcctcatgacgtggcccctaacgggccatcagcggggggcctggccatcccccagtcctcctcctcctcctcccggcctcccacccgagcccgaggtgcccccagccctggagtgctgggaccccacgcctcagagccccagctggcccctccagcctgcacccccgccgcccctgctgttcctgggccccctggcccccgctcaccacagcgggagccacagcgagtatcccatgagcagttccgggctgccctgcagctggtggtggacccaggcgacccccgctcctacctggacaacttcatcaagattggcgagggctccacgggcatcgtgtgcatcgccaccgtgcgcagctcgggcaagctggtggccgtcaagaagatggacctgcgcaagcagcagaggcgcgagctgctcttcaacgaggtggtaatcatgagggactaccagcacgagaatgtggtggagatgtacaacagctacctggtgggggacgagctctgggtggtcatggagttcctggaaggaggcgccctcaccgacatcgtcacccacaccaggatgaacgaggagcagatcgcggccgtgtgccttgcagtgctgcaggccctgtcggtgctccacgcccagggcgtcatccaccgggacatcaagagcgactcgatcctgctgacccatgatggcagggtgaagctgtcagactttgggttctgcgcccaggtgagcaaggaagtgccccgaaggaagtcgctggtcggcacgccctactggatggccccagagctcatctcccgccttccctacgggccagaggtagacatctggtcgctggggataatggtgattgagatggtggacggagagcccccctacttcaacgagccacccctcaaagccatgaagatgattcgggacaacctgccaccccgactgaagaacctgcacaaggtgtcgccatccctgaagggcttcctggaccgcctgctggtgcgagaccctgcccagcgggccacggcagccgagctgctgaagcacccattcctggccaaggcagggccgcctgccagcatcgtgcccctcatgcgccagaaccgcaccagatgaggcccagcgcccttcccctcaaccaaagagccccccgggtcacccccgccccactgaggccagtagggggccaggcctcccactcctcccagcccgggagatgctccgcgtggcaccaccctccttgctgggggtagatgagaccctactactgaactccagttttgatctcgtgacttttagaaaaacacagggactcgtgggagcaagcgaggctcccaggacccccaccctctgggacaggccctcccccatgttcttctgtctccaggaagggcagcggccctcccatcactggaagtctgcagtgggggtcgctgggggtggagagaacactaagaggtgaacatgtatgagtgtgtgcacgcgtgtgagtgtgcatgtgtgtgtgtgcaaaggtccagccaccccgtcctccagcctgcaaggggtgtctggcgccttgcctgacacccagccccctctccccctgagccattgtgggggtcgatcatgaatgtccgaagagtggccttttcccgtagccctgcgccccctttctgtggctggatggggagacaggtcagggccccccaccctctccagcccctgcagcaaatgactactgcacctggacagcctcctcttttctagaagtctatttatattgtcattttataacactctagcccctgcccttattgggggacagatggtccctgtcctgcggggtggccctggcagaaccactgcctgaagaaccaggttcctgcccggtcagcgcagccccagcccgcccacccctgcctcgagttagttttacaattaaaacattgtcttgttttgtg

SEQ ID NO: 163257 - DNA, 3025 bp, Homo sapiens
  Payload ID: 12168
  Gene Symbol: PAK4
  Gene Name: p21 protein (Cdc42/Rac)-activated kinase 4
  Uniprot ID: O96013
  ENST ID: ENST00000593690
  CDS Start-End: 428-2203
gcgggagtgtccgcggtggtggcggtgcaagagagctgagggaggcgcgagggcgcggagttccaggtcgagcagttaggccgcgagcgactgcggcgccgagccgatgagtaacccgaagcccctagaggagtggtcacctgcctgagggcacttctgtcccaccagcatcagaccaggtgtgtgcaggctctctatgggatgccgccatcagaatgtctcttcctcagcccctttgttttttaaagtggctttggtcgaccatttgctctgtgcttggtactgtgtcaagggcccgattgaagaccacagatcctaaagataggggagtgtcgcgacaaggctgcctggggtgccctcttaacccaggggatcagtaaccctgtgctgagtcaatatccaaaggccgcaccgagtccccggcaccatgtttgggaagaggaagaagcgggtggagatctccgcgccgtccaacttcgagcaccgcgtgcacacgggcttcgaccagcacgagcagaagttcacggggctgccccgccagtggcagagcctgatcgaggagtcggctcgccggcccaagcccctcgtcgaccccgcctgcatcacctccatccagcccggggcccccaagaccatcgtgcggggcagcaaaggtgccaaagatggggccctcacgctgctgctggacgagtttgagaacatgtcggtgacacgctccaactccctgcggagagacagcccgccgccgcccgcccgtgcccgccaggaaaatgggatgccagaggagccggccaccacggccagagggggcccagggaaggcaggcagccgaggccggttcgccggtcacagcgaggcgggtggcggcagtggtgacaggcgacgggcggggccagagaagaggcccaagtcttccagggagggctcagggggtccccaggagtcctcccgggacaaacgccccctctccgggcctgatgtcggcaccccccagcctgctggtctggccagtggggcgaaactggcagctggccggccctttaacacctacccgagggctgacacggaccacccatcccggggtgcccagggggagcctcatgacgtggcccctaacgggccatcagcggggggcctggccatcccccagtcctcctcctcctcctcccggcctcccacccgagcccgaggtgcccccagccctggagtgctgggaccccacgcctcagagccccagctggcccctccagcctgcacccccgccgcccctgctgttcctgggccccctggcccccgctcaccacagcgggagccacagcgagtatcccatgagcagttccgggctgccctgcagctggtggtggacccaggcgacccccgctcctacctggacaacttcatcaagattggcgagggctccacgggcatcgtgtgcatcgccaccgtgcgcagctcgggcaagctggtggccgtcaagaagatggacctgcgcaagcagcagaggcgcgagctgctcttcaacgaggtggtaatcatgagggactaccagcacgagaatgtggtggagatgtacaacagctacctggtgggggacgagctctgggtggtcatggagttcctggaaggaggcgccctcaccgacatcgtcacccacaccaggatgaacgaggagcagatcgcggccgtgtgccttgcagtgctgcaggccctgtcggtgctccacgcccagggcgtcatccaccgggacatcaagagcgactcgatcctgctgacccatgatggcagggtgaagctgtcagactttgggttctgcgcccaggtgagcaaggaagtgccccgaaggaagtcgctggtcggcacgccctactggatggccccagagctcatctcccgccttccctacgggccagaggtagacatctggtcgctggggataatggtgattgagatggtggacggagagcccccctacttcaacgagccacccctcaaagccatgaagatgattcgggacaacctgccaccccgactgaagaacctgcacaaggtgtcgccatccctgaagggcttcctggaccgcctgctggtgcgagaccctgcccagcgggccacggcagccgagctgctgaagcacccattcctggccaaggcagggccgcctgccagcatcgtgcccctcatgcgccagaaccgcaccagatgaggcccagcgcccttcccctcaaccaaagagccccccgggtcacccccgccccactgaggccagtagggggccaggcctcccactcctcccagcccgggagatgctccgcgtggcaccaccctccttgctgggggtagatgagaccctactactgaactccagttttgatctcgtgacttttagaaaaacacagggactcgtgggagcaagcgaggctcccaggacccccaccctctgggacaggccctcccccatgttcttctgtctccaggaagggcagcggccctcccatcactggaagtctgcagtgggggtcgctgggggtggagagaacactaagaggtgaacatgtatgagtgtgtgcacgcgtgtgagtgtgcatgtgtgtgtgtgcaaaggtccagccaccccgtcctccagcctgcaaggggtgtctggcgccttgcctgacacccagccccctctccccctgagccattgtgggggtcgatcatgaatgtccgaagagtggccttttcccgtagccctgcgccccctttctgtggctggatggggagacaggtcagggccccccaccctctccagcccctgcagcaaatgactactgcacctggacagcctcctcttttctagaagtctatttatattgtcattttataacactctagcccctgcccttattgggggacagatggtccctgtcctgcggggtggccctggcagaaccactgcctgaagaaccaggttcctgcccggtcagcgcagccccagcccgcccacccctgcctcgagttagttttacaattaaaacattgtcttgtt

SEQ ID NO: 163258 - DNA, 1715 bp, Homo sapiens
  Payload ID: 12168
  Gene Symbol: PAK4
  Gene Name: p21 protein (Cdc42/Rac)-activated kinase 4
  Uniprot ID: O96013
  ENST ID: ENST00000599470
  CDS Start-End: 161-1477
ccccggatgttcgttggggattcaacatggcggcgggagtgtccgcggtggtggcggtgcaagagagctgagggaggcgcgagggcgcggagttccaggtcgagcagttaggccgcgagcgactgcggcgccgagccggccgcaccgagtccccggcaccatgtttgggaagaggaagaagcgggtggagatctccgcgccgtccaacttcgagcaccgcgtgcacacgggcttcgaccagcacgagcagaagttcacggggctgccccgccagtggcagagcctgatcgaggagtcggctcgccggcccaagcccctcgtcgaccccgcctgcatcacctccatccagcccggggcccccaagggggagcctcatgacgtggcccctaacgggccatcagcggggggcctggccatcccccagtcctcctcctcctcctcccggcctcccacccgagcccgaggtgcccccagccctggagtgctgggaccccacgcctcagagccccagctggcccctccagcctgcacccccgccgcccctgctgttcctgggccccctggcccccgctcaccacagcgggagccacagcgagtatcccatgagcagttccgggctgccctgcagctggtggtggacccaggcgacccccgctcctacctggacaacttcatcaagattggcgagggctccacgggcatcgtgtgcatcgccaccgtgcgcagctcgggcaagctggtggccgtcaagaagatggacctgcgcaagcagcagaggcgcgagctgctcttcaacgaggtggtaatcatgagggactaccagcacgagaatgtggtggagatgtacaacagctacctggtgggggacgagctctgggtggtcatggagttcctggaaggaggcgccctcaccgacatcgtcacccacaccaggatgaacgaggagcagatcgcggccgtgtgccttgcagtgctgcaggccctgtcggtgctccacgcccagggcgtcatccaccgggacatcaagagcgactcgatcctgctgacccatgatggcagggtgaagctgtcagactttgggttctgcgcccaggtgagcaaggaagtgccccgaaggaagtcgctggtcggcacgccctactggatggccccagagctcatctcccgccttccctacgggccagaggtagacatctggtcgctggggataatggtgattgagatggtggacggagagcccccctacttcaacgagccacccctcaaagccatgaagatgattcgggacaacctgccaccccgactgaagaacctgcacaaggtgtcgccatccctgaagggcttcctggaccgcctgctggtgcgagaccctgcccagcgggccacggcagccgagctgctgaagcacccattcctggccaaggcagggccgcctgccagcatcgtgcccctcatgcgccagaaccgcaccagatgaggcccagcgcccttcccctcaaccaaagagccccccgggtcacccccgccccactgaggccagtagggggccaggcctcccactcctcccagcccgggagatgctccgcgtggcaccaccctccttgctgggggtagatgagaccctactactgaactccagttttgatctcgtgacttttagaaaaacacagggactcgtgggagcaagcgaggctcccaggacccccaccctctgg

SEQ ID NO: 163259 - DNA, 5735 bp, Homo sapiens
  Payload ID: 12168
  Gene Symbol: PAK4
  Gene Name: p21 protein (Cdc42/Rac)-activated kinase 4
  Uniprot ID: O96013
  ENST ID: ENST00000599386
  CDS Start-End: 182-1498
ggcggtgcaagagagctgagggaggcgcgagggcgcggagttccaggtcgagcagttaggccgcgagcgactgcggcgccgagccgatgagtaacccgaagcccctagaggagtggtcacctgcctgagggcacttctgtcccaccagcatcagaccaggccgcaccgagtccccggcaccatgtttgggaagaggaagaagcgggtggagatctccgcgccgtccaacttcgagcaccgcgtgcacacgggcttcgaccagcacgagcagaagttcacggggctgccccgccagtggcagagcctgatcgaggagtcggctcgccggcccaagcccctcgtcgaccccgcctgcatcacctccatccagcccggggcccccaagggggagcctcatgacgtggcccctaacgggccatcagcggggggcctggccatcccccagtcctcctcctcctcctcccggcctcccacccgagcccgaggtgcccccagccctggagtgctgggaccccacgcctcagagccccagctggcccctccagcctgcacccccgccgcccctgctgttcctgggccccctggcccccgctcaccacagcgggagccacagcgagtatcccatgagcagttccgggctgccctgcagctggtggtggacccaggcgacccccgctcctacctggacaacttcatcaagattggcgagggctccacgggcatcgtgtgcatcgccaccgtgcgcagctcgggcaagctggtggccgtcaagaagatggacctgcgcaagcagcagaggcgcgagctgctcttcaacgaggtggtaatcatgagggactaccagcacgagaatgtggtggagatgtacaacagctacctggtgggggacgagctctgggtggtcatggagttcctggaaggaggcgccctcaccgacatcgtcacccacaccaggatgaacgaggagcagatcgcggccgtgtgccttgcagtgctgcaggccctgtcggtgctccacgcccagggcgtcatccaccgggacatcaagagcgactcgatcctgctgacccatgatggcagggtgaagctgtcagactttgggttctgcgcccaggtgagcaaggaagtgccccgaaggaagtcgctggtcggcacgccctactggatggccccagagctcatctcccgccttccctacgggccagaggtagacatctggtcgctggggataatggtgattgagatggtggacggagagcccccctacttcaacgagccacccctcaaagccatgaagatgattcgggacaacctgccaccccgactgaagaacctgcacaaggtgtcgccatccctgaagggcttcctggaccgcctgctggtgcgagaccctgcccagcgggccacggcagccgagctgctgaagcacccattcctggccaaggcagggccgcctgccagcatcgtgcccctcatgcgccagaaccgcaccagatgaggcccagcgcccttcccctcaaccaaagagccccccgggtcacccccgccccactgaggccagtagggggccaggcctcccactcctcccagcccgggagatgctccgcgtggcaccaccctccttgctgggggtagatgagaccctactactgaactccagttttgatctcgtgacttttagaaaaacacagggactcgtgggagcaagcgaggctcccaggacccccaccctctgggacaggccctcccccatgttcttctgtctccaggaagggcagcggccctcccatcactggaagtctgcagtgggggtcgctgggggtggagagaacactaagaggtgaacatgtatgagtgtgtgcacgcgtgtgagtgtgcatgtgtgtgtgtgcaaaggtccagccaccccgtcctccagcctgcaaggggtgtctggcgccttgcctgacacccagccccctctccccctgagccattgtgggggtcgatcatgaatgtccgaagagtggccttttcccgtagccctgcgccccctttctgtggctggatggggagacaggtcagggccccccaccctctccagcccctgcagcaaatgactactgcacctggacagcctcctcttttctagaagtctatttatattgtcattttataacactctagcccctgcccttattgggggacagatggtccctgtcctgcggggtggccctggcagaaccactgcctgaagaaccaggttcctgcccggtcagcgcagccccagcccgcccacccctgcctcgagttagttttacaattaaaacattgtcttgttttgtgtctgtgtgcgatgtgtggggggcagggggccctgcccggctgtcttgggtgggaatttgcagggagagggtctggatctgggagcaaaccacgattccagccaaggcagggcaagggtggggtggggagtggggagttcaggtcatagcagccagtaagctcccccagcctgccactccccagaatggggcaggattgtccccacccctggaagcagccagtttgccacagtccatgtgcagactgatcccagtttgccaaatctgcaatttcctggaaccttttaaaggctgtcttgagcgcgtttggtgagtaggagctaacccaagttagtaaattgaaggccatttggcaaattggtcagtgggcagatgggcttttggggattgactgaggctgactggcctggagctgctggcttcggagagacaccctgtgaagtgtgtccttccacgcaggagcccagagccgagcccacgctggggggaatctgactggcatggaggtggccatgccaccatcgctgctgcagctgcatcctggcactttgcgcctcaggccctgttgggctccactttctgcatcctccccagcccccagggaggcagtggagtggggagagagccaggagtgagcctccgtccccaaagccagccaggcgtcatcagcaccagagacctcagcctggtcctctcgggaagtgagtggccagggcagagattccaggttagtccacgcctcccacccttcacaggtcctgaccccaagaatcagagcactgtgtgtgtggcagggcctatgccaagtgcaaacacagcctagatggatcatcacagagtgaaacccagcggtgcaagcagctgtgctctctgcgatgtattggaggcttaggtgaggtggatgcctttctggaaaaaaaaaaaatgctaacattggcaaaagaagaaatagaaaacaagaccaaaataactgtctcctcactgcacacacactccagaataaataaaaggtttcaggcttgaatgcactttcaaatgagattttttttttttttttgagacggagtatcgctctgtcgcccaggctggagtgcagtggcacgatcttggctcactgcaacttctgcctcctgggttcaagcgattctcctgcctcagcctcccaagtagctgggattacaggcgcttgccaccacgccaggctaattttttgtattttgagtagagactggatttcgccatcttggccagactggtcttgaactcctgacctcgtgatccacccacctcagcctcccaaagtgctgggattacaggcatgagccaccatgcctggcctcaaatgaggtttaccagactttgaaggagcaggtaattccttctaccttgtgaacaagttgttccagaaagatagcagctcaggaggcctctgtgaccatggttccagacccagataaggacggcaaagaacagagcatctcagaaacgcaaggctcacagccagggtgcccggcgaccccacgggcactgagaacagctagctctaggagctccactctcctgctgaagaaaccacgggctcagagacggggagctccctcgcccagccacatctgtgaccccacggtaactctgctggttttggtgccttcagtcactcactgcaggtttgttttgttttgttttgttttgagtttttttgttttttgttttttgtttttagagacaagatgttgctatgttgcctaggctggtttcgaactcctggcctcaagggatcctccctccttggccccgcaaagtgctgggattacaggcgtgagccaccgtgcccagcccgctcactgcagtttgaaggcatggctttgggtggcgtggggtgaaagctgcccgaggccccgttcctccccacgtggctgcctcctgccagagccagtcaggaaaacagaccccaactagagttgtttcaaatggcagggatttggtaccggtggttggatcatgacaaagctctgagaaggctggaggagccacagagtgccaagtgcccagcaatcattagaggaaggaggctgctgccacctgtgtggctagaggaacagaggggccaatggcattccccaaaccccactctcgcctctgtctggccagagcagaatggcttcttccagcttcccaccctggactcccacccaggagcctcctcctggcagacccttcctgaccccaccggcccggggggtctacagatccatgtttcaggcgtccgcctggagcggaacaggggagtgcttaggacaagggtggtgccagaggatccactctgcccacatttagttgaccagctgaggcactccacgggaatgaatgactctcgacaggtgccggaggtgaggaggggcccggaggcccaggaggggcacagggatggattcgtccgcctgggggctggaggtgtgtttacagagccccaaaataaacaatgcaaccaggtcagaccagcggttctcacagtgtggttcccagaccagcagcatcactgggagcttactggacacgcaaataaatccctgtgtgccaccccagctgcatcagatgctggtggggcccagtgatctgtatttaacacaccctccgggggatgccggtgcccactcacgtttgagaacccctgcgatccacgactgccctcccgtgtaaaaggcccacctctgtgggactccaagtcatcagcaccctagggtccttccgtctttttccttcctcctgggacacctgcctctcccatgtcgtattagagaattccttatgctcccaagtgggcacggggagaggaaggcactcctctttaaggaccgacccagaggttttgccattgcttcactggccagagcttagtcacgcagcctcacccagaggcaagggaggttggaaaatgtagtgtttgtgtgtgtctaacacaaattctattaccatgcagtcaggattctccactcttgctctttcattagatttgctgggcttcaccctggactttctgatttagtgacagaacagagaacccagaggcagacccagatgtgtacaagggcttcatatacaatcaggagatttaataatcatgctaggggccgggtgcagtggctcacgcctgtaatcccaagcactttggggagccgaggcaggcagatcacttgaggtcaggagtttgagaccagcctgggcaacaaagtgagaccctgtctctactaaaaataacaaaaattagccgggcgtggtggtgggcgcctgtaatcccagctcctcgggtggctgaggcatgagaatcacttgaacccaggaggcagaggtttcagtgagctgagatcacatcactgcactccagcctgggtgacagagtgagattctgtc

SEQ ID NO: 163260 - DNA, 564 bp, Homo sapiens
  Payload ID: 12168
  Gene Symbol: PAK4
  Gene Name: p21 protein (Cdc42/Rac)-activated kinase 4
  ENST ID: ENST00000602004
  CDS Start-End: 19-564
gaggggggaaagccccggatgttcgttggggattcaacatggcggcgggagtgtccgcggtggtggcggtgcaagagagctgagggaggcgcgagggcgcggagttccaggccgcaccgagtccccggcaccatgtttgggaagaggaagaagcgggtggagatctccgcgccgtccaacttcgagcaccgcgtgcacacgggcttcgaccagcacgagcagaagttcacggggctgccccgccagtggcagagcctgatcgaggagtcggctcgccggcccaagcccctcgtcgaccccgcctgcatcacctccatccagcccggggcccccaagggggagcctcatgacgtggcccctaacgggccatcagcggggggcctggccatcccccagtcctcctcctcctcctcccggcctcccacccgagcccgaggtgcccccagccctggagtgctgggaccccacgcctcagagccccagctggcccctccagcctgcacccccgccgcccctgctgttcctgggccccctggcccccgctcaccacagcgggagccacag

SEQ ID NO: 163261 - DNA, 633 bp, Homo sapiens
  Payload ID: 12168
  Gene Symbol: PAK4
  Gene Name: p21 protein (Cdc42/Rac)-activated kinase 4
  ENST ID: ENST00000597715
  CDS Start-End: 1-448
aatcatgagggactaccagcacgagaatgtggtgaagctgtcagactttgggttctgcgcccaggtgagcaaggaagtgccccgaaggaagtcgctggtcggcacgccctactggatggccccagagctcatctcccgccttccctacgggccagaggtagacatctggtcgctggggataatggtgattgagatggtggacggagagcccccctacttcaacgagccacccctcaaagccatgaagatgattcgggacaacctgccaccccgactgaagaacctgcacaaggtgtcgccatccctgaagggcttcctggaccgcctgctggtgcgagaccctgcccagcgggccacggcagccgagctgctgaagcacccattcctggccaaggcagggccgcctgccagcatcgtgcccctcatgcgccagaaccgcaccagatgaggcccagcgcccttcccctcaaccaaagagccccccgggtcacccccgccccactgaggccagtagggggccaggcctcccactcctcccagcccgggagatgctccgcgtggcaccaccctccttgctgggggtagatgagaccctactactgaactccagttttgatctcgtgacttttagaa

SEQ ID NO: 163262 - DNA, 714 bp, Homo sapiens
  Payload ID: 12168
  Gene Symbol: PAK4
  Gene Name: p21 protein (Cdc42/Rac)-activated kinase 4
  ENST ID: ENST00000593480
  CDS Start-End: 321-714
ggattcaacatggcggcgggagtgtccgcggtggtggcggtgcaagagagctgagggaggcgcgagggcgcggagttccaggtcgagcagttaggccgcgagcgactgcggcgccgagccgccttcctgctgcccaccccgcgtccctccagactgggtcccgtgctcccgtcccccagccctgaccaccctgggcagctgctgcatggggacagatgagtaacccgaagcccctagaggagtggtcacctgcctgagggcacttctgtcccaccagcatcagaccaggtgtgtgcaggccgcaccgagtccccggcaccatgtttgggaagaggaagaagcgggtggagatctccgcgccgtccaacttcgagcaccgcgtgcacacgggcttcgaccagcacgagcagaagttcacggggctgccccgccagtggcagagcctgatcgaggagtcggctcgccggcccaagcccctcgtcgaccccgcctgcatcacctccatccagcccggggcccccaagaccatcgtgcggggcagcaaaggtgccaaagatggggccctcacgctgctgctggacgagtttgagaacatgtcggtgacacgctccaactccctgcggagagacagcccgccgccgcccgcccgtgcccgccaggaaaatgggatgccagaggagccggccaccacggccagagggggcccagggaagg

SEQ ID NO: 163263 - DNA, 534 bp, Homo sapiens
  Payload ID: 12168
  Gene Symbol: PAK4
  Gene Name: p21 protein (Cdc42/Rac)-activated kinase 4
  ENST ID: ENST00000599657
  CDS Start-End: 255-534
atagagcccaggcagccctcctcggtgggtgcccatgttgagggcctggggagccctggatctactctgctttcccagctggaagcctgtctgtccacaggcccgccccattgagggtggcccaggaagtgggaaagagcgtggtggagatgagtaacccgaagcccctagaggagtggtcacctgcctgagggcacttctgtcccaccagcatcagaccaggtgtgtgcaggccgcaccgagtccccggcaccatgtttgggaagaggaagaagcgggtggagatctccgcgccgtccaacttcgagcaccgcgtgcacacgggcttcgaccagcacgagcagaagttcacggggctgccccgccagtggcagagcctgatcgaggagtcggctcgccggcccaagcccctcgtcgaccccgcctgcatcacctccatccagcccggggcccccaagggggagcctcatgacgtggcccctaacgggccatcagcggggggcctggccatcccccagtcctcctcctcctcct

SEQ ID NO: 163264 - DNA, 3865 bp, Homo sapiens
  Payload ID: 12169
  Gene Symbol: PAK6
  Gene Name: p21 protein (Cdc42/Rac)-activated kinase 6
  Uniprot ID: Q9NQU5
  ENST ID: ENST00000260404
  CDS Start-End: 427-2472
gtgccgtccccctgctggggacagcagctgggtccagcagagagctggctgggggcttgacaggagtttatcctaactgatgctgggtgggcgcaggccctgagatgggcgtcagggagaggggacgccagacacacggcctgagcagggtgaggagcagctgccagccccggcaggcccaggccctgtctgggtgcacaggacagagacacagcaagatgcccagggagtgccgcttcctgggctagagacaagcaccagcctgcagtggagaacgcaggaccccgctgcccagaaggagcagccacggcctgcggaggactggcccagcaaggtcccaggtcttccctctcctcagcgcctaagagagaggcccagtgcgggtgaggagtcgcgaggaagaggcggaaggcgccggaaggcaccatgttccgcaagaaaaagaagaaacgccctgagatctcagcgccacagaacttccagcaccgtgtccacacctccttcgaccccaaagaaggcaagtttgtgggcctccccccacaatggcagaacatcctggacacactgcggcgccccaagcccgtggtggacccttcgcgaatcacacgggtgcagctccagcccatgaagacagtggtgcggggcagcgcgatgcctgtggatggctacatctcggggctgctcaacgacatccagaagttgtcagtcatcagctccaacaccctgcgtggccgcagccccaccagccggcggcgggcacagtccctggggctgctgggggatgagcactgggccaccgacccagacatgtacctccagagcccccagtctgagcgcactgacccccacggcctctacctcagctgcaacgggggcacaccagcaggccacaagcagatgccgtggcccgagccacagagcccacgggtcctgcccaatgggctggctgcaaaggcacagtccctgggccccgccgagtttcagggtgcctcgcagcgctgtctgcagctgggtgcctgcctgcagagctccccaccaggagcctcgccccccacgggcaccaataggcatggaatgaaggctgccaagcatggctctgaggaggcccggccacagtcctgcctggtgggctcagccacaggcaggccaggtggggaaggcagccctagccctaagacccgggagagcagcctgaagcgcaggctattccgaagcatgttcctgtccactgctgccacagcccctccaagcagcagcaagccaggccctccaccacagagcaagcccaactcctctttccgaccgccgcagaaagacaaccccccaagcctggtggccaaggcccagtccttgccctcggaccagccggtggggaccttcagccctctgaccacttcggataccagcagcccccagaagtccctccgcacagccccggccacaggccagcttccaggccggtcttccccagcgggatccccccgcacctggcacgcccagatcagcaccagcaacctgtacctgccccaggaccccacggttgccaagggtgccctggctggtgaggacacaggtgttgtgacacatgagcagttcaaggctgcgctcaggatggtggtggaccagggtgacccccggctgctgctggacagctacgtgaagattggcgagggctccaccggcatcgtctgcttggcccgggagaagcactcgggccgccaggtggccgtcaagatgatggacctcaggaagcagcagcgcagggagctgctcttcaacgaggtggtgatcatgcgggactaccagcacttcaacgtggtggagatgtacaagagctacctggtgggcgaggagctgtgggtgctcatggagttcctgcagggaggagccctcacagacatcgtctcccaagtcaggctgaatgaggagcagattgccactgtgtgtgaggctgtgctgcaggccctggcctacctgcatgctcagggtgtcatccaccgggacatcaagagtgactccatcctgctgaccctcgatggcagggtgaagctctcggacttcggattctgtgctcagatcagcaaagacgtccctaagaggaagtccctggtgggaaccccctactggatggctcctgaagtgatctccaggtctttgtatgccactgaggtggatatctggtctctgggcatcatggtgattgagatggtagatggggagccaccgtacttcagtgactccccagtgcaagccatgaagaggctccgggacagccccccacccaagctgaaaaactctcacaaggtctccccagtgctgcgagacttcctggagcggatgctggtgcgggacccccaagagagagccacagcccaggagctcctagaccaccccttcctgctgcagacagggctacctgagtgcctggtgcccctgatccagctctaccgaaagcagacctccacctgctgagcccaccccaagtatgcctgccacctacgcccacaggcagggcacactgggcagccagcctgccggcaggacttgcctgcctcctcctctcagtattctctccaaagattgaaatgtgaagccccagccccaccctctgcccttcagcctactgggccaggccggacctgccccctcagtgtctctccctcccgagtccccagatggagacccctttctacaggatgaccccttgatatttgcacagggatatttctaagaaacgcagaggccagcgttcctggcctctgcagccaacacagtagaaaaggctgctgtggttttttaaaggcagttgtccactagtgtcctaggccactgcagagggcagactgctggtctccacagatacctgctgttctcagctccagcttcaaacctcgagtctcgagagggccacggggtggtttttatgaccggaatcccgcttcctccctcacgtctgatgtcctgaaggtgcagtcccacctgtacagcccctccccgcccagaactgtgaatggcctgctccaggccatggctgggggcagggagtgaggggacaatttctgagtgaaagagaaagaatggggtcggtggtgaaggtgctctcactttacagaatggagagaacatcgtgtgtgtgtgtgtgtgtgtgtgtgtgtgtgtgtgtgtgtaaggggaggaaagccaccttgacagcccaggtccctccaggtcacccacagccagtttcaggaaggctgcccctctctcccactaagttctggcctgaagggacctgctttcttggcctggcttccacctctccactcctgtgtctacctggccagtggagtggtccatgctaagtctaacactcctgggagctcaggaggcttctgagcttctcctgtactgtgcatcgtgagggccagagacaggaatgtaaggattggcaactgtgttacctttcaagtttatctcaataaccaggtcatcagggacccattgttctcttcagaaccctatctgggagagaaggcgaaccacctccgggtttccatcatgtcaaggtcacaggcatccatgtgtgcaaaccatctgccccagctgcctccacagactgctgtctccttgtcctcctcggccctgccccacttcagggctgctgtgagatggaattccaggaaagaacttcaggtgtctggaccctttctatctagataatatttttagattcttctgctccctagtgacctacctgggggcaaagaaattgcaaggacttttttttaagggtcagagttttcaaaacaaaagcatcttccctagaaatttttgtgaattgtttgcacttgtgcctgttttaaattaaattgagtgttcaaagcca

SEQ ID NO: 163265 - DNA, 4215 bp, Homo sapiens
  Payload ID: 12169
  Gene Symbol: PAK6
  Gene Name: p21 protein (Cdc42/Rac)-activated kinase 6
  Uniprot ID: Q9NQU5
  ENST ID: ENST00000455577
  CDS Start-End: 913-2823
aaacgagcaggtcgatgcctgaggatttaatggagaaatcccaaagtgagccggggcgcgcggtggaggaggggcgcgccgcagccggggccgctgggccctgatgggcgggagcggggtggagcggcctcgcctgccaggcagccctgggcgcggggctcggcggccacactctggagacagccacggtccaggcaggtgggggagggcgctgctcccgtcctgatgtgccaggagccgccagcagccatccaggtgactaagccggcccactagcactgagtcaccgcccgcctcgagctgttcttgcttctcctttgcatctgattattttgggagctggaaacttggagctgcacctgagtcccgccccttctagctctcccctccctaccttgggctccaggaagatgggacttgctgtgagtctgctgccaccccctaaagatatggaagacgctgtgggggccagaagtgcccggggggctgtggcagcaggcagagtgcaatagcagatatggtggtcaggctgcctgtgtgtgtcctctggaggtgttgggacagaagggcagtcttgtccgagctgactggagtcctcccgggctggctctgaactcatctcccacggggatgtttcggtaaaggagtggcttctggggtcggagtggcatttggagagcgaggctggattggcttaggctggcctgggcagggagtgccgcttcctgggctagagacaagcaccagcctgcagtggagaacgcaggaccccgctgcccagaaggagcagccacggcctgcggaggactggcccagcaaggtcccaggtcttccctctcctcagcgcctaagagagaggcccagtgcgggtgaggagtcgcgaggaagaggcggaaggcgccggaaggcaccatgttccgcaagaaaaagaagaaacgccctgagatctcagcgccacagaacttccagcaccgtgtccacacctccttcgaccccaaagaaggcaagtttgtgggcctccccccacaatggcagaacatcctggacacactgcggcgccccaagcccgtggtggacccttcgcgaatcacacgggtgcagctccagcccatgaagacagtggtgcggggcagcgcgatgcctgtggatggctacatctcggggctgctcaacgacatccagaagttgtcagtcatcagctccaacaccctgcgtggccgcagccccaccagccggcggcgggcacagtccctggggctgctgggggatgagcactgggccaccgacccagacatgtacctccagagcccccagtctgagcgcactgacccccacggcctctacctcagctgcaacgggggcacaccagcaggccacaagcagatgccgtggcccgagccacagagcccacgggtcctgcccaatgggctggctgcaaaggcacagtccctgggccccgccgagtttcagggtgcctcgcagcgctgtctgcagctgggtgcctgcctgcagagctccccaccaggagcctcgccccccacgggcaccaataggcatggaatgaaggctgccaagcatggctctgaggaggcccggccacagtcctgcctggtgggctcagccacaggcaggccaggtggggaaggcagccctagccctaagacccgggagagcagcctgaagcgcaggctattccgaagcatgttcctgtccactgctgccacagcccctccaagcagcagcaagccaggccctccaccacagagcaagcccaactcctctttccgaccgccgcagaaagacaaccccccaagcctggtggccaaggcccagtccttgccctcggaccagccggtggggaccttcagccctctgaccacttcggataccagcagcccccagaagtccctccgcacagccccggccacaggccagcttccaggccggtcttccccagcgggatccccccgcacctggcacgcccagatcagcaccagcaacctgtacctgccccaggaccccacggttgccaagggtgccctggctggtgaggacacaggtgttgtgacacatgagcagttcaaggctgcgctcaggatggtggtggaccagggtgacccccggctgctgctggacagctacgtgaagattggcgagggctccaccggcatcgtctgcttggcccgggagaagcactcgggccgccaggtggccgtcaagatgatggacctcaggaagcagcagcgcagggagctgctcttcaacgaggtggtgatcatgcgggactaccagcacttcaacgtggtggagatgtacaagagctacctggtgggcgaggagctgtgggtgctcatggagttcctgcagggaggagccctcacagacatcgtctcccaagtcaggctgaatgaggagcagattgccactgtgtgtgaggctgtgctgcaggccctggcctacctgcatgctcagggtgtcatccaccgggacatcaagagtgactccatcctgctgaccctcgatggcagggtgaagctctcggacttcggattctgtgctcagatcagcaaagacgtccctaagaggaagtccctggtgggaaccccctactggatggctcctgaagtgatctccaggtctttgtatgccactgaggtctccccagtgctgcgagacttcctggagcggatgctggtgcgggacccccaagagagagccacagcccaggagctcctagaccaccccttcctgctgcagacagggctacctgagtgcctggtgcccctgatccagctctaccgaaagcagacctccacctgctgagcccaccccaagtatgcctgccacctacgcccacaggcagggcacactgggcagccagcctgccggcaggacttgcctgcctcctcctctcagtattctctccaaagattgaaatgtgaagccccagccccaccctctgcccttcagcctactgggccaggccggacctgccccctcagtgtctctccctcccgagtccccagatggagacccctttctacaggatgaccccttgatatttgcacagggatatttctaagaaacgcagaggccagcgttcctggcctctgcagccaacacagtagaaaaggctgctgtggttttttaaaggcagttgtccactagtgtcctaggccactgcagagggcagactgctggtctccacagatacctgctgttctcagctccagcttcaaacctcgagtctcgagagggccacggggtggtttttatgaccggaatcccgcttcctccctcacgtctgatgtcctgaaggtgcagtcccacctgtacagcccctccccgcccagaactgtgaatggcctgctccaggccatggctgggggcagggagtgaggggacaatttctgagtgaaagagaaagaatggggtcggtggtgaaggtgctctcactttacagaatggagagaacatcgtgtgtgtgtgtgtgtgtgtgtgtgtgtgtgtgtgtgtgtaaggggaggaaagccaccttgacagcccaggtccctccaggtcacccacagccagtttcaggaaggctgcccctctctcccactaagttctggcctgaagggacctgctttcttggcctggcttccacctctccactcctgtgtctacctggccagtggagtggtccatgctaagtctaacactcctgggagctcaggaggcttctgagcttctcctgtactgtgcatcgtgagggccagagacaggaatgtaaggattggcaactgtgttacctttcaagtttatctcaataaccaggtcatcagggacccattgttctcttcagaaccctatctgggagagaaggcgaaccacctccgggtttccatcatgtcaaggtcacaggcatccatgtgtgcaaaccatctgccccagctgcctccacagactgctgtctccttgtcctcctcggccctgccccacttcagggctgctgtgagatggaattccaggaaagaacttcaggtgtctggaccctttctatctagataatatttttagattcttctgctccctagtgacctacctgggggcaaagaaattgcaaggacttttttttaagggtcagagttttcaaaacaaaagcatcttccctagaaatttttgtgaattgtttgcacttgtgcctgttttaaattaaattgagtgttcaaagcc

SEQ ID NO: 163266 - DNA, 2540 bp, Homo sapiens
  Payload ID: 12169
  Gene Symbol: PAK6
  Gene Name: p21 protein (Cdc42/Rac)-activated kinase 6
  Uniprot ID: Q9NQU5
  ENST ID: ENST00000542403
  CDS Start-End: 112-2157
ggaggactggcccagcaaggtcccaggtcttccctctcctcagcgcctaagagagaggcccagtgcgggtgaggagtcgcgaggaagaggcggaaggcgccggaaggcaccatgttccgcaagaaaaagaagaaacgccctgagatctcagcgccacagaacttccagcaccgtgtccacacctccttcgaccccaaagaaggcaagtttgtgggcctccccccacaatggcagaacatcctggacacactgcggcgccccaagcccgtggtggacccttcgcgaatcacacgggtgcagctccagcccatgaagacagtggtgcggggcagcgcgatgcctgtggatggctacatctcggggctgctcaacgacatccagaagttgtcagtcatcagctccaacaccctgcgtggccgcagccccaccagccggcggcgggcacagtccctggggctgctgggggatgagcactgggccaccgacccagacatgtacctccagagcccccagtctgagcgcactgacccccacggcctctacctcagctgcaacgggggcacaccagcaggccacaagcagatgccgtggcccgagccacagagcccacgggtcctgcccaatgggctggctgcaaaggcacagtccctgggccccgccgagtttcagggtgcctcgcagcgctgtctgcagctgggtgcctgcctgcagagctccccaccaggagcctcgccccccacgggcaccaataggcatggaatgaaggctgccaagcatggctctgaggaggcccggccacagtcctgcctggtgggctcagccacaggcaggccaggtggggaaggcagccctagccctaagacccgggagagcagcctgaagcgcaggctattccgaagcatgttcctgtccactgctgccacagcccctccaagcagcagcaagccaggccctccaccacagagcaagcccaactcctctttccgaccgccgcagaaagacaaccccccaagcctggtggccaaggcccagtccttgccctcggaccagccggtggggaccttcagccctctgaccacttcggataccagcagcccccagaagtccctccgcacagccccggccacaggccagcttccaggccggtcttccccagcgggatccccccgcacctggcacgcccagatcagcaccagcaacctgtacctgccccaggaccccacggttgccaagggtgccctggctggtgaggacacaggtgttgtgacacatgagcagttcaaggctgcgctcaggatggtggtggaccagggtgacccccggctgctgctggacagctacgtgaagattggcgagggctccaccggcatcgtctgcttggcccgggagaagcactcgggccgccaggtggccgtcaagatgatggacctcaggaagcagcagcgcagggagctgctcttcaacgaggtggtgatcatgcgggactaccagcacttcaacgtggtggagatgtacaagagctacctggtgggcgaggagctgtgggtgctcatggagttcctgcagggaggagccctcacagacatcgtctcccaagtcaggctgaatgaggagcagattgccactgtgtgtgaggctgtgctgcaggccctggcctacctgcatgctcagggtgtcatccaccgggacatcaagagtgactccatcctgctgaccctcgatggcagggtgaagctctcggacttcggattctgtgctcagatcagcaaagacgtccctaagaggaagtccctggtgggaaccccctactggatggctcctgaagtgatctccaggtctttgtatgccactgaggtggatatctggtctctgggcatcatggtgattgagatggtagatggggagccaccgtacttcagtgactccccagtgcaagccatgaagaggctccgggacagccccccacccaagctgaaaaactctcacaaggtctccccagtgctgcgagacttcctggagcggatgctggtgcgggacccccaagagagagccacagcccaggagctcctagaccaccccttcctgctgcagacagggctacctgagtgcctggtgcccctgatccagctctaccgaaagcagacctccacctgctgagcccaccccaaaaccctatctgggagagaaggcgaaccacctccgggtttccatcatgtcaaggtcacaggcatccatgtgtgcaaaccatctgccccagctgcctccacagactgctgtctccttgtcctcctcggccctgccccacttcagggctgctgtgagatggaattccaggaaagaacttcaggtgtctggaccctttctatctagataatatttttagattcttctgctccctagtgacctacctgggggcaaagaaattgcaaggacttttttttaagggtcagagttttcaaaacaaaagcatcttccctagaaatttttgtgaattgtttgcacttgtgcctgttttaaattaaattgagtgttcaaagcca

SEQ ID NO: 163267 - DNA, 552 bp, Homo sapiens
  Payload ID: 12169
  Gene Symbol: PAK6
  Gene Name: p21 protein (Cdc42/Rac)-activated kinase 6
  ENST ID: ENST00000558183
  CDS Start-End: 331-552
tttttttttttttttttctattttgcctgaagggagtgccgcttcctgggctagagacaagcaccagcctgcagtggagaacgcaggaccccgctgcccagaaggagcagccacggcctgcggaggactggcccagcaaggtcccaggtcttccctctcctcagcgcctaagagagaggcccagtgcgggtgaggagtcgcgaggaagaggcggaaggcgccggaagacaggttttcaccatgttggccaagctggtctcaaactcctgacctcaggtgatccacccgcctcggcctcccagagtactaggattacaggcatgaaccaccatgcccggcccaggcaccatgttccgcaagaaaaagaagaaacgccctgagatctcagcgccacagaacttccagcaccgtgtccacacctccttcgaccccaaagaaggcaagtttgtgggcctccccccacaatggcagaacatcctggacacactgcggcgccccaagcccgtggtggacccttcgcgaatcacacgggtgcagctccagcccatgaag

SEQ ID NO: 163268 - DNA, 571 bp, Homo sapiens
  Payload ID: 12169
  Gene Symbol: PAK6
  Gene Name: p21 protein (Cdc42/Rac)-activated kinase 6
  ENST ID: ENST00000559139
  CDS Start-End: 245-571
ttcgcgtccccgagagggcgcagcagtggggcctgcgagctggggccgggtggccgcgccgggtcggagtgtggctggagaggggccgccccggaagcggtgctgcgcccaacgtccccttctccccgcctgcggaggactggcccagcaaggtcccaggtcttccctctcctcagcgcctaagagagaggcccagtgcgggtgaggagtcgcgaggaagaggcggaaggcgccggaaggcaccatgttccgcaagaaaaagaagaaacgccctgagatctcagcgccacagaacttccagcaccgtgtccacacctccttcgaccccaaagaaggcaagtttgtgggcctccccccacaatggcagaacatcctggacacactgcggcgccccaagcccgtggtggacccttcgcgaatcacacgggtgcagctccagcccatgaagacagtggtgcggggcagcgcgatgcctgtggatggctacatctcggggctgctcaacgacatccagaagttgtcagtcatcagctccaacaccctgcgtggccgcagccccaccagccggcgg

SEQ ID NO: 163269 - DNA, 598 bp, Homo sapiens
  Payload ID: 12169
  Gene Symbol: PAK6
  Gene Name: p21 protein (Cdc42/Rac)-activated kinase 6
  ENST ID: ENST00000559617
  CDS Start-End: 262-598
aaaatcgcggtcaggtgaagccggcgctgcaccaacgtgtaagcgcggcccctcctcggcgttcccgcgccgaggtccctcccgcggagggcgggcccggctcccacgacctcttcgagcgttcctgggcttcccgctccgcaggcctgcggaggactggcccagcaaggtcccaggtcttccctctcctcagcgcctaagagagaggcccagtgcgggtgaggagtcgcgaggaagaggcggaaggcgccggaaggcaccatgttccgcaagaaaaagaagaaacgccctgagatctcagcgccacagaacttccagcaccgtgtccacacctccttcgaccccaaagaaggcaagtttgtgggcctccccccacaatggcagaacatcctggacacactgcggcgccccaagcccgtggtggacccttcgcgaatcacacgggtgcagctccagcccatgaagacagtggtgcggggcagcgcgatgcctgtggatggctacatctcggggctgctcaacgacatccagaagttgtcagtcatcagctccaacaccctgcgtggccgcagccccaccagccggcggcgggcacagt

SEQ ID NO: 163270 - DNA, 553 bp, Homo sapiens
  Payload ID: 12169
  Gene Symbol: PAK6
  Gene Name: p21 protein (Cdc42/Rac)-activated kinase 6
  ENST ID: ENST00000558878
  CDS Start-End: 381-553
agaagaggctgggtgagaaaagcactgaggttttcttttcctttttttttttttttttttttctattttgcctgaagggagtgccgcttcctgggctagagacaagcaccagcctgcagtggagaacgcaggaccccgctgcccagaaggagcagccacggcctgcggaggactggcccagcaaggtcccaggtcttccctctcctcagcgcctaagagagaggcccagtgcgggtgaggagtcgcgaggaagaggcggaaggcgccggaagtcaagacaggttttcaccatgttggccaagctggtctcaaactcctgacctcaggtgatccacccgcctcggcctcccagagtactaggattacaggcatgaaccaccatgcccggcccaggcaccatgttccgcaagaaaaagaagaaacgccctgagatctcagcgccacagaacttccagcaccgtgtccacacctccttcgaccccaaagaaggcaagtttgtgggcctccccccacaatggcagaacatcctggacacactgcggcgccccaagcc

SEQ ID NO: 163271 - DNA, 561 bp, Homo sapiens
  Payload ID: 12169
  Gene Symbol: PAK6
  Gene Name: p21 protein (Cdc42/Rac)-activated kinase 6
  ENST ID: ENST00000560806
  CDS Start-End: 502-561
gaacgcaggaccccgctgcccagaaggagcagccacggcctgcggaggactggcccagcaaggtcccaggtcttccctctcctcagcgcctaagagagaggcccagtgcgggtgaggagtcgcgaggaagaggcggaaggcgccggaaggctcttcctgagtgacgaccgtgagaaatatccaaagctcctccgtgagcaggaacagatgctccccctcactgtgcctggagaagctggcagaggtgaattaatccatcccttgtcatctacaaaaatgtcgaggcctacgtaaggcgagtaggccaaggtcacaagccgggacttaggaacaccaagcccaaggtccacgctgagccagcactcgggcttgtggcccaggacttgagccctgtcaagacaggttttcaccatgttggccaagctggtctcaaactcctgacctcaggtgatccacccgcctcggcctcccagagtactaggattacaggcatgaaccaccatgcccggcccaggcaccatgttccgcaagaaaaagaagaaacgccctgagatctcagcg

SEQ ID NO: 163272 - DNA, 1146 bp, Homo sapiens
  Payload ID: 12169
  Gene Symbol: PAK6
  Gene Name: p21 protein (Cdc42/Rac)-activated kinase 6
  ENST ID: ENST00000560669
  CDS Start-End: 293-1146
ccccttctccccgtaagccccgcaaggagcctgccgcctcttgcacctgagccaggagttcagtcgggaggcgggcgcggagcggttcccagcgcctggacgtcagccagtcgcaacacccgcgggaacacttgctacatttgccataatgcatttctgatctgtttccgcgcaggcctgcggaggactggcccagcaaggtcccaggtcttccctctcctcagcgcctaagagagaggcccagtgcgggtgaggagtcgcgaggaagaggcggaaggcgccggaaggcaccatgttccgcaagaaaaagaagaaacgccctgagatctcagcgccacagaacttccagcaccgtgtccacacctccttcgaccccaaagaaggcaagtttgtgggcctccccccacaatggcagaacatcctggacacactgcggcgccccaagcccgtggtggacccttcgcgaatcacacgggtgcagctccagcccatgaagacagtggtgcggggcagcgcgatgcctgtggatggctacatctcggggctgctcaacgacatccagaagttgtcagtcatcagctccaacaccctgcgtggccgcagccccaccagccggcggcgggcacagtccctggggctgctgggggatgagcactgggccaccgacccagacatgtacctccagagcccccagtctgagcgcactgacccccacggcctctacctcagctgcaacgggggcacaccagcaggccacaagcagatgccgtggcccgagccacagagcccacgggtcctgcccaatgggctggctgcaaaggcacagtccctgggccccgccgagtttcagggtgcctcgcagcgctgtctgcagctgggtgcctgcctgcagagctccccaccaggagcctcgccccccacgggcaccaataggcatggaatgaaggctgccaagcatggctctgaggaggcccggccacagtcctgcctggtgggctcagccacaggcaggccaggtggggaaggcagccctagccctaagacccgggagagcagcctgaagcgcaggctattccgaagcatgttcctgtccactgctgccacagcccctccaagcagcagcaagccaggccctccaccacagag

SEQ ID NO: 163273 - DNA, 569 bp, Homo sapiens
  Payload ID: 12169
  Gene Symbol: PAK6
  Gene Name: p21 protein (Cdc42/Rac)-activated kinase 6
  ENST ID: ENST00000560684
  CDS Start-End: 357-569
atcgcggtcaggtgaagccggcgctgcaccaacgtgtaagcgcggcccctcctcggcgttcccgcgccgaggtccctcccgcggagggcgggcccggctcccacgacctcttcgagcgttcctgggcttcccgctccgcaggcctgcggaggactggcccagcaaggtcccaggtcttccctctcctcagcgcctaagagagaggcccagtgcgggtgaggagtcgcgaggaagaggcggaaggcgccggaagacaggttttcaccatgttggccaagctggtctcaaactcctgacctcaggtgatccacccgcctcggcctcccagagtactaggattacaggcatgaaccaccatgcccggcccaggcaccatgttccgcaagaaaaagaagaaacgccctgagatctcagcgccacagaacttccagcaccgtgtccacacctccttcgaccccaaagaaggcaagtttgtgggcctccccccacaatggcagaacatcctggacacactgcggcgccccaagcccgtggtggacccttcgcgaatcacacgggtgcagctccag

SEQ ID NO: 163274 - DNA, 565 bp, Homo sapiens
  Payload ID: 12169
  Gene Symbol: PAK6
  Gene Name: p21 protein (Cdc42/Rac)-activated kinase 6
  ENST ID: ENST00000558055
  CDS Start-End: 200-565
aaaattgccaagcaacgttggagcagctcggcgccccaaacgagcaggtcgatgcctgaggatttaatggagaaatcccaaagcctgcggaggactggcccagcaaggtcccaggtcttccctctcctcagcgcctaagagagaggcccagtgcgggtgaggagtcgcgaggaagaggcggaaggcgccggaaggcaccatgttccgcaagaaaaagaagaaacgccctgagatctcagcgccacagaacttccagcaccgtgtccacacctccttcgaccccaaagaaggcaagtttgtgggcctccccccacaatggcagaacatcctggacacactgcggcgccccaagcccgtggtggacccttcgcgaatcacacgggtgcagctccagcccatgaagacagtggtgcggggcagcgcgatgcctgtggatggctacatctcggggctgctcaacgacatccagaagttgtcagtcatcagctccaacaccctgcgtggccgcagccccaccagccggcggcgggcacagtccctggggctgctgggggatgagcactgg

SEQ ID NO: 163275 - DNA, 891 bp, Homo sapiens
  Payload ID: 12169
  Gene Symbol: PAK6
  Gene Name: p21 protein (Cdc42/Rac)-activated kinase 6
  ENST ID: ENST00000561230
  CDS Start-End: 578-891
aaaaccagctgagaccagcacctgccagatctgaatgcgcagctccaagttctggggggtgggggtgggggtgagccaaggaggtctggcttctctagggcaagggtaggaaggacagcagggaggctcaccctgagcccggcaggcagcccttcctcctcctccccttcagcaaagaaaggcagataaaaacgtgtttttataaatagctccagccccagctgatttgtaaattcagtgggttttttgtgtcaatgacatcaccttcctccccatggcaacccccgacgatatcaaaattgccaagcaacgttggagcagctcggcgccccaaacgagcaggtcgatgcctgaggatttaatggagaaatcccaaaggagtgccgcttcctgggctagagacaagcaccagcctgcagtggagaacgcaggaccccgctgcccagaaggagcagccacggcctgcggaggactggcccagcaaggtcccaggtcttccctctcctcagcgcctaagagagaggcccagtgcgggtgaggagtcgcgaggaagaggcggaaggcgccggaaggcaccatgttccgcaagaaaaagaagaaacgccctgagatctcagcgccacagaacttccagcaccgtgtccacacctccttcgaccccaaagaaggcaagtttgtgggcctccccccacaatggcagaacatcctggacacactgcggcgccccaagcccgtggtggacccttcgcgaatcacacgggtgcagctccagcccatgaagacagtggtgcggggcagcgcgatgcctgtggatggctacatctcggggctgctcaacgacatccagaagttgtcagtcatcagctccaacaccctgcgtggccgcagccc

SEQ ID NO: 163276 - DNA, 560 bp, Homo sapiens
  Payload ID: 12169
  Gene Symbol: PAK6
  Gene Name: p21 protein (Cdc42/Rac)-activated kinase 6
  ENST ID: ENST00000558106
  CDS Start-End: 192-560
acacgcggcccgctcaggtccgggagagtcggcccgcggctctggagcgtgcatctgcgatgccagtgaacgaggcctgcggaggactggcccagcaaggtcccaggtcttccctctcctcagcgcctaagagagaggcccagtgcgggtgaggagtcgcgaggaagaggcggaaggcgccggaaggcaccatgttccgcaagaaaaagaagaaacgccctgagatctcagcgccacagaacttccagcaccgtgtccacacctccttcgaccccaaagaaggcaagtttgtgggcctccccccacaatggcagaacatcctggacacactgcggcgccccaagcccgtggtggacccttcgcgaatcacacgggtgcagctccagcccatgaagacagtggtgcggggcagcgcgatgcctgtggatggctacatctcggggctgctcaacgacatccagaagttgtcagtcatcagctccaacaccctgcgtggccgcagccccaccagccggcggcgggcacagtccctggggctgctgggggatgagcactgggcc

SEQ ID NO: 163277 - DNA, 4020 bp, Homo sapiens
  Payload ID: 12169
  Gene Symbol: PAK6
  Gene Name: p21 protein (Cdc42/Rac)-activated kinase 6
  Uniprot ID: Q9NQU5
  ENST ID: ENST00000560346
  CDS Start-End: 584-2629
attttgggagctggaaacttggagctgcacctgagtcccgccccttctagctctcccctccctaccttgggctccaggaagatgggacttgctgtgagtctgctgccaccccctaaagatatggaagacgctgtgggggccagaagtgcccggggggctgtggcagcaggcagagtgcaatagcagatatggtggtcaggctgcctgtgtgtgtcctctggaggtgttgggacagaagggcagtcttgtccgagctgactggagtcctcccgggctggctctgaactcatctcccacggggatgtttcggtaaaggagtggcttctggggtcggagtggcatttggagagcgaggctggattggcttaggctggcctgggcagggagtgccgcttcctgggctagagacaagcaccagcctgcagtggagaacgcaggaccccgctgcccagaaggagcagccacggcctgcggaggactggcccagcaaggtcccaggtcttccctctcctcagcgcctaagagagaggcccagtgcgggtgaggagtcgcgaggaagaggcggaaggcgccggaaggcaccatgttccgcaagaaaaagaagaaacgccctgagatctcagcgccacagaacttccagcaccgtgtccacacctccttcgaccccaaagaaggcaagtttgtgggcctccccccacaatggcagaacatcctggacacactgcggcgccccaagcccgtggtggacccttcgcgaatcacacgggtgcagctccagcccatgaagacagtggtgcggggcagcgcgatgcctgtggatggctacatctcggggctgctcaacgacatccagaagttgtcagtcatcagctccaacaccctgcgtggccgcagccccaccagccggcggcgggcacagtccctggggctgctgggggatgagcactgggccaccgacccagacatgtacctccagagcccccagtctgagcgcactgacccccacggcctctacctcagctgcaacgggggcacaccagcaggccacaagcagatgccgtggcccgagccacagagcccacgggtcctgcccaatgggctggctgcaaaggcacagtccctgggccccgccgagtttcagggtgcctcgcagcgctgtctgcagctgggtgcctgcctgcagagctccccaccaggagcctcgccccccacgggcaccaataggcatggaatgaaggctgccaagcatggctctgaggaggcccggccacagtcctgcctggtgggctcagccacaggcaggccaggtggggaaggcagccctagccctaagacccgggagagcagcctgaagcgcaggctattccgaagcatgttcctgtccactgctgccacagcccctccaagcagcagcaagccaggccctccaccacagagcaagcccaactcctctttccgaccgccgcagaaagacaaccccccaagcctggtggccaaggcccagtccttgccctcggaccagccggtggggaccttcagccctctgaccacttcggataccagcagcccccagaagtccctccgcacagccccggccacaggccagcttccaggccggtcttccccagcgggatccccccgcacctggcacgcccagatcagcaccagcaacctgtacctgccccaggaccccacggttgccaagggtgccctggctggtgaggacacaggtgttgtgacacatgagcagttcaaggctgcgctcaggatggtggtggaccagggtgacccccggctgctgctggacagctacgtgaagattggcgagggctccaccggcatcgtctgcttggcccgggagaagcactcgggccgccaggtggccgtcaagatgatggacctcaggaagcagcagcgcagggagctgctcttcaacgaggtggtgatcatgcgggactaccagcacttcaacgtggtggagatgtacaagagctacctggtgggcgaggagctgtgggtgctcatggagttcctgcagggaggagccctcacagacatcgtctcccaagtcaggctgaatgaggagcagattgccactgtgtgtgaggctgtgctgcaggccctggcctacctgcatgctcagggtgtcatccaccgggacatcaagagtgactccatcctgctgaccctcgatggcagggtgaagctctcggacttcggattctgtgctcagatcagcaaagacgtccctaagaggaagtccctggtgggaaccccctactggatggctcctgaagtgatctccaggtctttgtatgccactgaggtggatatctggtctctgggcatcatggtgattgagatggtagatggggagccaccgtacttcagtgactccccagtgcaagccatgaagaggctccgggacagccccccacccaagctgaaaaactctcacaaggtctccccagtgctgcgagacttcctggagcggatgctggtgcgggacccccaagagagagccacagcccaggagctcctagaccaccccttcctgctgcagacagggctacctgagtgcctggtgcccctgatccagctctaccgaaagcagacctccacctgctgagcccaccccaagtatgcctgccacctacgcccacaggcagggcacactgggcagccagcctgccggcaggacttgcctgcctcctcctctcagtattctctccaaagattgaaatgtgaagccccagccccaccctctgcccttcagcctactgggccaggccggacctgccccctcagtgtctctccctcccgagtccccagatggagacccctttctacaggatgaccccttgatatttgcacagggatatttctaagaaacgcagaggccagcgttcctggcctctgcagccaacacagtagaaaaggctgctgtggttttttaaaggcagttgtccactagtgtcctaggccactgcagagggcagactgctggtctccacagatacctgctgttctcagctccagcttcaaacctcgagtctcgagagggccacggggtggtttttatgaccggaatcccgcttcctccctcacgtctgatgtcctgaaggtgcagtcccacctgtacagcccctccccgcccagaactgtgaatggcctgctccaggccatggctgggggcagggagtgaggggacaatttctgagtgaaagagaaagaatggggtcggtggtgaaggtgctctcactttacagaatggagagaacatcgtgtgtgtgtgtgtgtgtgtgtgtgtgtgtgtgtgtgtgtaaggggaggaaagccaccttgacagcccaggtccctccaggtcacccacagccagtttcaggaaggctgcccctctctcccactaagttctggcctgaagggacctgctttcttggcctggcttccacctctccactcctgtgtctacctggccagtggagtggtccatgctaagtctaacactcctgggagctcaggaggcttctgagcttctcctgtactgtgcatcgtgagggccagagacaggaatgtaaggattggcaactgtgttacctttcaagtttatctcaataaccaggtcatcagggacccattgttctcttcagaaccctatctgggagagaaggcgaaccacctccgggtttccatcatgtcaaggtcacaggcatccatgtgtgcaaaccatctgccccagctgcctccacagactgctgtctccttgtcctcctcggccctgccccacttcagggctgctgtgagatggaattccaggaaagaacttcaggtgtctggaccctttctatctagataatatttttagattcttctgctccctagtgacctacctgggggcaaagaaattgcaaggacttttttttaagggtcagagttttcaaaacaaaagcatcttccctagaaatttttgtgaattgtttgcacttgtgcctgttttaaattaaattgagtgttcaaagc

SEQ ID NO: 163278 - DNA, 2490 bp, Homo sapiens
  Payload ID: 12170
  Gene Symbol:
  Gene Name: p21 protein (Cdc42/Rac)-activated kinase 6 [Source:EntrezGene
  Acc:56924]
  ENST ID: ENST00000453867
  CDS Start-End: 158-559
aaagaccagctatgcagcttctttcatggcctatttttattatctccttctcttaaatctgggctcagaatccacgatccctatgattgtaacaagaacaatcaagctttgaagatagtggacttttcctacagtgttgaccttagggtgcagctggatgtttttaccctcagcggctttcggactgtacagatcctggaaggacaaaagatcctggctaactgttcttctccctaccaggcctgcggaggactggcccagcaaggtcccaggtcttccctctcctcagcgcctaagagagaggcccagtgcgggtgaggagtcgcgaggaagaggcggaaggcgccggaaggcaccatgttccgcaagaaaaagaagaaacgccctgagatctcagcgccacagaacttccagcaccgtgtccacacctccttcgaccccaaagaaggcaagtttgtgggcctccccccacaatggcagaacatcctggacacactgcggcgccccaagcccgtggtggacccttcgcgaatcacacgggtgcagctccagcccatgaagacagtggtgcggggcagcgcgatgcctgtggatggctacatctcggggctgctcaacgacatccagaagttgtcagtcatcagctccaacaccctgcgtggccgcagccccaccagccggcggcgggcacagtccctggggctgctgggggatgagcactgggccaccgacccagacatgtacctccagagcccccagtctgagcgcactgacccccacggcctctacctcagctgcaacgggggcacaccagcaggccacaagcagatgccgtggcccgagccacagagcccacgggtcctgcccaatgggctggctgcaaaggcacagtccctgggccccgccgagtttcagggtgcctcgcagcgctgtctgcagctgggtgcctgcctgcagagctccccaccaggagcctcgccccccacgggcaccaataggcatggaatgaaggctgccaagcatggctctgaggaggcccggccacagtcctgcctggtgggctcagccacaggcaggccaggtggggaaggcagccctagccctaagacccgggagagcagcctgaagcgcaggctattccgaagcatgttcctgtccactgctgccacagcccctccaagcagcagcaagccaggccctccaccacagagcaagcccaactcctctttccgaccgccgcagaaagacaaccccccaagcctggtggccaaggcccagtccttgccctcggaccagccggtggggaccttcagccctctgaccacttcggataccagcagcccccagaagtccctccgcacagccccggccacaggccagcttccaggccggtcttccccagcgggatccccccgcacctggcacgcccagatcagcaccagcaacctgtacctgccccaggaccccacggttgccaagggtgccctggctggtgaggacacaggtgttgtgacacatgagcagttcaaggctgcgctcaggatggtggtggaccagggtgacccccggctgctgctggacagctacgtgaagattggcgagggctccaccggcatcgtctgcttggcccgggagaagcactcgggccgccaggtggccgtcaagatgatggacctcaggaagcagcagcgcagggagctgctcttcaacgaggtggtgatcatgcgggactaccagcacttcaacgtggtggagatgtacaagagctacctggtgggcgaggagctgtgggtgctcatggagttcctgcagggaggagccctcacagacatcgtctcccaagtcaggctgaatgaggagcagattgccactgtgtgtgaggctgtgctgcaggccctggcctacctgcatgctcagggtgtcatccaccgggacatcaagagtgactccatcctgctgaccctcgatggcagggtgaagctctcggacttcggattctgtgctcagatcagcaaagacgtccctaagaggaagtccctggtgggaaccccctactggatggctcctgaagtgatctccaggtctttgtatgccactgaggtggatatctggtctctgggcatcatggtgattgagatggtagatggggagccaccgtacttcagtgactccccagtgcaagccatgaagaggctccgggacagccccccacccaagctgaaaaactctcacaaggtctccccagtgctgcgagacttcctggagcggatgctggtgcgggacccccaagagagagccacagcccaggagctcctagaccaccccttcctgctgcagacagggctacctgagtgcctggtgcccctgatccagctctaccgaaagcagacctccacctgctgagcccaccccaagtatgcctgccacctacgcccacaggcagggcacactgggcagccagcctgccggcaggacttgcctgcctcctcc

SEQ ID NO: 163279 - DNA, 2767 bp, Homo sapiens
  Payload ID: 12170
  Gene Symbol:
  Gene Name: p21 protein (Cdc42/Rac)-activated kinase 6 [Source:EntrezGene
  Acc:56924]
  ENST ID: ENST00000441369
  CDS Start-End: 420-2465
tttcatggcctatttttattatctccttctcttaaatctgggctcagaatccacgatccctatgattgtaacaagaacaatcaagctttgaagatagtggacttttcctacagtgttgaccttagggtgcagctggatgtttttaccctcagcggctttcggactgtacagatcctggaaggacaaaagatcctggctaactgttcttctccctaccagggagtgccgcttcctgggctagagacaagcaccagcctgcagtggagaacgcaggaccccgctgcccagaaggagcagccacggcctgcggaggactggcccagcaaggtcccaggtcttccctctcctcagcgcctaagagagaggcccagtgcgggtgaggagtcgcgaggaagaggcggaaggcgccggaaggcaccatgttccgcaagaaaaagaagaaacgccctgagatctcagcgccacagaacttccagcaccgtgtccacacctccttcgaccccaaagaaggcaagtttgtgggcctccccccacaatggcagaacatcctggacacactgcggcgccccaagcccgtggtggacccttcgcgaatcacacgggtgcagctccagcccatgaagacagtggtgcggggcagcgcgatgcctgtggatggctacatctcggggctgctcaacgacatccagaagttgtcagtcatcagctccaacaccctgcgtggccgcagccccaccagccggcggcgggcacagtccctggggctgctgggggatgagcactgggccaccgacccagacatgtacctccagagcccccagtctgagcgcactgacccccacggcctctacctcagctgcaacgggggcacaccagcaggccacaagcagatgccgtggcccgagccacagagcccacgggtcctgcccaatgggctggctgcaaaggcacagtccctgggccccgccgagtttcagggtgcctcgcagcgctgtctgcagctgggtgcctgcctgcagagctccccaccaggagcctcgccccccacgggcaccaataggcatggaatgaaggctgccaagcatggctctgaggaggcccggccacagtcctgcctggtgggctcagccacaggcaggccaggtggggaaggcagccctagccctaagacccgggagagcagcctgaagcgcaggctattccgaagcatgttcctgtccactgctgccacagcccctccaagcagcagcaagccaggccctccaccacagagcaagcccaactcctctttccgaccgccgcagaaagacaaccccccaagcctggtggccaaggcccagtccttgccctcggaccagccggtggggaccttcagccctctgaccacttcggataccagcagcccccagaagtccctccgcacagccccggccacaggccagcttccaggccggtcttccccagcgggatccccccgcacctggcacgcccagatcagcaccagcaacctgtacctgccccaggaccccacggttgccaagggtgccctggctggtgaggacacaggtgttgtgacacatgagcagttcaaggctgcgctcaggatggtggtggaccagggtgacccccggctgctgctggacagctacgtgaagattggcgagggctccaccggcatcgtctgcttggcccgggagaagcactcgggccgccaggtggccgtcaagatgatggacctcaggaagcagcagcgcagggagctgctcttcaacgaggtggtgatcatgcgggactaccagcacttcaacgtggtggagatgtacaagagctacctggtgggcgaggagctgtgggtgctcatggagttcctgcagggaggagccctcacagacatcgtctcccaagtcaggctgaatgaggagcagattgccactgtgtgtgaggctgtgctgcaggccctggcctacctgcatgctcagggtgtcatccaccgggacatcaagagtgactccatcctgctgaccctcgatggcagggtgaagctctcggacttcggattctgtgctcagatcagcaaagacgtccctaagaggaagtccctggtgggaaccccctactggatggctcctgaagtgatctccaggtctttgtatgccactgaggtggatatctggtctctgggcatcatggtgattgagatggtagatggggagccaccgtacttcagtgactccccagtgcaagccatgaagaggctccgggacagccccccacccaagctgaaaaactctcacaaggtctccccagtgctgcgagacttcctggagcggatgctggtgcgggacccccaagagagagccacagcccaggagctcctagaccaccccttcctgctgcagacagggctacctgagtgcctggtgcccctgatccagctctaccgaaagcagacctccacctgctgagcccaccccaagtatgcctgccacctacgcccacaggcagggcacactgggcagccagcctgccggcaggacttgcctgcctcctcctctcagtattctctccaaagattgaaatgtgaagccccagccccaccctctgcccttcagcctactgggccaggccggacctgccccctcagtgtctctccctcccgagtccccagatggagacccctttctacaggatgaccccttgatatttgcacagggatatttctaagaaacgcagaggccagcgttcctggcctctgcagccaacacag

SEQ ID NO: 163280 - DNA, 2620 bp, Homo sapiens
  Payload ID: 12170
  Gene Symbol:
  Gene Name: p21 protein (Cdc42/Rac)-activated kinase 6 [Source:EntrezGene
  Acc:56924]
  ENST ID: ENST00000558658
  CDS Start-End: 1-483
gtttttaccctcagcggctttcggactgtacagatcctggaaggacaaaagatcctggctaactgttcttctccctaccagggagtgccgcttcctgggctagagacaagcaccagcctgcagtggagaacgcaggaccccgctgcccagaaggagcagccacggcctgcggaggactggcccagcaaggtcccaggtcttccctctcctcagcgcctaagagagaggcccagtgcgggtgaggagtcgcgaggaagaggcggaaggcgccggaaggcaccatgttccgcaagaaaaagaagaaacgccctgagatctcagcgccacagaacttccagcaccgtgtccacacctccttcgaccccaaagaaggcaagtttgtgggcctccccccacaatggcagaacatcctggacacactgcggcgccccaagcccgtggtggacccttcgcgaatcacacgggtgcagctccagcccatgaagacagtggtgcggggcagcgcgatgcctgtggatggctacatctcggggctgctcaacgacatccagaagttgtcagtcatcagctccaacaccctgcgtggccgcagccccaccagccggcggcgggcacagtccctggggctgctgggggatgagcactgggccaccgacccagacatgtacctccagagcccccagtctgagcgcactgacccccacggcctctacctcagctgcaacgggggcacaccagcaggccacaagcagatgccgtggcccgagccacagagcccacgggtcctgcccaatgggctggctgcaaaggcacagtccctgggccccgccgagtttcagggtgcctcgcagcgctgtctgcagctgggtgcctgcctgcagagctccccaccaggagcctcgccccccacgggcaccaataggcatggaatgaaggctgccaagcatggctctgaggaggcccggccacagtcctgcctggtgggctcagccacaggcaggccaggtggggaaggcagccctagccctaagacccgggagagcagcctgaagcgcaggctattccgaagcatgttcctgtccactgctgccacagcccctccaagcagcagcaagccaggccctccaccacagagcaagcccaactcctctttccgaccgccgcagaaagacaaccccccaagcctggtggccaaggcccagtccttgccctcggaccagccggtggggaccttcagccctctgaccacttcggataccagcagcccccagaagtccctccgcacagccccggccacaggccagcttccaggccggtcttccccagcgggatccccccgcacctggcacgcccagatcagcaccagcaacctgtacctgccccaggaccccacggttgccaagggtgccctggctggtgaggacacaggtgttgtgacacatgagcagttcaaggctgcgctcaggatggtggtggaccagggtgacccccggctgctgctggacagctacgtgaagattggcgagggctccaccggcatcgtctgcttggcccgggagaagcactcgggccgccaggtggccgtcaagatgatggacctcaggaagcagcagcgcagggagctgctcttcaacgaggtggtgatcatgcgggactaccagcacttcaacgtggtggagatgtacaagagctacctggtgggcgaggagctgtgggtgctcatggagttcctgcagggaggagccctcacagacatcgtctcccaagtcaggctgaatgaggagcagattgccactgtgtgtgaggctgtgctgcaggccctggcctacctgcatgctcagggtgtcatccaccgggacatcaagagtgactccatcctgctgaccctcgatggcagggtgaagctctcggacttcggattctgtgctcagatcagcaaagacgtccctaagaggaagtccctggtgggaaccccctactggatggctcctgaagtgatctccaggtctttgtatgccactgaggtggatatctggtctctgggcatcatggtgattgagatggtagatggggagccaccgtacttcagtgactccccagtgcaagccatgaagaggctccgggacagccccccacccaagctgaaaaactctcacaaggtctccccagtgctgcgagacttcctggagcggatgctggtgcgggacccccaagagagagccacagcccaggagctcctagaccaccccttcctgctgcagacagggctacctgagtgcctggtgcccctgatccagctctaccgaaagcagacctccacctgctgagcccaccccaagtatgcctgccacctacgcccacaggcagggcacactgggcagccagcctgccggcaggacttgcctgcctcctcctctcagtattctctccaaagattgaaatgtgaagccccagccccaccctctgcccttcagcctactgggccaggccggacctgccccctcagtgtctctccctcccgagtccccagatggagacccctttctacaggatgaccccttgatatttgcacagggatatttctaagaaacgcagaggccagcgttcctggcctctgcag

SEQ ID NO: 163281 - DNA, 608 bp, Homo sapiens
  Payload ID: 12170
  Gene Symbol:
  Gene Name: p21 protein (Cdc42/Rac)-activated kinase 6 [Source:EntrezGene
  Acc:56924]
  ENST ID: ENST00000559435
  CDS Start-End: 1-424
caaggaacacctacaggtcttctgggatgggtccttctggaaacttagccaaaatatttctgagctaaaagatggtgaattgtggaataaattctttgtgcggattctgaatgccaatgatgaggccacagtgtctgttcttggggagcttgcagcagaaatgaatggggtttttgacactacattccaaagtcacctgaacaaagccttatggaagggagtgccgcttcctgggctagagacaagcaccagcctgcagtggagaacgcaggaccccgctgcccagaaggagcagccacggcctgcggaggactggcccagcaaggtcccaggtcttccctctcctcagcgcctaagagagaggcccagtgcgggtgaggagtcgcgaggaagaggcggaaggcgccggaagacagtggaatgatacttgtaatgggctttggattttataaaaacacacccccagagtctgcctgctccataggggacttggcacaggcaccatgttccgcaagaaaaagaagaaacgccctgagatctcagcgccacagaacttccagcaccgtgtccacacctccttcgaccccaaagaaggcaagtttgtgggc

SEQ ID NO: 163282 - DNA, 4500 bp, Homo sapiens
  Payload ID: 12171
  Gene Symbol: PAK7
  Gene Name: p21 protein (Cdc42/Rac)-activated kinase 7
  Uniprot ID: Q9P286
  ENST ID: ENST00000353224
  CDS Start-End: 268-2427
agttccccagcgtgcgcccggggagaccgggaacatggcgctgggagcgctgtagcagctgagaaggggctgaggcaccgccgcttcgctgacagccggccaccagaaatacactgtggtgaaatgcttccacctcttgctaaaatgaacactgaggaaaaatgaagaagactgacaagcaccagcgaaaagttgcagaatagaaatagccacactcctctggagtctttaattcatccacagccatcatataaaggttttggcatcatgtttgggaagaaaaagaaaaagattgaaatatctggcccgtccaactttgaacacagggttcatactgggtttgatccacaagagcagaagtttaccggccttccccagcagtggcacagcctgttagcagatacggccaacaggccaaagcctatggtggacccttcatgcatcacacccatccagctggctcctatgaagacaatcgttagaggaaacaaaccctgcaaggaaacctccatcaacggcctgctagaggattttgacaacatctcggtgactcgctccaactccctaaggaaagaaagcccacccaccccagatcagggagcctccagccacggtccaggccacgcggaagaaaatggcttcatcaccttctcccagtattccagcgaatccgatactactgctgactacacgaccgaaaagtacagggagaagagtctctatggagatgatctggatccgtattatagaggcagccacgcagccaagcaaaatgggcacgtaatgaaaatgaagcacggggaggcctactattctgaggtgaagcctttgaaatccgattttgccagattttctgccgattatcactcacatttggactcactgagcaaaccaagtgaatacagtgacctcaagtgggagtatcagagagcctcgagtagctcccctctggattattcattccaattcacaccttctagaactgcagggaccagcgggtgctccaaggagagcctggcgtacagtgaaagtgaatggggacccagcctggatgactatgacaggaggccaaagtcttcgtacctgaatcagacaagccctcagcccaccatgcggcagaggtccaggtcaggctcgggactccaggaaccgatgatgccatttggagcaagtgcatttaaaacccatccccaaggacactcctacaactcctacacctaccctcgcttgtccgagcccacaatgtgcattccaaaggtggattacgatcgagcacagatggtcctcagccctccactgtcagggtctgacacctaccccaggggccctgccaaactacctcaaagtcaaagcaaatcgggctattcctcaagcagtcaccagtacccgtctgggtaccacaaagccaccttgtaccatcacccctccctgcagagcagttcgcagtacatctccacggcttcctacctgagctccctcagcctctcatccagcacctacccgccgcccagctggggctcctcctccgaccagcagccctccagggtgtcccatgaacagtttcgggcggccctgcagctggtggtcagcccaggagaccccagggaatacttggccaactttatcaaaatcggggaaggctcaaccggcatcgtatgcatcgccaccgagaaacacacagggaaacaagttgcagtgaagaaaatggacctccggaagcaacagagacgagaactgcttttcaatgaggtcgtgatcatgcgggattaccaccatgacaatgtggttgacatgtacagcagctaccttgtcggcgatgagctctgggtggtcatggagtttctagaaggtggtgccttgacagacattgtgactcacaccagaatgaatgaagaacagatagctactgtctgcctgtcagttctgagagctctctcctaccttcataaccaaggagtgattcacagggacataaaaagtgactccatcctcctgacaagcgatggccggataaagttgtctgattttggtttctgtgctcaagtttccaaagaggtgccgaagaggaaatcattggttggcactccctactggatggcccctgaggtgatttctaggctaccttatgggacagaggtggacatctggtccctcgggatcatggtgatagaaatgattgatggcgagcccccctacttcaatgagcctcccctccaggcgatgcggaggatccgggacagtttacctccaagagtgaaggacctacacaaggtttcttcagtgctccggggattcctagacttgatgttggtgagggagccctctcagagagcaacagcccaggaactcctcggacatccattcttaaaactagcaggtccaccgtcttgcatcgtccccctcatgagacaatacaggcatcactgagcagaggattcgtgtaggtggcaaagctagatgaggacatgagaataattcaggagaacaaaaggaaacacagaacatgcaaaaggcctgtgcattctagaccagccaattggtgggacagcgtgatgaccggcagggttcaacagaccagggcatcttcttgtgtcttaaacaggcatctctccactgacagccggtgtggtcacttggagcacggctttaataagtcattattatatttttcagcccttcatccagcaaatcagaaggactcagtacaaactccgttatgatatatcctagccacatgcagggtaacatgtaggattttctatattgaaagaatacttttctggcaaaaaaaaaaaaaaaagaaagaaaggaaaacaaaaagcacttttttcttaatggtagcagtataatgtattttgcaacgaatttgtaatttttctgtacgatagttttgataatttatagtactttgatgtcatgtagccattgtatcagttgaagtaatacttgtttactagaggagtttgaacaaagcctttcctacttttttatccctttaagagaaccaatgattctttaggaactttgaatactgaatgactctcaatcaccgtcagctttagtaaaatctctttcttatcctaacaagtgtcttatttggtggaagaagaattaagagtgatggtgatggtgtgcacgtttcattaatccaaccaaaaataatgaaataaaatttgagccacagtataccactccttgggataaagttaaatatttttaaagatcacattttccatgaacgcctctagtagcaaaccattcttttgcacaccacaatgtttccctcagtgccctttctcaaatgggtacaatgttcccttgtggccaaatttccctcccagggagcaatttcagtgctaggatcattggattcagttcccaaaatagaatgtttcagtgagaccatgagaattccaggctcacaaagggagaggagagaacagggcaagacgtttggtttcatttgtcaccatttttaaaactctgtatgctagcacaccaaactcttgtctatatttacctttgtaccacagtattaatcgctattgttcatgtatcgtgctggaagtctgaactgactctagaggatgaattagcaagagggtattttaccaggtatgatctgacttcagttgtgcccatgttataatgtgtttccgacataggagagtcgtgctgctgtctagatcttcttgaatgttgataaaaatgaatgactactacaatacattttgtgttgcttgttggatgaatttgcatgttaactgtaggccaatatagatttgcctttaaaactctggaagagctacatagtcatcattagtttctattaattatgcatcagacaaaagccatttgttaccaaactgggaaaacagaggcttttcttaactatttcacatactgtaacaaatatgaatttaaatttgtgatagcgctctggttgctctaagcataattaagaatttttgtaattaataggttgctaattatttatcactgctaaaaaggaaaaaaggcataaaatgaccttctactgattagattttcagttttctttcaaactggaaatgcctccataaatatgatctatgattttgcttcataaaacagcaaatcaatgttttatgtaaaatattaaagcattaatataaatatgtgagaataaaaacaatctaaatccagaaaatggcagtcctaaatgttcatgagacagattgtattaatttaaccaggactatgtagaagtagaaagaaaagaaaaagaaaatcttttttaaaccagaataaacattaaaaactattgcagaaaatagtggattttggattccaaacattttcgacagtgtaatggaaatttttctgtaattttcttaccatcgggtattttttaaagtattcattgagtttaccaaaagttactgtagcttaaaaggttttgtgagcactaactattggcagaaactgcatttgcaaataaaaataaatgtttgccttttc

SEQ ID NO: 163283 - DNA, 4613 bp, Homo sapiens
  Payload ID: 12171
  Gene Symbol: PAK7
  Gene Name: p21 protein (Cdc42/Rac)-activated kinase 7
  Uniprot ID: Q9P286
  ENST ID: ENST00000378423
  CDS Start-End: 381-2540
ggcgctgggagcgctgtagcagctgagaaggggctgaggcaccgccgcttcgctgacagccggccaccaggtttctgtctcccagtataatcatatccagccccatggctcttactggggcctctgaaatgtttatcaccaaatctgtgtctgcagttccaacctcttccctgagcatcaaagctgtatttccaactttcgctggatgcttctatctggaaatacactgtggtgaaatgcttccacctcttgctaaaatgaacactgaggaaaaatgaagaagactgacaagcaccagcgaaaagttgcagaatagaaatagccacactcctctggagtctttaattcatccacagccatcatataaaggttttggcatcatgtttgggaagaaaaagaaaaagattgaaatatctggcccgtccaactttgaacacagggttcatactgggtttgatccacaagagcagaagtttaccggccttccccagcagtggcacagcctgttagcagatacggccaacaggccaaagcctatggtggacccttcatgcatcacacccatccagctggctcctatgaagacaatcgttagaggaaacaaaccctgcaaggaaacctccatcaacggcctgctagaggattttgacaacatctcggtgactcgctccaactccctaaggaaagaaagcccacccaccccagatcagggagcctccagccacggtccaggccacgcggaagaaaatggcttcatcaccttctcccagtattccagcgaatccgatactactgctgactacacgaccgaaaagtacagggagaagagtctctatggagatgatctggatccgtattatagaggcagccacgcagccaagcaaaatgggcacgtaatgaaaatgaagcacggggaggcctactattctgaggtgaagcctttgaaatccgattttgccagattttctgccgattatcactcacatttggactcactgagcaaaccaagtgaatacagtgacctcaagtgggagtatcagagagcctcgagtagctcccctctggattattcattccaattcacaccttctagaactgcagggaccagcgggtgctccaaggagagcctggcgtacagtgaaagtgaatggggacccagcctggatgactatgacaggaggccaaagtcttcgtacctgaatcagacaagccctcagcccaccatgcggcagaggtccaggtcaggctcgggactccaggaaccgatgatgccatttggagcaagtgcatttaaaacccatccccaaggacactcctacaactcctacacctaccctcgcttgtccgagcccacaatgtgcattccaaaggtggattacgatcgagcacagatggtcctcagccctccactgtcagggtctgacacctaccccaggggccctgccaaactacctcaaagtcaaagcaaatcgggctattcctcaagcagtcaccagtacccgtctgggtaccacaaagccaccttgtaccatcacccctccctgcagagcagttcgcagtacatctccacggcttcctacctgagctccctcagcctctcatccagcacctacccgccgcccagctggggctcctcctccgaccagcagccctccagggtgtcccatgaacagtttcgggcggccctgcagctggtggtcagcccaggagaccccagggaatacttggccaactttatcaaaatcggggaaggctcaaccggcatcgtatgcatcgccaccgagaaacacacagggaaacaagttgcagtgaagaaaatggacctccggaagcaacagagacgagaactgcttttcaatgaggtcgtgatcatgcgggattaccaccatgacaatgtggttgacatgtacagcagctaccttgtcggcgatgagctctgggtggtcatggagtttctagaaggtggtgccttgacagacattgtgactcacaccagaatgaatgaagaacagatagctactgtctgcctgtcagttctgagagctctctcctaccttcataaccaaggagtgattcacagggacataaaaagtgactccatcctcctgacaagcgatggccggataaagttgtctgattttggtttctgtgctcaagtttccaaagaggtgccgaagaggaaatcattggttggcactccctactggatggcccctgaggtgatttctaggctaccttatgggacagaggtggacatctggtccctcgggatcatggtgatagaaatgattgatggcgagcccccctacttcaatgagcctcccctccaggcgatgcggaggatccgggacagtttacctccaagagtgaaggacctacacaaggtttcttcagtgctccggggattcctagacttgatgttggtgagggagccctctcagagagcaacagcccaggaactcctcggacatccattcttaaaactagcaggtccaccgtcttgcatcgtccccctcatgagacaatacaggcatcactgagcagaggattcgtgtaggtggcaaagctagatgaggacatgagaataattcaggagaacaaaaggaaacacagaacatgcaaaaggcctgtgcattctagaccagccaattggtgggacagcgtgatgaccggcagggttcaacagaccagggcatcttcttgtgtcttaaacaggcatctctccactgacagccggtgtggtcacttggagcacggctttaataagtcattattatatttttcagcccttcatccagcaaatcagaaggactcagtacaaactccgttatgatatatcctagccacatgcagggtaacatgtaggattttctatattgaaagaatacttttctggcaaaaaaaaaaaaaaaagaaagaaaggaaaacaaaaagcacttttttcttaatggtagcagtataatgtattttgcaacgaatttgtaatttttctgtacgatagttttgataatttatagtactttgatgtcatgtagccattgtatcagttgaagtaatacttgtttactagaggagtttgaacaaagcctttcctacttttttatccctttaagagaaccaatgattctttaggaactttgaatactgaatgactctcaatcaccgtcagctttagtaaaatctctttcttatcctaacaagtgtcttatttggtggaagaagaattaagagtgatggtgatggtgtgcacgtttcattaatccaaccaaaaataatgaaataaaatttgagccacagtataccactccttgggataaagttaaatatttttaaagatcacattttccatgaacgcctctagtagcaaaccattcttttgcacaccacaatgtttccctcagtgccctttctcaaatgggtacaatgttcccttgtggccaaatttccctcccagggagcaatttcagtgctaggatcattggattcagttcccaaaatagaatgtttcagtgagaccatgagaattccaggctcacaaagggagaggagagaacagggcaagacgtttggtttcatttgtcaccatttttaaaactctgtatgctagcacaccaaactcttgtctatatttacctttgtaccacagtattaatcgctattgttcatgtatcgtgctggaagtctgaactgactctagaggatgaattagcaagagggtattttaccaggtatgatctgacttcagttgtgcccatgttataatgtgtttccgacataggagagtcgtgctgctgtctagatcttcttgaatgttgataaaaatgaatgactactacaatacattttgtgttgcttgttggatgaatttgcatgttaactgtaggccaatatagatttgcctttaaaactctggaagagctacatagtcatcattagtttctattaattatgcatcagacaaaagccatttgttaccaaactgggaaaacagaggcttttcttaactatttcacatactgtaacaaatatgaatttaaatttgtgatagcgctctggttgctctaagcataattaagaatttttgtaattaataggttgctaattatttatcactgctaaaaaggaaaaaaggcataaaatgaccttctactgattagattttcagttttctttcaaactggaaatgcctccataaatatgatctatgattttgcttcataaaacagcaaatcaatgttttatgtaaaatattaaagcattaatataaatatgtgagaataaaaacaatctaaatccagaaaatggcagtcctaaatgttcatgagacagattgtattaatttaaccaggactatgtagaagtagaaagaaaagaaaaagaaaatcttttttaaaccagaataaacattaaaaactattgcagaaaatagtggattttggattccaaacattttcgacagtgtaatggaaatttttctgtaattttcttaccatcgggtattttttaaagtattcattgagtttaccaaaagttactgtagcttaaaaggttttgtgagcactaactattggcagaaactgcatttgcaaataaaaataaatgtttgccttttc

SEQ ID NO: 163284 - DNA, 4780 bp, Homo sapiens
  Payload ID: 12171
  Gene Symbol: PAK7
  Gene Name: p21 protein (Cdc42/Rac)-activated kinase 7
  Uniprot ID: Q9P286
  ENST ID: ENST00000378429
  CDS Start-End: 548-2707
cgaaaacccggagcagctgcgtacgctcatggacagtcctccgaggggcgaagccgggcagctgggcatgctcagtagctgggggaggtttgggtggagagtagaaagctgtggctctgcctctcaccccctcccgctggcccccgccccccttgcccctacccagccagtagtagttccccagcgtgcgcccggggagaccgggaacatggcgctgggagcgctgtagcagctgagaaggggctgaggcaccgccgcttcgctgacagccggccaccagatgttcatgcattctagagaaagtggaaaacttagaagcctaattaatgactgtcttctggacctctgagaccatgtttctagtgttttccgtggaatattatcagaaatacactgtggtgaaatgcttccacctcttgctaaaatgaacactgaggaaaaatgaagaagactgacaagcaccagcgaaaagttgcagaatagaaatagccacactcctctggagtctttaattcatccacagccatcatataaaggttttggcatcatgtttgggaagaaaaagaaaaagattgaaatatctggcccgtccaactttgaacacagggttcatactgggtttgatccacaagagcagaagtttaccggccttccccagcagtggcacagcctgttagcagatacggccaacaggccaaagcctatggtggacccttcatgcatcacacccatccagctggctcctatgaagacaatcgttagaggaaacaaaccctgcaaggaaacctccatcaacggcctgctagaggattttgacaacatctcggtgactcgctccaactccctaaggaaagaaagcccacccaccccagatcagggagcctccagccacggtccaggccacgcggaagaaaatggcttcatcaccttctcccagtattccagcgaatccgatactactgctgactacacgaccgaaaagtacagggagaagagtctctatggagatgatctggatccgtattatagaggcagccacgcagccaagcaaaatgggcacgtaatgaaaatgaagcacggggaggcctactattctgaggtgaagcctttgaaatccgattttgccagattttctgccgattatcactcacatttggactcactgagcaaaccaagtgaatacagtgacctcaagtgggagtatcagagagcctcgagtagctcccctctggattattcattccaattcacaccttctagaactgcagggaccagcgggtgctccaaggagagcctggcgtacagtgaaagtgaatggggacccagcctggatgactatgacaggaggccaaagtcttcgtacctgaatcagacaagccctcagcccaccatgcggcagaggtccaggtcaggctcgggactccaggaaccgatgatgccatttggagcaagtgcatttaaaacccatccccaaggacactcctacaactcctacacctaccctcgcttgtccgagcccacaatgtgcattccaaaggtggattacgatcgagcacagatggtcctcagccctccactgtcagggtctgacacctaccccaggggccctgccaaactacctcaaagtcaaagcaaatcgggctattcctcaagcagtcaccagtacccgtctgggtaccacaaagccaccttgtaccatcacccctccctgcagagcagttcgcagtacatctccacggcttcctacctgagctccctcagcctctcatccagcacctacccgccgcccagctggggctcctcctccgaccagcagccctccagggtgtcccatgaacagtttcgggcggccctgcagctggtggtcagcccaggagaccccagggaatacttggccaactttatcaaaatcggggaaggctcaaccggcatcgtatgcatcgccaccgagaaacacacagggaaacaagttgcagtgaagaaaatggacctccggaagcaacagagacgagaactgcttttcaatgaggtcgtgatcatgcgggattaccaccatgacaatgtggttgacatgtacagcagctaccttgtcggcgatgagctctgggtggtcatggagtttctagaaggtggtgccttgacagacattgtgactcacaccagaatgaatgaagaacagatagctactgtctgcctgtcagttctgagagctctctcctaccttcataaccaaggagtgattcacagggacataaaaagtgactccatcctcctgacaagcgatggccggataaagttgtctgattttggtttctgtgctcaagtttccaaagaggtgccgaagaggaaatcattggttggcactccctactggatggcccctgaggtgatttctaggctaccttatgggacagaggtggacatctggtccctcgggatcatggtgatagaaatgattgatggcgagcccccctacttcaatgagcctcccctccaggcgatgcggaggatccgggacagtttacctccaagagtgaaggacctacacaaggtttcttcagtgctccggggattcctagacttgatgttggtgagggagccctctcagagagcaacagcccaggaactcctcggacatccattcttaaaactagcaggtccaccgtcttgcatcgtccccctcatgagacaatacaggcatcactgagcagaggattcgtgtaggtggcaaagctagatgaggacatgagaataattcaggagaacaaaaggaaacacagaacatgcaaaaggcctgtgcattctagaccagccaattggtgggacagcgtgatgaccggcagggttcaacagaccagggcatcttcttgtgtcttaaacaggcatctctccactgacagccggtgtggtcacttggagcacggctttaataagtcattattatatttttcagcccttcatccagcaaatcagaaggactcagtacaaactccgttatgatatatcctagccacatgcagggtaacatgtaggattttctatattgaaagaatacttttctggcaaaaaaaaaaaaaaaagaaagaaaggaaaacaaaaagcacttttttcttaatggtagcagtataatgtattttgcaacgaatttgtaatttttctgtacgatagttttgataatttatagtactttgatgtcatgtagccattgtatcagttgaagtaatacttgtttactagaggagtttgaacaaagcctttcctacttttttatccctttaagagaaccaatgattctttaggaactttgaatactgaatgactctcaatcaccgtcagctttagtaaaatctctttcttatcctaacaagtgtcttatttggtggaagaagaattaagagtgatggtgatggtgtgcacgtttcattaatccaaccaaaaataatgaaataaaatttgagccacagtataccactccttgggataaagttaaatatttttaaagatcacattttccatgaacgcctctagtagcaaaccattcttttgcacaccacaatgtttccctcagtgccctttctcaaatgggtacaatgttcccttgtggccaaatttccctcccagggagcaatttcagtgctaggatcattggattcagttcccaaaatagaatgtttcagtgagaccatgagaattccaggctcacaaagggagaggagagaacagggcaagacgtttggtttcatttgtcaccatttttaaaactctgtatgctagcacaccaaactcttgtctatatttacctttgtaccacagtattaatcgctattgttcatgtatcgtgctggaagtctgaactgactctagaggatgaattagcaagagggtattttaccaggtatgatctgacttcagttgtgcccatgttataatgtgtttccgacataggagagtcgtgctgctgtctagatcttcttgaatgttgataaaaatgaatgactactacaatacattttgtgttgcttgttggatgaatttgcatgttaactgtaggccaatatagatttgcctttaaaactctggaagagctacatagtcatcattagtttctattaattatgcatcagacaaaagccatttgttaccaaactgggaaaacagaggcttttcttaactatttcacatactgtaacaaatatgaatttaaatttgtgatagcgctctggttgctctaagcataattaagaatttttgtaattaataggttgctaattatttatcactgctaaaaaggaaaaaaggcataaaatgaccttctactgattagattttcagttttctttcaaactggaaatgcctccataaatatgatctatgattttgcttcataaaacagcaaatcaatgttttatgtaaaatattaaagcattaatataaatatgtgagaataaaaacaatctaaatccagaaaatggcagtcctaaatgttcatgagacagattgtattaatttaaccaggactatgtagaagtagaaagaaaagaaaaagaaaatcttttttaaaccagaataaacattaaaaactattgcagaaaatagtggattttggattccaaacattttcgacagtgtaatggaaatttttctgtaattttcttaccatcgggtattttttaaagtattcattgagtttaccaaaagttactgtagcttaaaaggttttgtgagcactaactattggcagaaactgcatttgcaaataaaaataaatgtttgccttttc

SEQ ID NO: 163285 - DNA, 5905 bp, Homo sapiens
  Payload ID: 12172
  Gene Symbol: P2RX5-TAX1BP3
  Gene Name: P2RX5-TAX1BP3 readthrough (NMD candidate)
  ENST ID: ENST00000550383
  CDS Start-End: 190-1488
caaccgcgtcaataaaaggccgccccgacccgcccccgcgccccgcagccctgccggacaccccgggctgcagctgagcgggcgcagacgggccgaggcgggcgccgggcgcgcagggaccgagggaccgagtgctccccatgagcgcacgtgggccgggcggtccgcaagcccggctgagagcgcgccatggggcaggcgggctgcaaggggctctgcctgtcgctgttcgactacaagaccgagaagtatgtcatcgccaagaacaagaaggtgggcctgctgtaccggctgctgcaggcctccatcctggcgtacctggtcgtatgggtgttcctgataaagaagggttaccaagacgtcgacacctccctgcagagtgctgtcatcaccaaagtcaagggcgtggccttcaccaacacctcggatcttgggcagcggatctgggatgtcgccgactacgtcattccagcccagggagagaacgtcttttttgtggtcaccaacctgattgtgacccccaaccagcggcagaacgtctgtgctgagaatgaaggcattcctgatggcgcgtgctccaaggacagcgactgccacgctggggaagcggttacagctggaaacggagtgaagaccggccgctgcctgcggagagagaacttggccaggggcacctgtgagatctttgcctggtgcccgttggagacaagctccaggccggaggagccattcctgaaggaggccgaagacttcaccattttcataaagaaccacatccgtttccccaaattcaacttctccaaaagcaatgtgatggacgtcaaggacagatctttcctgaaatcatgccactttggccccaagaaccactactgccccatcttccgactgggctccgtgatccgctgggccgggagcgacttccaggatatagccctggagggtggcgtgataggaattaatattgaatggaactgtgatcttgataaagctgcctctgagtgccaccctcactattcttttagccgtctggacaataaactttcaaagtctgtctcctccgggtacaacttcagatttgccagatattaccgagacgcagccggggtggagttccgcaccctgatgaaagcctacgggatccgctttgacgtgatggtgaacggcaagggtgctttcttctgcgacctggtactcatctacctcatcaaaaagagagagttttaccgtgacaagaagtacgaggaagtgaggggcctagaagacagttcccaggaggccgaggacgaggcatcggggctggggctatctgagcagctcacatctgggccagggctgctggggatgccggagcagcaggagctgcaggagccacccgaggcgaagcgtggaagcagcagtcagaaggggaacggatctgtgtgcccacagctcctggagccccacaggctgaggactccctctgcttctcccttacaccaggaatgaacctttccttcccactcagaggaggttctgagaggactgaggtgggcaaaccactgaggatcttcagtgggggcagagaaagggctcactgagatggggggcaacgctatggcctcagcttctccttggcgtcgtgtgcatgtgttcctgaagccgaaacggaatttaacaggtctgggtcccagatccatttccatgactggccatgggctatctatgatctgtcaaaaggggacttggattcaagctctcagatccccttccaatctaaaacagattctttttttaaaaaaaatccaaatgtgattacgtcacttcagactaaaaacttccaaaggcttcccccatttgctctgaggatcaaggccagggcaaatgggagctcactgcagcctcaacctcctgggctcaagtgatcttgatcttcccattccagcctcctgagtagctggactacaggcgcatgtccccacacccattactgccctccatgatctggtctgggtctaccctgtggcctcttctctcactctctaaatacagtcacattccttcctgcccaatggcctggaaacatgcgctttcctgaaggtaactccttccccacacttgcctatgttattcaacttttgggtttcagatgtaatgttatttcctcagagaagacttccttgacctccatataccccaacttgggctaggtctgctatgtcctcttcatagtactcaccatgatttaagtatttctgaagttaggtgatgctggtttccccagttaaccataaatccaatgagcaccatcattttcattactgtaatttcttttttttttagacagggtctcgctgttgcctaggttggagtgtagtggcaaaatcgtggcttactgtggcctcaacctcccgggcccaggtgatcctgatcctcccacctcagcctcctgagtagctgggactacaggcacatgccaccacatctggctaattaaatgtttttttgtagagatgggcatctcactatgttgcccaggctggtcttgatctcctgggctcaagccttggcctcccaaagtgctgagatcacagcaggagccactacactcaggcaattaccgtcattctaatgcaatatttattcctcaattaaacaaatgcattttattcttttttttttgagagggagtttcgctcttgttgcccaggccggagtgcaatggcatgatctcggctcaccgcaacctctgcctcccaggttcaagagattctcctgcctcagccttcctagtagctgggattacaggcctgtgccaccacacccggctaattttgtatttttagtagagatggggtttctccatgttggtcaggctggtctcgaactcctgacctcaggtgatctgcccacctcggcctcccaaagtgctgggattacaggcatgagccaccgtgctcggccacaaatgcgttttattctaaaataaccctcctgacaagaaaggatcatggattaacacatggaggtgtttacaccctaaacctgcccaaagttcaacttcaatgtccaaacaatttttgtgttttttttgagatggaatcttgctgtcacccaggctggagtgcagtggtatgatcttggctcactgcaacctccacctccagggttcaagcgattctcctacctcagccacccaagtagctgggattacaggtgcccaccaccacgcctggctaatttttgcatcttatttttagtagagatggggtttcgccatgttggccaggcttgtctcaaactcctgacctcaggtgatctgcctgccgtcggactcccaaagtgctaggattacaggcgtgagccactgtgcccagcctaaatgtccaaacaatgtttaatcttccctagacatattctaaaaaatacagcttgactttattttttcttatggaaaggactgtcactaaatgaaatggaactaaaatgacaccatatatacctgaaagtagtggttagtgggagggaacgctggcctgtgaaaggtacacccagcaaacatatcaagagcaaattaagagacctgcatttgaatcctggctctgtctcttcctagctgtatctcctctgggagaagtatttaacctctctgagcctcaggttccttacgagggagctaacaataacatctaccctgtaaggttattgctaaaattaaatgagaggatcggtgtagagtagaagtcacaatgccagcatatagggaactcttttttttttttttttccctgagagacagacggagtcttgctccatcacccaggctggaatgcagtggcacgatctcggctcgctgcaacctctgcctccagggttcaagcgattctctttcctcagcctcccgagtacctggcattgcaggcgcgcgccaccacacccggctaatatttatatttttagtagagacggagttttgccatgttggccaggttggtcttgaactcctgacctcaggtgatccgcccacctcggcctcccaaagtgctgggattacagacatgagccaccgtgcccggcccagggagctcttaatacatattaactgttactgcttcttaggatgttaataagttctttccttatgtaggcccttagggcccgtttctgaatggcctatgtgtaaatacaaggacttaacacaaggctatggcccattccttgctctccaggagtcaaatctcggcgattttgcatcagtggcagcctaagcgttacagcaggaaagaactccacaaagtgtctcacgcttcatttaatctgaagaatattacaggctctccgtcttcagatataaattatttataacgttacagaacaagcagcgaattcaaccacttaagaactaaggaagtctacatggtgttaattgctggccacagtcctcccgatctggttttttaaaaaagtcccccgggcccccatttcagtagacgtgcaccatgccgtagaggaacgtccagaacaggacgtaggtgaagaggcccccgatgaggcctcctgtaaagagaggtctccgtgatttgaaatatttgttccacctccttcccgccttgagaatgaggagcagggagagcaggacggaggcgagcaggtagaagatgaagccgtagaggccggtgaggccgaggatgccggccgtggcccccgacagcgctgacaccgaggtccggcaataatccaggacggcggcgttgccccgcacggccgcctcgctgatgaacggcggcccttcccgcttggccaccaccgcggccatcgcaccagcccgggctcggcctctcgctttctcgcggaacaacgcggagctgcggagaaaaccaagttacaagtggcgcccggagctcgcaaagagttgaaattcacaagctgcgtcaaggtgagaacttaatcctgggtttcagcattggaggtggaatcgaccaggatccttcccagaatcccttctctgaagacaagacggacaagggtatttatgtcacacgggtgtctgaaggaggccctgctgaaatcgctgggctgcagattggagacaagatcatgcaggtgaacggctgggacatgaccatggtcacacacgaccaggcccgcaagcggctcaccaagcgctcggaggaggtggtgcgtctgctggtgacgcggcagtcgctgcagaaggccgtgcagcagtccatgctgtcctagcagccaccaccatctgcgactcctgcctgccgcctctctgtacagtaacgccacttccacactctgtccccatctggcttctgctgaccgctgggccccagctcagaagggctatagctggtcccagaggcctggcctggccttccttcccttctcccatccctggcctggggcctctgggaccggctttctctcctggacaccgaggattggaaataagggcctggagctgagtagtagccagtctgctgtgaccacaggctcaggtccgaccctgctgcttggccacagcagtggctgggcaagtgggaaccactatctcttgggagcccccaaaagctgggaaatgctggaggaaccaggcctttcccgcttttgcctggctgcagggttcggctccgcccctgccccccagccctcgtgtgtccacaccgcagtgcctctgcccctcgggggactggacacacatcctgccagaggcgctacgaagctttgcccagatgaagccaggtgggctccgcgttcactcccactctcccgaggggtgctggcctccccagggtttgccttcttacggatttagacgaggttcgaggctcacctatcagggcagctctcaggattgtcattttcctctttgcctgtgggtttaacttttgtatttttttaatcacaagtttgatac

SEQ ID NO: 163286 - DNA, 2532 bp, Homo sapiens
  Payload ID: 12173
  Gene Symbol: POR
  Gene Name: P450 (cytochrome) oxidoreductase
  Uniprot ID: P16435
  ENST ID: ENST00000394893
  CDS Start-End: 21-1922
agccgggctgccagcgtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcggtgtttggtcttgggaacaagacctacgagcacttcaatgccatgggcaagtacgtggacaagcggctggagcagctcggcgcccagcgcatctttgagctggggttgggcgacgacgatgggaacttggaggaggacttcatcacctggcgagagcagttctggccggccgtgtgtgaacactttggggtggaagccactggcgaggagtccagcattcgccagtacgagcttgtggtccacaccgacatagatgcggccaaggtgtacatgggggagatgggccggctgaagagctacgagaaccagaagcccccctttgatgccaagaatccgttcctggctgcagtcaccaccaaccggaagctgaaccagggaaccgagcgccacctcatgcacctggaattggacatctcggactccaaaatcaggtatgaatctggggaccacgtggctgtgtacccagccaacgactctgctctcgtcaaccagctgggcaaaatcctgggtgccgacctggacgtcgtcatgtccctgaacaacctggatgaggagtccaacaagaagcacccattcccgtgccctacgtcctaccgcacggccctcacctactacctggacatcaccaacccgccgcgtaccaacgtgctgtacgagctggcgcagtacgcctcggagccctcggagcaggagctgctgcgcaagatggcctcctcctccggcgagggcaaggagctgtacctgagctgggtggtggaggcccggaggcacatcctggccatcctgcaggactgcccgtccctgcggccccccatcgaccacctgtgtgagctgctgccgcgcctgcaggcccgctactactccatcgcctcatcctccaaggtccaccccaactctgtgcacatctgtgcggtggttgtggagtacgagaccaaggctggccgcatcaacaagggcgtggccaccaactggctgcgggccaaggagcctgccggggagaacggcggccgtgcgctggtgcccatgttcgtgcgcaagtcccagttccgcctgcccttcaaggccaccacgcctgtcatcatggtgggccccggcaccggggtggcacccttcataggcttcatccaggagcgggcctggctgcgacagcagggcaaggaggtgggggagacgctgctgtactacggctgccgccgctcggatgaggactacctgtaccgggaggagctggcgcagttccacagggacggtgcgctcacccagctcaacgtggccttctcccgggagcagtcccacaaggtctacgtccagcacctgctaaagcaagaccgagagcacctgtggaagttgatcgaaggcggtgcccacatctacgtctgtgggtgagtgagtggggtcactggaatagggggcagggaggacaaggccctgcctgccacagttggcccagcccccagcaccccctcttcctgcccagggatgcacggaacatggccagggatgtgcagaacaccttctacgacatcgtggctgagctcggggccatggagcacgcgcaggcggtggactacatcaagaaactgatgaccaagggccgctactccctggacgtgtggagctaggggcctgcctgccccacccaccccacagactccggcctgtaatcagctctcctggctccctcccgtagtctcctgggtgtgtttggcttggccttggcatgggcgcaggcccagtgacaaagactcctctgggcctggggtgcatcctcctcagcccccaggccaggtgaggtccaccggcccctggcagcacagcccagggcctgcatgggggcaccgggctccatgcctctggaggcctctggccctcggtggctgcacagaagggctctttctctctgctgagctgggcccagcccctccacgtgatttccagtgagtgtaaataattttaaataacctctggcccttggaataaagttctgttttctgta

SEQ ID NO: 163287 - DNA, 561 bp, Homo sapiens
  Payload ID: 12173
  Gene Symbol: POR
  Gene Name: P450 (cytochrome) oxidoreductase
  Uniprot ID: P16435
  ENST ID: ENST00000432753
  CDS Start-End: 63-561
gcacttgagaactctcacagggagggaagcaagcatacaattcaacaagaatggcacgtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctct

SEQ ID NO: 163288 - DNA, 736 bp, Homo sapiens
  Payload ID: 12173
  Gene Symbol: POR
  Gene Name: P450 (cytochrome) oxidoreductase
  Uniprot ID: P16435
  ENST ID: ENST00000418341
  CDS Start-End: 549-736
aagaaaagttgctatattttgcaaaagacataaatctacagattcaagaaactgagtgaaccccacagaaggtataaagaagaaactcagagattaaagactctttcagggcagaaggctcacacaggcttccagaacctcctcggagcgattgtagggactgcctgacccggaagagagttgtcagtcaagaccgccagagttttcccatcagagtatttggcatagcagaggtggctcccaaactgtgccagggcactgcagcaaactcacaagtgatcattctcaatgcggcggacgctcaagtctgttgaactccatgcgaagtgctagcttgggacagttcacggttccaacgtgagatccttgctgcattccttcttaggattttacatctttgcgaagctgggtttgcagtggttgttcagacctaactatacgtggaactgttaggcatttttttttggcctacggataccattaaaaatttgctgagataccagggactccacaaacgaaggacatttgggatctgtccagacagtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacatt

SEQ ID NO: 163289 - DNA, 625 bp, Homo sapiens
  Payload ID: 12173
  Gene Symbol: POR
  Gene Name: P450 (cytochrome) oxidoreductase
  Uniprot ID: P16435
  ENST ID: ENST00000439963
  CDS Start-End: 61-625
agcaaggagaccggaagaaggtctggggaagttatttggacaatgaagagagccagtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcggtgtttggtcttgggaacaagacctacgagcacttcaatgccatgggca

SEQ ID NO: 163290 - DNA, 2332 bp, Homo sapiens
  Payload ID: 12173
  Gene Symbol: POR
  Gene Name: P450 (cytochrome) oxidoreductase
  ENST ID: ENST00000447222
  CDS Start-End: 1-2176
gacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcggtgagtcacccagagactgctatgggctcccggtggcctgcggtgcctccctggggactccagatccatgtatctgaaaggcagccctccagacccccaccctgtcctcagcagccagggcaggccacttgtgagaccctctcctctgccccagaccccagcactacgagaatgtcccctccctgtccccagccccagtcggctccagggggcattgggtgctggagactaaaggtgtttggtcttgggaacaagacctacgagcacttcaatgccatgggcaagtacgtggacaagcggctggagcagctcggcgcccagcgcatctttgagctggggttgggcgacgacgatgggaacttggaggaggacttcatcacctggcgagagcagttctggccggccgtgtgtgaacactttggggtggaagccactggcgaggagtccagcattcgccagtacgagcttgtggtccacaccgacatagatgcggccaaggtgtacatgggggagatgggccggctgaagagctacgagaaccagaagcccccctttgatgccaagaatccgttcctggctgcagtcaccaccaaccggaagctgaaccagggaaccgagcgccacctcatgcacctggaattggacatctcggactccaaaatcaggtatgaatctggggaccacgtggctgtgtacccagccaacgactctgctctcgtcaaccagctgggcaaaatcctgggtgccgacctggacgtcgtcatgtccctgaacaacctggatgaggagtccaacaagaagcacccattcccgtgccctacgtcctaccgcacggccctcacctactacctggacatcaccaacccgccgcgtaccaacgtgctgtacgagctggcgcagtacgcctcggagccctcggagcaggagctgctgcgcaagatggcctcctcctccggcgagggcaaggagctgtacctgagctgggtggtggaggcccggaggcacatcctggccatcctgcaggactgcccgtccctgcggccccccatcgaccacctgtgtgagctgctgccgcgcctgcaggcccgctactactccatcgcctcatcctccaaggtccaccccaactctgtgcacatctgtgcggtggttgtggagtacgagaccaaggctggccgcatcaacaagggcgtggccaccaactggctgcgggccaaggagcctgccggggagaacggcggccgtgcgctggtgcccatgttcgtgcgcaagtcccagttccgcctgcccttcaaggccaccacgcctgtcatcatggtgggccccggcaccggggtggcacccttcataggcttcatccaggagcgggcctggctgcgacagcagggcaaggaggtgggggagacgctgctgtactacggctgccgccgctcggatgaggactacctgtaccgggaggagctggcgcagttccacagggacggtgcgctcacccagctcaacgtggccttctcccgggagcagtcccacaaggtctacgtccagcacctgctaaagcaagaccgagagcacctgtggaagttgatcgaaggcggtgcccacatctacgtctgtggcaccccctcttcctgcccagggatgcacggaacatggccagggatgtgcagaacaccttctacgacatcgtggctgagctcggggccatggagcacgcgcaggcggtggactacatcaagaaactgatgaccaagggccgctactccctggacgtgtggagctaggggcctgcctgccccacccaccccacagactccggcctgtaatcagctctcctggctccctcccgtagtctcctgggtgtgtttggcttggccttggcatgggcgcaggcccagtgac

SEQ ID NO: 163291 - DNA, 498 bp, Homo sapiens
  Payload ID: 12173
  Gene Symbol: POR
  Gene Name: P450 (cytochrome) oxidoreductase
  Uniprot ID: P16435
  ENST ID: ENST00000453773
  CDS Start-End: 78-498
agaccgccctcagcacaggacctgccctggctggtcagccctgcctggggcacccacagccccagctgtccagtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatgg

SEQ ID NO: 163292 - DNA, 548 bp, Homo sapiens
  Payload ID: 12173
  Gene Symbol: POR
  Gene Name: P450 (cytochrome) oxidoreductase
  Uniprot ID: P16435
  ENST ID: ENST00000414186
  CDS Start-End: 33-548
gagtgctatctttcgcggcgacggcgggtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcg

SEQ ID NO: 163293 - DNA, 1104 bp, Homo sapiens
  Payload ID: 12173
  Gene Symbol: POR
  Gene Name: P450 (cytochrome) oxidoreductase
  ENST ID: ENST00000448410
  CDS Start-End: 36-341
gtgcccgcagagagcagccgggctgccagcgtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggtgagtttcctgcatgtctttactcttctcaggaagcctcggccccgatgggcatgtaatcaagtctagcagacggctggcgtcaccgcatagaggatgtcccggtggccaggagagggaacgcagcccggctcgcttgggagtcattcttgcctaaccaaagccctgaagcagctctgctgttgctgggacagtttgtttccttgaatctttactttttgaacaaaccaaagtctaagaacagaccctccctctaactcacgaagcttctcccgtctggccctggcctgtccaggagcagaggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcggtgagtcacccagagactgctatgggctcccggtggcctgcggtgcctccctggggactccagatccatgtatctgaaaggcagccctccagacccccaccctgtcctcagcagccagggcaggccacttgtgagaccctctcctctgccccagaccccagcactacgagaatgtcccctccctgtccccagccccagtcggctccagggggcattgggtgctggagactaaaggcaagaaaggtctggc

SEQ ID NO: 163294 - DNA, 283 bp, Homo sapiens
  Payload ID: 12173
  Gene Symbol: POR
  Gene Name: P450 (cytochrome) oxidoreductase
  Uniprot ID: P16435
  ENST ID: ENST00000449920
  CDS Start-End: 96-283
gacttcctgggccctgaagctccaaggacaaaagactcctgtcccttttcccttcctctccattctgggtctcccaccaccaccaagtccttttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacatt

SEQ ID NO: 163295 - DNA, 565 bp, Homo sapiens
  Payload ID: 12173
  Gene Symbol: POR
  Gene Name: P450 (cytochrome) oxidoreductase
  ENST ID: ENST00000426184
  CDS Start-End: 240-565
agatgttgcagagttcttgggctcatgggggcagacgcaggcaggagctcagggaaattccgagaggactttggggtgtccaggagcactttgaggccacgggcccaggcaacttcctcaccagtacggaacaggggatgcacagggccgaactttccatctgctggcccctgctggtgtccaggagagagctgtgaccctcctttttccttaagtcctggagctgagagtgagaagccatggggtgcacgtactcgtctccacctgaggagcccgctctgagaaggacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttcta

SEQ ID NO: 163296 - DNA, 569 bp, Homo sapiens
  Payload ID: 12173
  Gene Symbol: POR
  Gene Name: P450 (cytochrome) oxidoreductase
  ENST ID: ENST00000439297
  CDS Start-End: 407-569
atgttgcagagttcttgggctcatgggggcagacgcaggcaggagctcagggaaattccgagaggactttggggtgtccaggagcactttgaggccacgggcccaggcaacttcctcaccagtacggaacaggggatgcacagggccgaactttccatctgctggcccctgctggtgtccaggagagagctgtgaccctcctttttccttaagtcctggagctgagagtgagaagccatggggtgcacgtactcgtctccacctgaggagcccgctctgagaaggtcagttcctgacactgtccctggcggcagactgccctcatgccccttggccaggggacgcctgcaccctcactcgagtgtgggagacttcctcctggcggggacctgctggaggcctgaagatgcggctgcctggagttaacagcaaggacctcctctgtcagagagagcagctttgtggaaaagatgaagaaaacggggaggaacatcatcgtgttctacggctcccagacggggactgcagaggagtttgccaaccgcctgtccaaggacgcccaccgctac

SEQ ID NO: 163297 - DNA, 1044 bp, Homo sapiens
  Payload ID: 12173
  Gene Symbol: POR
  Gene Name: P450 (cytochrome) oxidoreductase
  Uniprot ID: P16435
  ENST ID: ENST00000412064
  CDS Start-End: 5-640
tttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcggtgtttggtcttgggaacaagacctacgagcacttcaatgccatgggcaaatgcggccaaggtgtacatgggggagatgggccggctgaagagctacgagaaccagaagcccccctttgatgccaagaatccgttcctggctgcagtcaccaccaaccggaagctgaaccagggaaccgagcgccacctcatgcacctggaattggacatctcggactccaaaatcagtcccacaaggtctacgtccagcacctgctaaagcaagaccgagagcacctgtggaagttgatcgaaggcggtgcccacatctacgtctgtggggatgcacggaacatggccagggatgtgcagaacaccttctacgacatcgtggctgagctcggggccatggagcacgcgcaggcggtggactacatcaagaaactgatgaccaagggccgctactccctggacgtgtggagctaggggcctgcctgccccacccaccccacagactccggcctgtaatcagctctcctggctcc

SEQ ID NO: 163298 - DNA, 586 bp, Homo sapiens
  Payload ID: 12173
  Gene Symbol: POR
  Gene Name: P450 (cytochrome) oxidoreductase
  Uniprot ID: P16435
  ENST ID: ENST00000412521
  CDS Start-End: 148-586
ccagcggtgagtgctatctttcgcggcgacggcgggcatcaggtgggctgagtcgatggatcacgggagccccccagcccggcctgcatccctgagggcagtgcccctcgcagtcaggtgtctcggcggcccccacaacacagtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggag

SEQ ID NO: 163299 - DNA, 631 bp, Homo sapiens
  Payload ID: 12173
  Gene Symbol: POR
  Gene Name: P450 (cytochrome) oxidoreductase
  ENST ID: ENST00000421059
  CDS Start-End: 515-631
agagagcagccgggctgccagcggtgagtgctatctttcgcggcgacggcggggtgggtgaggtcgggccccaagactcggggtttgccgggcgcctcagttcaccgcggccgcctggctctctgcgtcggggtgggccctcgggcctgggcactgcgcgtctggcccgacgctcgggcggaaggcatggctcccaccccggccctcctccgcgtcgcccttcccctagagctgatctcccgcggcggcctgagggtcgacttttccacagcttgggccgagagagcccggcaggccctcggctgagggttagggctcggtatctcagggctcggggtccagtccccgcgccgccgccccccacgggctaagccactttaactctccgagcctcagtttccccatctgtacgatgaatgggcctcgggaggcagcgaattctgggggtacctaacgtgagaggcgctcgatgcatgctcatgggacccgaatctaaccctgcagcatcagtttcatgatcaacatgggagactcccacgtggacaccagctccaccgtgtccgaggcggtggccgaagaagtatctcttttcagcatgacggacatgattctgttttcgctcatcgtgggt

SEQ ID NO: 163300 - DNA, 1858 bp, Homo sapiens
  Payload ID: 12173
  Gene Symbol: POR
  Gene Name: P450 (cytochrome) oxidoreductase
  ENST ID: ENST00000439269
  CDS Start-End: 251-1507
ataacgttcctctctgtgcccttgatggcccctgggtgctgcccgggcttccttaccttctcccagatggaagcctgcccagccctgccccggcttctgggcgtctggcccccggcagctccacgccgcctccctccttgctccctcgcctgccctccttgtgcatctgcagcaggggctcccctgcttcttgtccattcgccagtacgagcttgtggtccacaccgacatagatgcggccaaggtgtacatgggggagatgggccggctgaagagctacgagaaccagaagcccccctttgatgccaagaatccgttcctggctgcagtcaccaccaaccggaagctgaaccagggaaccgagcgccacctcatgcacctggaattggacatctcggactccaaaatcaggtatgaatctggggaccacgtggctgtgtacccagccaacgactctgctctcgtcaaccagctgggcaaaatcctgggtgccgacctggacgtcgtcatgtccctgaacaacctggatgaggagtccaacaagaagcacccattcccgtgccctacgtcctaccgcacggccctcacctactacctggacatcaccaacccgccgcgtaccaacgtgctgtacgagctggcgcagtacgcctcggagccctcggagcaggagctgctgcgcaagatggcctcctcctccggcgagggcaaggagctgtacctgagctgggtggtggaggcccggaggcacatcctggccatcctgcaggactgcccgtccctgcggccccccatcgaccacctgtgtgagctgctgccgcgcctgcaggcccgctactactccatcgcctcatcctccaaggtccaccccaactctgtgcacatctgtgcggtggttgtggagtacgagaccaaggctggccgcatcaacaagggcgtggccaccaactggctgcgggccaaggagcctgccggggagaacggcggccgtgcgctggtgcccatgttcgtgcgcaagtcccagttccgcctgcccttcaaggccaccacgcctgtcatcatggtgggccccggcaccggggtggcacccttcataggcttcatccaggagcgggcctggctgcgacagcagggcaaggaggtgggggagacgctgctgtactacggctgccgccgctcggatgaggactacctgtaccgggaggagctggcgcagttccacagggacggtgcgctcacccagctcaacgtggccttctcccgggagcagtcccacaaggtctacgtccagcacctgctaaagcaagaccgagagcacctgtggaagttgatcgaaggcggtgcccacatctacgtctgtggggatgcacggaacatggccagggatgtgcagaacaccttctacgacatcgtggctgagctcggggccatggagcacgcgcaggcggtggactacatcaagaaactgatgaccaagggccgctactccctggacgtgtggagctaggggcctgcctgccccacccaccccacagactccggcctgtaatcagctctcctggctccctcccgtagtctcctgggtgtgtttggcttggccttggcatgggcgcaggcccagtgacaaagactcctctgggcctggggtgcatcctcctcagcccccaggccaggtgaggtccaccggcccctggcagcacagcccagggcctgcatgggggcaccgggctccatgcctctggaggcctctggccctcggtggctgcacagaagggctctttctctctgctgagctgggcccagcccctccacgtgatttccagtgagtgtaaataattttaaataacctctggccctt

SEQ ID NO: 163301 - DNA, 2295 bp, Homo sapiens
  Payload ID: 12173
  Gene Symbol: POR
  Gene Name: P450 (cytochrome) oxidoreductase
  Uniprot ID: P16435
  ENST ID: ENST00000454934
  CDS Start-End: 5-574
tttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcgcttggaggaggacttcatcacctggcgagagcagttctggccggccgtgtgtgaacactttggggtggaagccactggcgaggagtccagcattcgccagtacgagcttgtggtccacaccgacatagatgcggccaaggtgtacatgggggagatgggccggctgaagagctacgagaaccagaagcccccctttgatgccaagaatccgttcctggctgcagtcaccaccaaccggaagctgaaccagggaaccgagcgccacctcatgcacctggaattggacatctcggactccaaaatcaggtatgaatctggggaccacgtggctgtgtacccagccaacgactctgctctcgtcaaccagctgggcaaaatcctgggtgccgacctggacgtcgtcatgtccctgaacaacctggatgaggagtccaacaagaagcacccattcccgtgccctacgtcctaccgcacggccctcacctactacctggacatcaccaacccgccgcgtaccaacgtgctgtacgagctggcgcagtacgcctcggagccctcggagcaggagctgctgcgcaagatggcctcctcctccggcgagggcaaggagctgtacctgagctgggtggtggaggcccggaggcacatcctggccatcctgcaggactgcccgtccctgcggccccccatcgaccacctgtgtgagctgctgccgcgcctgcaggcccgctactactccatcgcctcatcctccaaggtccaccccaactctgtgcacatctgtgcggtggttgtggagtacgagaccaaggctggccgcatcaacaagggcgtggccaccaactggctgcgggccaaggagcctgccggggagaacggcggccgtgcgctggtgcccatgttcgtgcgcaagtcccagttccgcctgcccttcaaggccaccacgcctgtcatcatggtgggccccggcaccggggtggcacccttcataggcttcatccaggagcgggcctggctgcgacagcagggcaaggaggtgggggagacgctgctgtactacggctgccgccgctcggatgaggactacctgtaccgggaggagctggcgcagttccacagggacggtgcgctcacccagctcaacgtggccttctcccgggagcagtcccacaaggtctacgtccagcacctgctaaagcaagaccgagagcacctgtggaagttgatcgaaggcggtgcccacatctacgtctgtggggatgcacggaacatggccagggatgtgcagaacaccttctacgacatcgtggctgagctcggggccatggagcacgcgcaggcggtggactacatcaagaaactgatgaccaagggccgctactccctggacgtgtggagctaggggcctgcctgccccacccaccccacagactccggcctgtaatcagctctcctggctccctcccgtagtctcctgggtgtgtttggcttggccttggcatgggcgcaggcccagtgacaaagactcctctgggcctggggtgcatcctcctcagcccccaggccaggtgaggtccaccggcccctggcagcacagcccagggcctgcatgggggcaccgggctccatgcctctggaggcctctggccctcggtggctgcacagaagggctctttctctctgctgagctgggcccagcccctccacgtgatttccagtgagtgtaaataattttaaataacctctggcccttggaataaagttctgttttctgt

SEQ ID NO: 163302 - DNA, 2522 bp, Homo sapiens
  Payload ID: 12173
  Gene Symbol: POR
  Gene Name: P450 (cytochrome) oxidoreductase
  Uniprot ID: P16435
  ENST ID: ENST00000461988
  CDS Start-End: 106-2148
acgcccccacccccgcggccggcgaaggcggtggtagcgcctcagtggtgtgggcctgagccctgcccaggtgcccgcagagagcagccgggctgccagcgtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcggtgtttggtcttgggaacaagacctacgagcacttcaatgccatgggcaagtacgtggacaagcggctggagcagctcggcgcccagcgcatctttgagctggggttgggcgacgacgatgggaacttggaggaggacttcatcacctggcgagagcagttctggccggccgtgtgtgaacactttggggtggaagccactggcgaggagtccagcattcgccagtacgagcttgtggtccacaccgacatagatgcggccaaggtgtacatgggggagatgggccggctgaagagctacgagaaccagaagcccccctttgatgccaagaatccgttcctggctgcagtcaccaccaaccggaagctgaaccagggaaccgagcgccacctcatgcacctggaattggacatctcggactccaaaatcaggtatgaatctggggaccacgtggctgtgtacccagccaacgactctgctctcgtcaaccagctgggcaaaatcctgggtgccgacctggacgtcgtcatgtccctgaacaacctggatgaggagtccaacaagaagcacccattcccgtgccctacgtcctaccgcacggccctcacctactacctggacatcaccaacccgccgcgtaccaacgtgctgtacgagctggcgcagtacgcctcggagccctcggagcaggagctgctgcgcaagatggcctcctcctccggcgagggcaaggagctgtacctgagctgggtggtggaggcccggaggcacatcctggccatcctgcaggactgcccgtccctgcggccccccatcgaccacctgtgtgagctgctgccgcgcctgcaggcccgctactactccatcgcctcatcctccaaggtccaccccaactctgtgcacatctgtgcggtggttgtggagtacgagaccaaggctggccgcatcaacaagggcgtggccaccaactggctgcgggccaaggagcctgccggggagaacggcggccgtgcgctggtgcccatgttcgtgcgcaagtcccagttccgcctgcccttcaaggccaccacgcctgtcatcatggtgggccccggcaccggggtggcacccttcataggcttcatccaggagcgggcctggctgcgacagcagggcaaggaggtgggggagacgctgctgtactacggctgccgccgctcggatgaggactacctgtaccgggaggagctggcgcagttccacagggacggtgcgctcacccagctcaacgtggccttctcccgggagcagtcccacaaggtctacgtccagcacctgctaaagcaagaccgagagcacctgtggaagttgatcgaaggcggtgcccacatctacgtctgtggggatgcacggaacatggccagggatgtgcagaacaccttctacgacatcgtggctgagctcggggccatggagcacgcgcaggcggtggactacatcaagaaactgatgaccaagggccgctactccctggacgtgtggagctaggggcctgcctgccccacccaccccacagactccggcctgtaatcagctctcctggctccctcccgtagtctcctgggtgtgtttggcttggccttggcatgggcgcaggcccagtgacaaagactcctctgggcctggggtgcatcctcctcagcccccaggccaggtgaggtccaccggcccctggcagcacagcccagggcctgcatgggggcaccgggctccatgcctctggaggcctctggccctcggtggctgcacagaagggctctttctctctgctgagctgggcccagcccctccacgtgatttccagtgagtgtaaataattttaaataacctctggcccttggaataaagttctgttttctgta

SEQ ID NO: 163303 - DNA, 1998 bp, Homo sapiens
  Payload ID: 12174
  Gene Symbol: PDRG1
  Gene Name: p53 and DNA-damage regulated 1
  Uniprot ID: Q9NUG6
  ENST ID: ENST00000202017
  CDS Start-End: 132-533
agcctgcgcaccaccgttcttttaactgcgcaggcgcgccggaagcacctagagagcggcgcgtgcgcagcgggagtcgaagcggagatcccggggtcgcgcgagagccgcaagcggagttggtgggcgctatgctatcacccgaggcagagcgagtgctgcggtaccttgtagaagtggaggagctcgccgaggaggtgctggcggacaagcggcagattgtggacctggacactaaaaggaatcagaatcgagagggcctgagggccctgcagaaggatctcagcctctctgaagatgtgatggtttgcttcgggaacatgtttatcaagatgcctcaccctgagacaaaggaaatgattgaaaaagatcaagatcatctggataaagaaatagaaaaactgcggaagcaacttaaagtgaaggtcaaccgcctttttgaggcccaaggcaaaccggagctgaagggttttaacttgaaccccctcaaccaggatgagcttaaagctctcaaggtcatcttgaaaggatgagactcaagaaccaagatgggggaccagcaaccccccagggtcatggaggacccaggaccctccaaccttgacacctgtaaggacaggatctgccctgtaaggggccagccgtcaggaatctggccatgaaaacctctttgtagtgcttggctactctgtgatggcaggagggaaccttcagcctgtctggctgctggacctggacaccagggctcggtggacacaagatctattgacgggccttggtagccaccagtgggtgtgtggggcagtggctgtgggggtgtaagaatgactgcaacaggcacttcccaacaatggcctgctgttcacatggaccctgagcaaggaaggagggagggaggggcagagtggagtgtcattccagcattcctctcagaagggagagaggttttcaggctggtgccatgcgattggaataaagcaggaggctcatgggtggttgctgaatgaagaacagaatcttggtgctttgtggctcaccacagccatctgtggggcaggcacacacacctcccgccagctccaattttgcactttttccctgcttgattccaagagtaggtgctgcctagcagcccttcgtggccactctttactcaggagggccttgcagagtcctgcaccaggcctgggtgagtggatgcgcctcttaccatatgacacgtgtcaagatgcccttccgccccctctgaaagtggggcccggccagcactgctcgttactgtctgccttcagtggtctgaggtcccagtatgaactgccgtgaagtcaaaactcttatgtgttcattaagggctcaataaatgttagctgaatgaatgaatagcagcaactagtctttatttgcctcatctagtccttcagtaagggcacgccactccatttagaatacaacctatgaacatggttcttgccttgaaataaacctgtgatttgacaggcgggtgataacaaatggcagcatggcaggggcacacctctcctggtccccccgctccttggctctggctcatagttacatagaaacacaggctgtcatggccagttcttacgtgttttcaagagaagctagacatatgggttgtgaagttgaatctccttttaaatatttttgactaatgcagaaacttttaaaacatgagtgtgggtcacaggtgttagctccagatagtgcaataccatacaactataatcaagaataaggaacaagctccaagatacatcaagtgaggaaagcaaggggaaggctggtgtcttataagctaataatttttgtgcaagcacagtgtgattccctcagaacagcacctgcagggttggggcgcacaggtgggagggaaggagatgtcaccctatacccttttgtaaactttggattttaaaccgtatgaatatattgcttattttaaaatgtaaataaagtagggagttgcagaattca

SEQ ID NO: 163304 - DNA, 2998 bp, Homo sapiens
  Payload ID: 12175
  Gene Symbol: PIDD1
  Gene Name: p53-induced death domain protein 1
  Uniprot ID: Q9HB75
  ENST ID: ENST00000347755
  CDS Start-End: 143-2875
gccggcgggatcccaggcgccgagcgcccgctgagcagccaccctttgcgcgccgcctgcagcgcagcttccccgggcgctgcctggacaggcctgcctgcgtgctgggacatgtctggcctccaaggaccgtcggtgggcgatggctgcaacggtggaggggccagagctggaggcagctgctgccgcaggagatgcttcagaggattcggacgcagggtccagggcgctgcctttcctgggcggcaaccggctgagcttggacctgtaccccgggggctgccagcagctgctgcacctgtgtgtccagcagcctctgcagctgctgcaggtggaattcttgcgtctgagcactcacgaggaccctcagctgctggaggccaccctggcccagctgcctcagagcctgtcctgcctccgctccctggtcctcaaaggagggcaacgccgggacacactgggtgcctgtctccggggtgccctgaccaacctgcccgctggtctgagtggcctggcccatctggcccacctggacctgagcttcaacagcctggagacactgccggcctgtgtcctgcagatgcgaggtctgggtgcgctcttgctgtctcacaactgcctctctgagctgcctgaggctctgggggccctccccgccctcaccttcctcacagtgacacacaaccgcctgcagacgctgcccccagcactgggggccctatccaccctgcagcgcctcgatctctctcagaatctgctggacacgctacctcctgagattggaggcctgggcagcctcctggagctcaacctggcctccaaccggctgcagagcctcccagcctctctggcgggacttcggtccttgcggctccttgtcctgcacagcaacctcctggcctctgtgccagctgacttggcccgccttccactcctcacccggctcgacctgagggacaaccagctccgggacctgccccctgagctgctagacgccccctttgtgcgcctgcaggggaaccccctgggtgaggcctcgccagacgccccgagttcaccagtggcagccctcattccagaaatgcccagactgttcctgacctcagatttggacagctttcctgtgacccctcaaggctgctcagtgaccctggcctgtggcgtccgcctgcagttcccagcgggagccaccgccacccccatcaccatccgctatcggctgctgctgccggagccaggcctcgtccccctgggtcctcatgacgccctgctcagccatgtgctggagctgcagccccatggggtggccttccagcaggatgtggggctgtggctgctcttcaccccaccgcaggcccggcgctgccgtgaagtggtggtcaggacccggaatgacaacagctggggtgacctggagacctacctggaggaagaggcaccccagcggctctgggctcactgccaggtgccccacttctcctggttccttgtggtttcccgccctgtgtccaatgcctgcctggtgccaccggaggggacactgctgtgctcctcgggtcatcctggggtcaaagtcatcttcccccctggggccactgaggagcctcgtcgagtctccatgcaggtggtgcgcatggctggccgagagctgcaggccctcctgggagaaccagaggctgcagtgagccccctgctgtgcctgtcacagagcggtccccccagcttcctccaaccggtcaccgtgcagctgcctctgccctctggcatcacaggcctcagtctggaccgctcccgcctgcacctgttgtactgggcccctcctgcagccacctgggatgacatcacagctcaggtggtcctggagctcacccacctgtacgcacgcttccaggtcacacacttctcctggtactggctctggtacaccaccaagaactgtgtgggaggcctggctcggaaggcctgggagcggctgcggctgcaccgtgtgaacctcatcgctctgcagcggcgccgggaccctgagcaggtcctgctgcagtgcctgccccgaaacaaggtggacgccacccttcggcggctgctggagcggtaccggggccccgagccctctgacacggtggagatgttcgagggcgaagagttctttgcggccttcgagcgcggcatcgacgtggatgctgaccgccctgactgtgtggagggcagaatctgctttgtcttctactcgcacctgaagaatgtgaaggaggtatacgtgaccaccactctggaccgggaggctcaggctgtgcggggccaggtgtccttctaccgtggcgcggtgcctgtgcgggtgcccgaggaggctgaggctgcccggcagaggaagggcgcagacgccctgtggatggccactctgcccatcaagctgccgagacttcgagggtccgaggggccacggcggggggctggcctctccttggcacccttgaatctgggagatgccgagaccggctttctgacgcagagcaacctgctgagtgtggctgggcgtctgggtctggactggccagccgtggccctgcacctgggggtgtcctaccgggaggtgcagcgcatccggcacgagttccgggatgatctggatgagcagatccgtcacatgctcttctcctgggctgagcgccaggctgggcagccaggggctgtggggctcctggtgcaggccctggagcagagtgaccggcaggacgtggctgaagaggtgcgcgcagtcttggagctcggccgccgcaagtaccaggacagcatccgacgcatgggcttggcccccaaggaccccgctctgcctggctcctcggctccacagcccccagagcctgcccaggcctaggccccacagacttttaggctggcccagatattccccagtggatgggcagagcccccaccttcaagtctctccagtgtgtggggacgggtccctgtgagcaacaaaactgcactgtttctttca

SEQ ID NO: 163305 - DNA, 2886 bp, Homo sapiens
  Payload ID: 12175
  Gene Symbol: PIDD1
  Gene Name: p53-induced death domain protein 1
  Uniprot ID: Q9HB75
  ENST ID: ENST00000411829
  CDS Start-End: 82-2763
ctgcagcttccccgggcgctgcctggacaggcctgcctgcgtgctgggacatgtctggcctccaaggaccgtcggtgggcgatggctgcaacggtggaggggccagagctggaggcagctgctgccgcaggagatgcttcagaggattcggacgcagggtccagggcgctgcctttcctgggcggcaaccggctgagcttggacctgtaccccgggggctgccagcagctgctgcacctgtgtgtccagcagcctctgcagctgctgcaggtggaattcttgcgtctgagcactcacgaggaccctcagctgctggaggccaccctggcccagctgcctcagagcctgtcctgcctccgctccctggtcctcaaaggagggcaacgccgggacacactgggtgcctgtctccggggtgccctgaccaacctgcccgctggtctgagtggcctggcccatctggcccacctggacctgagcttcaacagcctggagacactgccggcctgtgtcctgcagatgcgaggtctgggtgcgctcttgctgtctcacaactgcctctctgagctgcctgaggctctgggggccctccccgccctcaccttcctcacagtgacacacaaccgcctgcagacgctgcccccagcactgggggccctatccaccctgcagcgcctcgatctctctcagaatctgctggacacgctacctcctgagattggaggcctgggcagcctcctggagctcaacctggcctccaaccggctgcagagcctcccagcctctctggcgggacttcggtccttgcggctccttgtcctgcacagcaacctcctggcctctgtgccagctgacttggcccgccttccactcctcacccggctcgacctgagggacaaccagctccgggacctgccccctgagctgctagacgccccctttgtgcgcctgcaggggaaccccctgggtgaggcctcgccagacgccccgagttcaccagtggcagccctcattccagaaatgcccagactgttcctgacctcagatttggacagctttcctgtgacccctcaaggctgctcagtgaccctggcctgtggcgtccgcctgcagttcccagcgggagccaccgccacccccatcaccatccgctatcggctgctgctgccggagccaggcctcgtccccctgggtcctcatgacgccctgctcagccatgtgctggagctgcagccccatggggtggccttccagcaggatgtggggctgtggctgctcttcaccccaccgcaggcccggcgctgccgtgaagtggtggtcaggacccggaatgacaacagctggggtgacctggagacctacctggaggaagaggcaccccagcggctctgggctcactgccaggtgccccacttctcctggttccttgtggtttcccgccctgtgtccaatgcctgcctggtgccaccggaggggacactgctgtgctcctcgggtcatcctggggtcaaagtcatcttcccccctggggccactgaggagcctcgtcgagtctccatgcaggtggtgcgcatggctggccgagagctgcaggccctcctgggagaaccagaggctgcagtgagccccctgctgtgcctgtcacagagcggtccccccagcttcctccaaccggtcaccgtgcagctgcctctgccctctggcatcacaggcctcagtctggaccgctcccgcctgcacctgttgtactgggcccctcctgcagccacctgggatgacatcacagctcaggtggtcctggagctcacccacctgtacgcacgcttccaggtcacacacttctcctggtactggctctggtacaccaccaagaactgtgtgggaggcctggctcggaaggcctgggagcggctgcggctgcaccgtgtgaacctcatcgctctgcagcggcgccgggaccctgagcaggtcctgctgcagtgcctgccccgaaacaaggtggacgccacccttcggcggctgctggagcggtaccggggccccgagccctctgacacggtggagatgttcgagggcgaagagttctttgcggccttcgagcgcggcatcgacgtggatgctgaccgccctgactgtgtggagggcagaatctgctttgtcttctactcgcacctgaagaatgtgaaggaggtgtccttctaccgtggcgcggtgcctgtgcgggtgcccgaggaggctgaggctgcccggcagaggaagggcgcagacgccctgtggatggccactctgcccatcaagctgccgagacttcgagggtccgaggggccacggcggggggctggcctctccttggcacccttgaatctgggagatgccgagaccggctttctgacgcagagcaacctgctgagtgtggctgggcgtctgggtctggactggccagccgtggccctgcacctgggggtgtcctaccgggaggtgcagcgcatccggcacgagttccgggatgatctggatgagcagatccgtcacatgctcttctcctgggctgagcgccaggctgggcagccaggggctgtggggctcctggtgcaggccctggagcagagtgaccggcaggacgtggctgaagaggtgcgcgcagtcttggagctcggccgccgcaagtaccaggacagcatccgacgcatgggcttggcccccaaggaccccgctctgcctggctcctcggctccacagcccccagagcctgcccaggcctaggccccacagacttttaggctggcccagatattccccagtggatgggcagagcccccaccttcaagtctctccagtgtgtggggacgggtccctgtgagcaacaaaactgcactgtttctttca

SEQ ID NO: 163306 - DNA, 1937 bp, Homo sapiens
  Payload ID: 12175
  Gene Symbol: PIDD1
  Gene Name: p53-induced death domain protein 1
  ENST ID: ENST00000531286
  CDS Start-End: 1-1016
acgccccctttgtgcgcctgcaggggaaccccctgggtgaggcctcgccagacgccccgagttcaccagtggcagccctcattccagaaatgcccagactgttcctgacctcagatttggacagctttcctgtgacccctcaaggctgctcagtgaccctggcctgtggcgtccgcctgcagttcccagcgggagccaccgccacccccatcaccatccgctatcggctgctgctgccggagccaggcctcgtccccctgggtcctcatgacgccctgctcagccatgtgctggagctgcagccccatggggtggccttccagcaggatgtggggctgtggctgctcttcaccccaccgcaggcccggcgctgccgtgaagtggtggtcaggacccggaatgacaacagctggggtgacctggagacctacctggaggaagaggcaccccagcggctctgggctcactgccaggtgccccacttctcctggttccttgtggtttcccgccctgtgtccaatgcctgcctggtgccaccggaggggacactgctgtgctcctcgggtcatcctggggtcaaagtcatcttcccccctggggccactgaggagcctcgtcgagtctccatgcaggtggtgcgcatggctggccgagagctgcaggccctcctgggagaaccagaggctgcagtgagccccctgctgtgcctgtcacagagcggtccccccagcttcctccaaccggtcaccgtgcagctgcctctgccctctggcatcacaggcctcagtctggaccgctcccgcctgcacctgttgtactgggcccctcctgcagccacctgggatgacatcacagctcaggtggtcctggagctcacccacctgtacgcacgcttccaggtactggctctggtacaccaccaagaactgtgtgggaggcctggctcggaaggcctgggagcggctgcggctgcaccgtgtgaacctcatcgctctgcagcggcgccgggaccctgagcaggtcctgctgcagtgcctgccccgaaacaaggtggacgccacccttcggcggctgctggagcggtaccggggccccgagccctctgacacggtggagatgttcgagggcgaagagttctttgcggccttcgagcgcggcatcgacgtggatgctgaccgccctgactgtgtggagggcagaatctgctttgtcttctactcgcacctgaagaatgtgaaggaggtgtccttctaccgtggcgcggtgcctgtgcgggtgcccgaggaggctgaggctgcccggcagaggaagggcgcagacgccctgtggatggccactctgcccatcaagctgccgagacttcgagggtccgaggggccacggcggggggctggcctctccttggcacccttgaatctgggagatgccgagaccggctttctgacgcagagcaacctgctgagtgtggctgggcgtctgggtctggactggccagccgtggccctgcacctgggggtgtcctaccgggaggtgcagcgcatccggcacgagttccgggatgatctggatgagcagatccgtcacatgctcttctcctgggctgagcgccaggctgggcagccaggggctgtggggctcctggtgcaggccctggagcagagtgaccggcaggacgtggctgaagaggtgcgcgcagtcttggagctcggccgccgcaagtaccaggacagcatccgacgcatgggcttggcccccaaggaccccgctctgcctggctcctcggctccacagcccccagagcctgcccaggcctaggccccacagacttttaggctggcccagatattccccagtggatgggcagagcccccaccttcaagtctctccagtgtgtggggacgggtccctgtgagcaacaaaactgcactgtttctttc

SEQ ID NO: 163307 - DNA, 3917 bp, Homo sapiens
  Payload ID: 12175
  Gene Symbol: PIDD1
  Gene Name: p53-induced death domain protein 1
  ENST ID: ENST00000524486
  CDS Start-End: 716-1042
ccccgacgcccgggggatcccgagcctgcctcggggctggggcccgccccccacgccgtctgagcggtgcgcggtgcaccaccctccccagtggaccgaactggaaaggccgggagaggtttcctccggggctcacgaattggggtcccggccccaggaccccgaagctgcccaatggctcacgccccaggccctcacccttacacggccttccctgactttcggggcgcagtcacccccgcggtaggggagggtcacggccttcctggtaaaacggatgtaaatagaagggggactcatctccaggactggggaacagcccctatgacctcgcagctccacggctccattggccagatttccaggaccaggactgaagcctcactaccccggctttgctgctcatagcgaggtctccctgcccggtgctcctgcgagccatggcggtcccattccccaaccctctttccagtggtgacccaggcctccggggttcagggtgaccacaaggtctcccccactctgcagcccaggcccagatggcctggctctagagctccccactccatccagagtccctgtttccccaaagagaagggcccaccccggctcccgctcactcctcctcctgcctctgcagcttccccgggcgctgcctggacaggcctgcctgcgtgctgggacatgtctggcctccaaggaccgtcggtgggcgatggctgcaacggtggaggggccagagctggaggcagctgctgccgcaggagatgcttcagaggattcggacgcagggtccagggcgctgcctttcctgggcggcaaccggctgagcttggacctgtaccccgggggctgccagcagctgctgcacctgtgtgtccagcagcctctgcagctgctgcaggtggaattcttgcgtctgagcactcacgaggaccctcagctgctggaggccaccctggcccagctgcctcagagcctgtcctgcctccgctccctggtcctcaaagggtcgatctgggacctcggaccctggctctgagggccacatccgcctccccccttcccaggagggcaacgccgggacacactgggtgcctgtctccggggtgccctgaccaacctgcccgctggtctgagtggcctggcccatctggcccacctggacctgagcttcaacagcctggagacactgccggcctgtgtcctgcagatgcgaggtctgggtgcgctcttgctgtctcacaactgcctctctgagctgcctgaggctctgggggccctccccgccctcaccttcctcacagtgacacacaaccgcctgcagacgctgcccccagcactgggggccctatccaccctgcagcgcctcgatctctctcagaatctgctggacacgctacctcctgagattggaggcctgggcagcctcctggagctcaacctggcctccaaccggctgcagagcctcccagcctctctgggtgagtagcccctgcgccccgacacactggccccacgggagggtccctgaagcctgcctgtcttctgcaggggcctctgcacccacaggcttggtccacagctgcctcttggttgtccctccacctccctggcctttgagactccctcagtggctttgtcagagttctctgagcccagctgtggaggagagtctgaaacagctgctctgggaggcggcagcaggagtgtcccagcgccgtgggctgggctggtgccaagcctaagccagcaactgcccgcagcgggacttcggtccttgcggctccttgtcctgcacagcaacctcctggcctctgtgccagctgacttggcccgccttccactcctcacccggctcgacctgagggacaaccagctccgggacctgccccctgagctgctagacgccccctttgtgcgcctgcaggggaaccccctgggtgaggcctcgccagacgccccgagttcaccagtggcagccctcattccagaaatgcccagactgttcctgacctcagatttggacagctttcctgtgacccctcaaggctgctcagtgaccctggcctgtggcgtccgcctgcagttcccagcgggagccaccgccacccccatcaccatccgctatcggctgctgctgccggagccaggcctcgtccccctgggtcctcatgacgccctgctcagccatgtgctggagctgcagccccatggggtggccttccagcaggatgtggggctgtggctgctcttcaccccaccgcaggcccggcgctgccgtgaagtggtggtcaggacccggaatgacaacagctggggtgacctggagacctacctggaggaagaggcaccccagcggctctgggctcactgccaggtgccccacttctcctggttccttgtggtttcccgccctgtgtccaatgcctgcctggtgccaccggaggggacactgctgtgctcctcgggtcatcctggggtcaaagtcatcttcccccctggggccactgaggagcctcgtcgagtctccatgcaggtggtgcgcatggctggccgagagctgcaggccctcctgggagaaccagaggctgcagtgagccccctgctgtgcctgtcacagagcggtccccccagcttcctccaaccggtcaccgtgcagctgcctctgccctctggcatcacaggcctcagtctggaccgctcccgcctgcacctgttgtactgggcccctcctgcagccacctgggatgacatcacagctcaggtggtcctggagctcacccacctgtacgcacgcttccaggtcacacacttctcctggtactggctctggtacaccaccaagaactgtgtgggaggcctggctcggaaggcctgggagcggctgcggctgcaccgtgtgaacctcatcgctctgcagcggcgccgggaccctgagcaggtcctgctgcagtgcctgccccgaaacaaggtggacgccacccttcggcggctgctggagcggtaccggggccccgagccctctgacacggtggagatgttcgagggcgaagagttctttgcggccttcgagcgcggcatcgacgtggatgctgaccgccctgactgtgtggagggcagaatctgctttgtcttctactcgcacctgaagaatgtgaaggaggtatacgtgaccaccactctggaccgggaggctcaggctgtgcggggccaggtgtccttctaccgtggcgcggtgcctgtgcgggtgcccgaggaggctgaggctgcccggcagaggaagggcgcagacgccctgtggatggccactctgcccatcaagctgccgagacttcgagggtccgaggggccacggcggggggctggcctctccttggcacccttgaatctgggagatgccgagaccggctttctgacgcagagcaacctgctgagtgtggctgggcgtctgggtctggactggccagccgtggccctgcacctgggggtgtcctaccgggaggtgcagcgcatccggcacgagttccgggatgatctggatgagcagatccgtcacatgctcttctcctgggctgagcgccaggctgggcagccaggggctgtggggctcctggtgcaggccctggagcagagtgaccggcaggacgtggctgaagaggtgcgcgcagtcttggagctcggccgccgcaagtaccaggacagcatccgacgcatgggcttggcccccaaggaccccgctctgcctggctcctcggctccacagcccccagagcctgcccaggcctaggccccacagacttttaggctggcccagatattccccagtggatgggcagagcccccaccttcaagtctctccagtgtgtggggacgggtccctgtgagcaacaaaactgcactgtttctttcacctc

SEQ ID NO: 163308 - DNA, 3175 bp, Homo sapiens
  Payload ID: 12175
  Gene Symbol: PIDD1
  Gene Name: p53-induced death domain protein 1
  ENST ID: ENST00000525028
  CDS Start-End: 288-614
ctcctgcgagccatggcggtcccattccccaaccctctttccagtggtgacccaggcctccggggttcagggtgaccacaaggtctcccccactctgcagcccaggcccagatggcctggctctagagctccccactccatccagagtccctgtttccccaaagagaagggcccaccccggctcccgctcactcctcctcctgcctctgcagcttccccgggcgctgcctggacaggcctgcctgcgtgctgggacatgtctggcctccaaggaccgtcggtgggcgatggctgcaacggtggaggggccagagctggaggcagctgctgccgcaggagatgcttcagaggattcggacgcagggtccagggcgctgcctttcctgggcggcaaccggctgagcttggacctgtaccccgggggctgccagcagctgctgcacctgtgtgtccagcagcctctgcagctgctgcaggtggaattcttgcgtctgagcactcacgaggaccctcagctgctggaggccaccctggcccagctgcctcagagcctgtcctgcctccgctccctggtcctcaaagggtcgatctgggacctcggaccctggctctgagggccacatccgcctccccccttcccaggagggcaacgccgggacacactgggtgcctgtctccggggtgccctgaccaacctgcccgctggtctgagtggcctggcccatctggcccacctggacctgagcttcaacagcctggagacactgccggcctgtgtcctgcagatgcgaggtctgggtgcgctcttgctgtctcacaactgcctctctgagctgcctgaggctctgggggccctccccgccctcaccttcctcacagtgacacacaaccgcctgcagacgctgcccccagcactgggggccctatccaccctgcagcgcctcgatctctctcagaatctgctggacacgctacctcctgagattggaggcctgggcagcctcctggagctcaacctggcctccaaccggctgcagagcctcccagcctctctggcgggacttcggtccttgcggctccttgtcctgcacagcaacctcctggcctctgtgccagctgacttggcccgccttccactcctcacccggctcgacctgagggacaaccagctccgggacctgccccctgagctgctagacgccccctttgtgcgcctgcaggggaaccccctgggtgaggcctcgccagacgccccgagttcaccagtggcagccctcattccagaaatgcccagactgttcctgacctcagatttggacagctttcctgtgacccctcaaggctgctcagtgaccctggcctgtggcgtccgcctgcagttcccagcgggagccaccgccacccccatcaccatccgctatcggctgctgctgccggagccaggcctcgtccccctgggtcctcatgacgccctgctcagccatgtgctggagctgcagccccatggggtggccttccagcaggatgtggggctgtggctgctcttcaccccaccgcaggcccggcgctgccgtgaagtggtggtcaggacccggaatgacaacagctggggtgacctggagacctacctggaggaagaggcaccccagcggctctgggctcactgccaggtgccccacttctcctggttccttgtggtttcccgccctgtgtccaatgcctgcctggtgccaccggaggggacactgctgtgctcctcgggtcatcctggggtcaaagtcatcttcccccctggggccactgaggagcctcgtcgagtctccatgcaggtggtgcgcatggctggccgagagctgcaggccctcctgggagaaccagaggctgcagtgagccccctgctgtgcctgtcacagagcggtccccccagcttcctccaaccggtcaccgtgcagctgcctctgccctctggcatcacaggcctcagtctggaccgctcccgcctgcacctgttgtactgggcccctcctgcagccacctgggatgacatcacagctcaggtggtcctggagctcacccacctgtactggctctggtacaccaccaagaactgtgtgggaggcctggctcggaaggcctgggagcggctgcggctgcaccgtgtgaacctcatcgctctgcagcggcgccgggaccctgagcaggtcctgctgcagtgcctgccccgaaacaaggtggacgccacccttcggcggctgctggagcggtaccggggccccgagccctctgacacggtggagatgttcgagggcgaagagttctttgcggccttcgagcgcggcatcgacgtggatgctgaccgccctgactgtgtggagggcagaatctgctttgtcttctactcgcacctgaagaatgtgaaggaggtatacgtgaccaccactctggaccgggaggctcaggctgtgcggggccaggtgtccttctaccgtggcgcggtgcctgtgcgggtgcccgaggaggctgaggctgcccggcagaggaagggcgcagacgccctgtggatggccactctgcccatcaagctgccgagacttcgagggtccgaggggccacggcggggggctggcctctccttggcacccttgaatctgggagatgccgagaccggctttctgacgcagagcaacctgctgagtgtggctgggcgtctgggtctggactggccagccgtggccctgcacctgggggtgtcctaccgggaggtgcagcgcatccggcacgagttccgggatgatctggatgagcagatccgtcacatgctcttctcctgggctgagcgccaggctgggcagccaggggctgtggggctcctggtgcaggccctggagcagagtgaccggcaggacgtggctgaagaggtgcgcgcagtcttggagctcggccgccgcaagtaccaggacagcatccgacgcatgggcttggcccccaaggaccccgctctgcctggctcctcggctccacagcccccagagcctgcccaggcctaggccccacagacttttaggctggcccagatattccccagtggatgggcagagcccccaccttcaagtctctccagtgtgtggggacgggtccctgtgagcaacaaaactgcactgtttctttcacctca

SEQ ID NO: 163309 - DNA, 2066 bp, Homo sapiens
  Payload ID: 12176
  Gene Symbol: PAF1
  Gene Name: PAF1 homolog, Paf1/RNA polymerase II complex component
  Uniprot ID: Q8N7H5
  ENST ID: ENST00000221265
  CDS Start-End: 332-1927
acccagacgctcgccaatccgtgtgtggttccgagccggacttcatttccccgaaggcgtcgcggcctgaggagacccgttgggtcctcagcgtcttggcggcagttggtggaaccggagcttcgagtccgtccccggtgctgcctgcgcgttcacctgagtctcgctggagctcttctcgcccgcccacctcatctcaacccactttccgcggggagcggcgccaagctgggccttcctcggatcaggcgtcccctgaagtcggcacgcccctctgcgtcccccttcggtcccgctaggaccccgtccgggctgccgtcgcctcgtcgctatggcgcccaccatccagacccaggcccagcgggaggatggccacaggcccaattcccaccggactctgcctgagaggtctggagtggtctgccgagtcaagtactgcaatagcctccctgatatccccttcgaccccaagttcatcacctaccccttcgaccagaacaggttcgtccagtacaaagccacttccttggagaaacagcacaaacatgacctcctgactgagccagacctgggggtcaccatcgatctcatcaatcctgacacctaccgcatcgaccccaatgttcttctagatccagctgatgagaaacttttggaagaggagattcaggcccccaccagctccaagagatcccagcagcacgcgaaggtggtgccatggatgcgaaagacagagtacatctccactgagttcaaccgttatggcatctccaatgagaagcctgaggtcaagattggggtttctgtgaagcagcagtttaccgaggaagaaatatacaaagacagggatagccagatcacagccattgagaagacttttgaggatgcccagaaatcaatctcacagcattacagcaaaccccgagtcacaccggtggaggtcatgcctgtcttcccagactttaagatgtggatcaatccatgtgctcaggtgatctttgactcagacccagcccccaaggacacgagtggtgcagctgcgttggagatgatgtctcaggccatgattaggggcatgatggatgaggaagggaaccagtttgtggcctatttcctgcctgtagaagagacgttgaagaaacgaaagcgggaccaggaggaggagatggactatgcaccagatgatgtgtatgactacaaaattgctcgggagtacaactggaacgtgaagaacaaagctagcaagggctatgaggaaaactacttcttcatcttccgagagggtgacggggtttactacaatgagttggaaaccagggtccgccttagtaagcgccgggccaaggctggggttcagtcaggcaccaacgccctgcttgtggtcaaacatcgggacatgaatgagaaggaactggaagctcaggaggcacggaaggcccagctagaaaaccacgaaccggaggaggaagaggaagaggagatggagacagaagagaaagaagctgggggctcagatgaggagcaggagaagggcagcagcagtgagaaggagggcagtgaagatgagcactcgggcagcgagagtgaacgggaggaaggtgacagggacgaggccagtgacaagagtggcagtggtgaggacgagagcagcgaggatgaggcccgggctgcccgtgacaaagaggagatctttggcagtgatgctgattctgaggacgatgccgactctgatgatgaggacagaggacaggcccaaggtggcagtgacaatgattcagacagcggcagcaatgggggtggccagcggagccggagccacagccgcagcgccagtcccttccccagtggcagcgagcactcggcccaggaggatggcagtgaagctgcagcttctgattccagtgaagctgatagtgacagtgactgagtcccagggcattcagggctggttcagacaccattattgtgagcagcaaagcacttttctagtggtctgtttgtgagcctttcacttgtttgttccccacccccaaacctttgctgttaataaagtcaacttctcttta

SEQ ID NO: 163310 - DNA, 1383 bp, Homo sapiens
  Payload ID: 12176
  Gene Symbol: PAF1
  Gene Name: PAF1 homolog, Paf1/RNA polymerase II complex component
  ENST ID: ENST00000416728
  CDS Start-End: 291-1157
gttgggtcctcagcgtcttggcggcagttggtggaaccggagcttcgagtccgtccccggtgctgcctgcgcgttcacctgagtctcgctggagctcttctcgcccgcccacctcatctcaacccactttccgcggggagcggcgccaagctgggccttcctcggatcaggcgtcccctgaagtcggcacgcccctctgcgtcccccttcggtcccgctaggaccccgtccgggctgccgtcgcctcgtcgctatggcgcccaccatccagacccaggcccagcgggaggatggccacaggcccaattcccaccggactctgcctgagaggtctggagtggtctgccgagtcaagtactgcaatagcctccctgatatccccttcgaccccaagttcatcacctaccccttcgaccagaacagttcttctagatccagctgatgagaaacttttggaagaggagattcaggcccccaccagctccaagagatcccagcagcacgcgaaggtggtgccatggatgcgaaagacagagtacatctccactgagttcaaccgttatggcatctccaatgagaagcctgaggtcaagattggggtttctgtgaagcagcagtttaccgaggaagaaatatacaaagacagggatagccagatcacagccattgagaagacttttgaggatgcccagaaatcaatctcacagcattacagcaaaccccgagtcacaccggtggaggtcatgcctgtcttcccagactttaagatgtggatcaatccatgtgctcaggtgatctttgactcagacccagcccccaaggacacgagtggtgcagctgcgttggagatgatgtctcaggccatgattaggggcatgatggatgaggaagggaaccagtttgtggcctatttcctgcctgtagaagagacgttgaagaaacgaaagcgggaccaggaggaggagatggactatgcaccagatgatgtgtatgactacaaaattgctcgggagtacaactggaacgtgaagaacaaagctagcaagggctatgaggaaaactacttcttcatcttccgagagggtgacggggtttactacaatgagttggaaaccagtattcagtacagtcacatgctgtacaaccttgtagcctaggagcaataggctacaccattacagcctagggtccgccttagtaagcgccgggccaaggctggggttcagtcaggcaccaacgccctgcttgtggtcaaacatcgggacatgaatgagaaggaactggaagctcaggaggcacggaaggcccagctagaaaaccacgaaccggaggaggaagaggaagaggagatggagacagaagagaaagaagctgggggctcag

SEQ ID NO: 163311 - DNA, 1810 bp, Homo sapiens
  Payload ID: 12176
  Gene Symbol: PAF1
  Gene Name: PAF1 homolog, Paf1/RNA polymerase II complex component
  Uniprot ID: Q8N7H5
  ENST ID: ENST00000595564
  CDS Start-End: 291-1748
ttcatttccccgaaggcgtcgcggcctgaggagacccgttgggtcctcagcgtcttggcggcagttggtggaaccggagcttcgagtccgtccccggtgctgcctgcgcgttcacctgagtctcgctggagctcttctcgcccgcccacctcatctcaacccactttccgcggggagcggcgccaagctgggccttcctcggatcaggcgtcccctgaagtcggcacgcccctctgcgtcccccttcggtcccgctaggaccccgtccgggctgccgtcgcctcgtcgctatggcgcccaccatccagacccaggcccagcgggaggatggccacaggtctggagtggtctgccgagtcaagtactgcaatagcctccctgatatccccttcgaccccaagttcatcacctaccccttcgaccagaacaggttcgtccagtacaaagccacttccttggagaaacagcacaaacatgacctcctgactgagccagacctgggggtcaccatcgatctcatcaatcctgacacctaccgcatcgaccccaatgttcttctagatccagctgatgagaaacttttggaagaggagattcaggcccccaccagctccaagagatcccagcagcacgcgaaggtggtgccatggatgcgaaagacagagtacatctccactgagttcaaccgttatggcatctccaatgagaagcctgaggtcaagattggggtttctgtgaagcagcagtttaccgaggaagaaatatacaaagacagggatagccagatcacagccattgagaagacttttgaggatgcccagaaatcaatctcacagcattacagcaaaccccgagtcacaccggtggaggtcatgcctgtcttcccagactttaagatgtggatcaatccatgtgctcaggtgatctttgactcagacccagcccccaaggacacgagtggtgcagctgcgttggagatgatgtctcaggccatgattaggggcatgatggatgaggaagggaaccagtttgtggcctatttcctgcctgtagaagagacgttgaagaaacgaaagcgggaccaggaggaggagatggactatgcaccagatgatgtgtatgactacaaaattgctcgggagtacaactggaacgtgaagaacaaagctagcaagggctatgaggaaaactacttcttcatcttccgagagggtgacggggtttactacaatgagttggaaaccagggtccgccttagtaagcgccgggccaaggctggggttcagtcaggcaccaacgccctgcttgtggtcaaacatcgggacatgaatgagaaggaactggaagctcaggaggcacggaaggcccagctagaaaaccacgaaccggaggaggaagaggaagaggagatggagacagaagagaaagaagctgggggctcagtgatgctgattctgaggacgatgccgactctgatgatgaggacagaggacaggcccaaggtggcagtgacaatgattcagacagcggcagcaatgggggtggccagcggagccggagccacagccgcagcgccagtcccttccccagtggcagcgagcactcggcccaggaggatggcagtgaagctgcagcttctgattccagtgaagctgatagtgacagtgactgagtcccagggcattcagggctggttcagacaccattattgtgagcagcaaagcacttttctagtggtctgtttgtgagcctttcacttgtttgttccccacccccaaacctttgctgttaataaagtcaacttctcttt

SEQ ID NO: 163312 - DNA, 281 bp, Homo sapiens
  Payload ID: 12176
  Gene Symbol: PAF1
  Gene Name: PAF1 homolog, Paf1/RNA polymerase II complex component
  ENST ID: ENST00000595379
  CDS Start-End: 1-281
ggttcagtcaggcaccaacgccctgcttgtggtcaaacatcgggacatgaatgagaaggaactggaagctcaggaggcacggaaggcccagctagaaaaccacgaaccggaggaggaagaggaagaggagatggagacagaagagaaagaagctgggggctcaggtaaatctggacaggccagactctgggagccctgggagggtggaaaagtgggtttcatctctctccactcccttccagatgaggagcaggagaagggcagcagcagtgagaaggagg

SEQ ID NO: 163313 - DNA, 2838 bp, Homo sapiens
  Payload ID: 12177
  Gene Symbol: PAX1
  Gene Name: paired box 1
  Uniprot ID: P15863
  ENST ID: ENST00000398485
  CDS Start-End: 55-1659
aaattgattcccgcacgctgcagcctcccggtcagacgaatttctcccaatcggatgaagttcaccctgggcctggggtcgcgggcgtggagagtgtcctgggagggggcagcagcggcggcggcaggccctggagcgggcggcagcgcgctccgctgccgcgcacagcgcgtctccagcccgcggctgggccgccgcggctctcggctctcgggcgccctccctctatgcctctcacgcggcggcggcggcgcccaagctctcccggactgcgccgggcccagccccggccaccccggccaccccggcgccaggcagctggccggcccgctcgctatggagcagacgtatggcgaggtgaaccagctgggcggtgtgttcgtcaacggccgccccctgcccaacgccatccgcttgcgcattgtggagctggcgcagctgggcatccgaccctgtgacatcagtcggcagctccgcgtatcccacggctgcgtgagcaagatcctggcgcgctacaacgagaccggctccattctgcccggggccatcggggggagcaagccccgcgtcaccactcccaacgtggtcaagcacatccgggactacaagcaaggagaccctggcatctttgcctgggagatccgcgaccggctgctggccgacggcgtctgtgacaagtacaatgtgccttcggtgagctccatcagccgcatcctgcgcaacaagatcggcagcctggcgcagcccggaccgtacgaggcaagtaagcagccgccgtcgcagcctacgctgccctacaaccacatctaccagtacccctaccccagtcccgtgtcgcccacgggcgccaagatgggcagccaccccggggtcccgggcacggcgggccacgtcagcatcccgcgctcatggccctcggcacactcggtcagcaacatcctgggcatccggacgtttatggagcaaacaggggccctggctgggagcgaaggcaccgcttactctcccaagatggaagactgggccggcgtgaaccgcacggccttccccgccacccccgcagtgaatgggctagagaaacctgccttagaggcagacattaaatacactcagtcggcctccaccctctctgccgtgggcggctttctccccgcctgcgcctacccggcctccaaccagcacggcgtgtacagcgccccgggcggcggctacctcgccccgggcccgccgtggccgcctgcgcaaggtcctcctctggcgccccccggggccggcgtagctgtgcatggcggggaactcgcggcagcaatgaccttcaagcatcccagccgagaaggaagcctcccagctccggcagcaaggccccggacgccctcagtagcttacacggactgcccatcccggcctcgacctcctaggggcagctctccccggacccgagcccggagggaacggcaggcggacccgggcgcacaggtctgcgcggcggccccggcaatcggcacgggcaggatcggaggactcgcggaggaggaagccagtgccggcccgcggggtgcacgcccagccagcccccaggcccagccctgcctctggccggacccaccacacttcctttattggtctgggtttttaggcttctctgaacttgggttttagactgccgtaccctcctcacaatccttgctctgacgtggcctccttcgctctgccagcttcaaatttcttttttgtcactcccttgtccgtctccgtctcgcctctctccctgtttccttcccccctctttctttctcactctccctcccttccctttctctttcccttcctccctaccttccaccccggctttccccgaccttccagggctccctctgcccttccactctcttttccttgctccgacctctgctccagtcccgcttcttcccccgtctcctctttctagtcctctatatgctatcagccctttttcctggtccatccctgtcgttccttctctctctgtctctggttctactgtcaagggccctagttccctttgttttactgcttccccaaccctccctcagtccctgagagccctagagccatctcggtgacagtcccttctctggcacctgggactttgtagccttcactcctctgagcccaccagccctaatggaggggggctcaaacctaggaagtggacagaaaagccacagcctttattttgtattttttttgtaataacaaaccctaaaaaaccctccatgaactgtcctctcccgtcgatccccgcagcatattgtctggaaatctgttttctttctcagagcccagtggccgccgggcttctcttcccttctgagatgatgtcaccccaaagaagactggggtaggagtagggagcacaggggttgttggtgttttcagtgcttagaaaactgggttgtcctgcaggtgtctcctcccacccctccactcgcaacacttgctagggaatccgaccagtggtaaacacatcagcactttttggtgttcaggggtcagcacatttgttaatttaaaccacagactgcttccaggtacaaaggttcatttggacttctggtttgcaagggatgagggttaaaaaaaacaaaacaaaacaaacaacaacaacaacaaaaacaacccagaaagtatcttctagagccagccgcaagagctgtgagctgcttccaagttaggcgagctggtggtggtaccctggacataatgcaattctgtagtcagagcaatatccctggcgagagcctgacatcgcctgttaaaggtggctgcctctgaataaaggaaagcgtctgaaaggtg

SEQ ID NO: 163314 - DNA, 1850 bp, Homo sapiens
  Payload ID: 12177
  Gene Symbol: PAX1
  Gene Name: paired box 1
  Uniprot ID: P15863
  ENST ID: ENST00000444366
  CDS Start-End: 2-1303
aatgcgccgcgctccactccgcggctcctctgcgcccttgcccactccaagccagacccaggcggtttgcccttggactccgagctgtctggggacccacaggtcacctttggaagtgcgcctgggtgcagtccctcgctccgcgtggggacccttggctaacccgccgggtgttttctccccctccggctcactcttgtctggcgcatccgcagagcagacgtatggcgaggtgaaccagctgggcggtgtgttcgtcaacggccgccccctgcccaacgccatccgcttgcgcattgtggagctggcgcagctgggcatccgaccctgtgacatcagtcggcagctccgcgtatcccacggctgcgtgagcaagatcctggcgcgctacaacgagaccggctccattctgcccggggccatcggggggagcaagccccgcgtcaccactcccaacgtggtcaagcacatccgggactacaagcaaggagaccctggcatctttgcctgggagatccgcgaccggctgctggccgacggcgtctgtgacaagtacaatgtgccttcggtgagctccatcagccgcatcctgcgcaacaagatcggcagcctggcgcagcccggaccgtacgaggcaagtaagcagccgccgtcgcagcctacgctgccctacaaccacatctaccagtacccctaccccagtcccgtgtcgcccacgggcgccaagatgggcagccaccccggggtcccgggcacggcgggccacgtcagcatcccgcgctcatggccctcggcacactcggtcagcaacatcctgggcatccggacgtttatggagcaaacaggggccctggctgggagcgaaggcaccgcttactctcccaagatggaagactgggccggcgtgaaccgcacggccttccccgccacccccgcagtgaatgggctagagaaacctgccttagaggcagacattaaatacactcagtcggcctccaccctctctgccgtgggcggctttctccccgcctgcgcctacccggcctccaaccagcacggcgtgtacagcgccccgggcggcggctacctcgccccgggcccgccgtggccgcctgcgcaaggtcctcctctggcgccccccggggccggcgtagctgtgcatggcggggaactcgcggcagcaatgaccttcaagcatcccagccgagaagtggctgacaggaagcctcccagctccggcagcaaggccccggacgccctcagtagcttacacggactgcccatcccggcctcgacctcctaggggcagctctccccggacccgagcccggagggaacggcaggcggacccgggcgcacaggtctgcgcggcggccccggcaatcggcacgggcaggatcggaggactcgcggaggaggaagccagtgccggcccgcggggtgcacgcccagccagcccccaggcccagccctgcctctggccggacccaccacacttcctttattggtctgggtttttaggcttctctgaacttgggttttagactgccgtaccctcctcacaatccttgctctgacgtggcctccttcgctctgccagcttcaaatttcttttttgtcactcccttgtccgtctccgtctcgcctctctccctgtttccttcccccctctttctttctcactctccctcccttccctttctctttcccttcctccctaccttccaccccggctttccccgaccttccagggctccctctgcccttccactctcttttccttgctccgacctctgctccagtcccgcttcttcccccgtctcctctttctagtcctctatatgctatca

SEQ ID NO: 163315 - DNA, 5352 bp, Homo sapiens
  Payload ID: 12177
  Gene Symbol: PAX1
  Gene Name: paired box 1
  ENST ID: ENST00000613128
  CDS Start-End: 55-1428
aaattgattcccgcacgctgcagcctcccggtcagacgaatttctcccaatcggatgaagttcaccctgggcctggggtcgcgggcgtggagagtgtcctgggagggggcagcagcggcggcggcaggccctggagcgggcggcagcgcgctccgctgccgcgcacagcgcgtctccagcccgcggctgggccgccgcggctctcggctctcgggcgccctccctctatgcctctcacgcggcggcggcggcgcccaagctctcccggactgcgccgggcccagccccggccaccccggccaccccggcgccaggcagctggccggcccgctcgctatggagcagacgtatggcgaggtgaaccagctgggcggtgtgttcgtcaacggccgccccctgcccaacgccatccgcttgcgcattgtggagctggcgcagctgggcatccgaccctgtgacatcagtcggcagctccgcgtatcccacggctgcgtgagcaagatcctggcgcgctacaacgagaccggctccattctgcccggggccatcggggggagcaagccccgcgtcaccactcccaacgtggtcaagcacatccgggactacaagcaaggagaccctggcatctttgcctgggagatccgcgaccggctgctggccgacggcgtctgtgacaagtacaatgtgccttcggtgagctccatcagccgcatcctgcgcaacaagatcggcagcctggcgcagcccggaccgtacgaggcaagtaagcagccgccgtcgcagcctacgctgccctacaaccacatctaccagtacccctaccccagtcccgtgtcgcccacgggcgccaagatgggcagccaccccggggtcccgggcacggcgggccacgtcagcatcccgcgctcatggccctcggcacactcggtcagcaacatcctgggcatccggacgtttatggagcaaacaggggccctggctgggagcgaaggcaccgcttactctcccaagatggaagactgggccggcgtgaaccgcacggccttccccgccacccccgcagtgaatgggctagagaaacctgccttagaggcagacattaaatacactcagtcggcctccaccctctctgccgtgggcggctttctccccgcctgcgcctacccggcctccaaccagcacggcgtgtacagcgccccgggcggcggctacctcgccccgggcccgccgtggccgcctgcgcaaggtcctcctctggcgccccccggggccggcgtagctgtgcatggcggggaactcgcggcagcaatgaccttcaagcatcccagccgagaagtggctgacaggaagcctcccagctccggcagcaaggccccggacgccctcagtagcttacacggactgcccatcccggcctcgacctcctaggggcagctctccccggacccgagcccggagggaacggcaggcggacccgggcgcacaggtctgcgcggcggccccggcaatcggcacgggcaggatcggaggactcgcggaggaggaagccagtgccggcccgcggggtgcacgcccagccagcccccaggcccagccctgcctctggccggacccaccacacttcctttattggtctgggtttttaggcttctctgaacttgggttttagactgccgtaccctcctcacaatccttgctctgacgtggcctccttcgctctgccagcttcaaatttcttttttgtcactcccttgtccgtctccgtctcgcctctctccctgtttccttcccccctctttctttctcactctccctcccttccctttctctttcccttcctccctaccttccaccccggctttccccgaccttccagggctccctctgcccttccactctcttttccttgctccgacctctgctccagtcccgcttcttcccccgtctcctctttctagtcctctatatgctatcagccctttttcctggtccatccctgtcgttccttctctctctgtctctggttctactgtcaagggccctagttccctttgttttactgcttccccaaccctccctcagtccctgagagccctagagccatctcggtgacagtcccttctctggcacctgggactttgtagccttcactcctctgagcccaccagccctaatggaggggggctcaaacctaggaagtggacagaaaagccacagcctttattttgtattttttttgtaataacaaaccctaaaaaaccctccatgaactgtcctctcccgtcgatccccgcagcatattgtctggaaatctgttttctttctcagagcccagtggccgccgggcttctcttcccttctgagatgatgtcaccccaaagaagactggggtaggagtagggagcacaggggttgttggtgttttcagtgcttagaaaactgggttgtcctgcaggtgtctcctcccacccctccactcgcaacacttgctagggaatccgaccagtggtaaacacatcagcactttttggtgttcaggggtcagcacatttgttaatttaaaccacagactgcttccaggtacaaaggttcatttggacttctggtttgcaagggatgagggttaaaaaaaacaaaacaaaacaaacaacaacaacaacaaaaacaacccagaaagtatcttctagagccagccgcaagagctgtgagctgcttccaagttaggcgagctggtggtggtaccctggacataatgcaattctgtagtcagagcaatatccctggcgagagcctgacatcgcctgttaaaggtggctgcctctgaataaaggaaagcgtctgaaaggtgtgtggtgaggtgagcaagtctgtttctgagcgcagagtgttgagttcttactccgtagctaccctctcccctgagttcctaggatgaacactatcaagggaaattatgcagaaaccaccttgaaatgcagttaattctgaaaagagtaaaatgggcaaaaggcaatgagccagaatggaggatttcttcagaacatttctagtattctaaaagctaaagaagacaatcccaggctaccaagtaatctagggggtttgcactacaaaggggcttccggctaattgtttttttttcctgcctctgtttgaccttctaaaactgatggaagagatttttgaattgaagttgctgtttgtgagtggagctgcctgcttggtgtgtgcactggtcccacctaggggactagtggtaaacagtttttgtttcaactctttttgatagtatctgttgaaggtatcaattataaaaaagtacttacttttttcctagagagactcttcttctcagattcaaagtctcttgtctttttttttttttttttttaaagtttcactttgtagacagtgttagtgatggctagggatttgatttattttctttagaccacatagcaaggtatgaattagagggcttgtgcttggaaactgggtgacactatctcatcagagaggcaggattgagacttggactttgagactgaagtcctcagccttccatggcagcatatcctgtagaagagcttgtcatactgataataggaaaaaagtatgacagagaagcatgttcccaagtcccccatcctctcagcctgtctccttgtgcttagatgagcattgcatgctcagtggtgacatcctggacagaattttcatgcacccatttgtgctgcctggagaaggactggcttgctcaggccaggaggaagacatcacatccctttctgaaggaatgagaagaatctatatgacaacttctacctttgagttgtcaccatccccatttccctgctatggcccacttctgtgtttgagctgatcagggttatgggggagaagagctgggaaatgcgccccagggtggatgcaaagcacctgtgttttaagtgccacctgcaaagggaggcatttttcaaatctgcctcttgttccctgtatcctgtggctggaggcgggtctttgagttccctggctctggggcgagcattcactgaggataggcagccttcgtcccagagccagcaggctctgacatttcatgtggggtgtggagggacataccccctctctcgcggctgggggtcacggaacatcttagtgaacttggcttaaatctctgctccactgtatgtgtcaggggactgggacctcttggaacctgtctgtgaaatgtagccttcaatgcagtaacgcgcacggtgacctggcctgtaggaagactgccactggtgtggcctcacctctctggagacaattttgcttatctgttaacaaaagttagaggaatcacttgtaaggttggtgggagacccagaatttaaatattttccaaaagatcccattggaatattgcacttttgctctttgttcgtatggatctgtggaggaactgagagctcataataaaattatgcagcaccacgtcaggtagaataatttgagaaacaatcactccctaaacgcagtttgtctttgcctttcatttttttaatttaagaataagttttttttagaaaaatatagagatgtaacccaaagaaaataaagacataatcagatagccctctgattttttgaaagaatagaaataatatatgcgtatcactaaaaaactcaagcagtacagaaacattaaaatgaaaagtggaagttcttcctgctctcatttttgttcttaaaggtgaatgctgttatagtcttttgtgaatctttccaggaaaaacatgcatgcgggaaaatatgtttctgtctatgtgttatttgaaagtgcacactaatgagttgtgctgtgcacacacagacatgagctgaagatctgctctttgcgtaccaccagcttcagctccaatgtacccactttattctcgtgaatggatgtctattaccgaggatttattaaaaacagggtatttgtaaagagggccagcttcgtgctttaaatgaataaagacaggattttgttgtgttcattattggaggaagtacttgcaatggattgtaataacttccctgccaaaggtagctgttttttggcaagaagtaaggaaaacaaaccaaaggaaaggaggattgaggggcaagaggcatgaagttttgcccttcttgaatatgccccgagttgttctacagatcactgaagggcatttgaaggtgtgaggggaaggcttcctctcctttggagggagtcagtctctctgggccaggaaagagacatggaggcagaggggtgcgggaaaaccttgtgtgaagaaatactggctacaaataaagtttagattttcaatactg

SEQ ID NO: 163316 - DNA, 4057 bp, Homo sapiens
  Payload ID: 12178
  Gene Symbol: PAX2
  Gene Name: paired box 2
  Uniprot ID: Q02962
  ENST ID: ENST00000355243
  CDS Start-End: 551-1735
cgggggcctggcccgcgcgctcccctcccgcaggcgccacctcggacatccccgggattgctacttctctgccaacttcgccaactcgccagcacttggagaggcccggctcccctcccggcgccctctgaccgcccccgccccgcgcgctctccgaccaccgcctctcggatgaccaggttccaggggagctgagcgagtcgcctcccccgcccagcttcagccctggctgcagctgcagcgcgagccatgcgcccccagtgcaccccggcccggcccaccgccccggggccattctgctgaccgcccagccccgagccccgacagtggcaagttgcggctactgcagttgcaagctccggccaacccggaggagccccagcggggagcgcagtgctgcgccccccgcccccgcgcgccccgcagcagccgggcgttcactcatcctccctcccccaccgtccctcccttttctcctcaagtcctgaagttgagtttgagaggcgacacggcggcggcggccgcgctgctcccgctcctctgcctccccatggatatgcactgcaaagcagaccccttctccgcgatgcacccagggcacgggggtgtgaaccagctcgggggggtgtttgtgaacggccggcccctacccgacgtggtgaggcagcgcatcgtggagctggcccaccagggtgtgcggccctgtgacatctcccggcagctgcgggtcagccacggctgtgtcagcaaaatcctgggcaggtactacgagaccggcagcatcaagccgggtgtgatcggtggctccaagcccaaagtggcgacgcccaaagtggtggacaagattgctgaatacaaacgacagaacccgactatgttcgcctgggagattcgagaccggctcctggccgagggcatctgtgacaatgacacagtgcccagcgtctcttccatcaacagaatcatccggaccaaagttcagcagcctttccacccaacgccggatggggctgggacaggagtgaccgcccctggccacaccattgttcccagcacggcctcccctcctgtttccagcgcctccaatgacccagtgggatcctactccatcaatgggatcctggggattcctcgctccaatggtgagaagaggaaacgtgatgaagatgtgtctgagggctcagtccccaatggagattcccagagtggtgtggacagtttgcggaagcacttgcgagctgacaccttcacccagcagcagctggaagctttggatcgggtctttgagcgtccttcctaccctgacgtcttccaggcatcagagcacatcaaatcagaacaggggaacgagtactccctcccagccctgacccctgggcttgatgaagtcaagtcgagtctatctgcatccaccaaccctgagctgggcagcaacgtgtcaggcacacagacatacccagttgtgactggtcgtgacatggcgagcaccactctgcctggttacccccctcacgtgccccccactggccagggaagctaccccacctccaccctggcaggaatggtgcctgggagcgagttctccggcaacccgtacagccacccccagtacacggcctacaacgaggcttggagattcagcaaccccgccttactaagttccccttattattatagtgccgccccccggggctccgcccctgccgctgctgccgctgcctatgaccgccactagttaccgcggggaccacatcaagcttcaggccgacagcttcggcctccacatcgtccccgtctgaccccaccccggagggagggaggaccgacgcgacgcgatgcctcccggccaccgccccagcctcaccccatcccacgacccccgcaacccttcacatcacccccctcgaaggtcggacaggacgggtggagccgtgggcgggaccctcaggcccgggcccgccgcccccagccccgcctgccgcccctccccgcctgcctggactgcgcggcgccgtgagggggattcggcccagctcgtcccggcctccaccaagccagccccgaagcccgccagccaccctgccggactcgggcgcgacctgctggcgcgcgccggatgtttctgtgacacacaatcagcgcggaccgcagcgcggcccagccccgggcacccgcctcggacgctcgggcgccaggaggcttcgctggaggggctgggccaaggagattaagaagaaaacgactttctgcaggaggaagagcccgctgccgaatccctgggaaaaattcttttcccccagtgccagccggactgccctcgccttccgggtgtgccctgtcccagaagatggaatgggggtgtgggggtccggctctaggaacgggctttgggggcgtcaggtctttccaaggttgggacccaaggatcggggggcccagcagcccgcaccgatcgagccggactctcggctcttcactgctcctcctggcctgcctagttccccagggcccggcacctcctgctgcgagacccggctctcagccctgccttgcccctacctcagcgtctcttccacctgctggcctcccagtttcccctcctgccagtccttcgcctgtcccttgacgccctgcatcctcctccctgactcgcagccccatcggacgctctcccgggaccgccgcaggaccagtttccatagactgcggactggggtcttcctccagcagttacttgatgccccctcccccgacacagactctcaatctgccggtggtaagaaccggttctgagctggcgtctgagctgctgcggggtggaagtggggggctgcccactccactcctcccatcccctcccagcctcctcctccggcaggaactgaacagaaccacaaaaagtctacatttatttaatatgatggtctttgcaaaaaggaacaaaacaacacaaaagcccaccaggctgctgctttgtggaaagacggtgtgtgtcgtgtgaaggcgaaacccggtgtacataacccctccccctccgccccgccccgcccggccccgtagagtccctgtcgcccgccggccctgcctgtagatacgccccgctgtctgtgctgtgagagtcgccgctcgctgggggggaagggggggacacagctacacgcccattaaagcacagcacgtcctgggggaggggggcattttttatgttacaaaaaaaaattacgaaagaaaagaaatctctatgcaaaatgacgaacatggtcctgtggactcctctggcctgttttgttggctctttctctgtaattccgtgttttcgctttttcctccctgcccctctctccctctgcccctctctcctctccgcttctctccccctctgtctctgtctctctccgtctctgtcgctcttgtctgtctgtctctgctctttcctcggcctctctccccagacctggcccggccgccctgtctccgcaggctagatccgaggtggcagctccagcccccgggctcgccccctcgcgggcgtgccccgcgcgccccgggcggccgaaggccgggccgccccgtcccgccccgtagttgctctttcggtagtggcgatgcgccctgcatgtctcctcacccgtggatcgtgacgactcgaaataacagaaacaaagtcaataaagtgaaaataaataaaaatccttgaacaaatccgaaaaggcttggagtcctcgcccagatctctctcccctgcgagccctttttatttgagaaggaaaaagagaaaagagaatcgtttaagggaacccggcgcccagccaggctccagtggcccgaacggggcggcgagggcggcgagggcgccgaggtccggcccatcccagtcctgtggggctggccgggcagagaccccggacccaggcccaggcctaacctgctaaatgtccccggacggttctggtctcctcggccactttcagtgcgtcggttcgttttgattctttttcttttgtgcacataagaaataaataataataataaataaagaataaaattttgtatgtca

SEQ ID NO: 163317 - DNA, 3193 bp, Homo sapiens
  Payload ID: 12178
  Gene Symbol: PAX2
  Gene Name: paired box 2
  ENST ID: ENST00000361791
  CDS Start-End: 42-1223
cggcggcggcggccgcgctgctcccgctcctctgcctccccatggatatgcactgcaaagcagaccccttctccgcgatgcaccggcacgggggtgtgaaccagctcgggggggtgtttgtgaacggccggcccctacccgacgtggtgaggcagcgcatcgtggagctggcccaccagggtgtgcggccctgtgacatctcccggcagctgcgggtcagccacggctgtgtcagcaaaatcctgggcaggtactacgagaccggcagcatcaagccgggtgtgatcggtggctccaagcccaaagtggcgacgcccaaagtggtggacaagattgctgaatacaaacgacagaacccgactatgttcgcctgggagattcgagaccggctcctggccgagggcatctgtgacaatgacacagtgcccagcgtctcttccatcaacagaatcatccggaccaaagttcagcagcctttccacccaacgccggatggggctgggacaggagtgaccgcccctggccacaccattgttcccagcacggcctcccctcctgtttccagcgcctccaatgacccagtgggatcctactccatcaatgggatcctggggattcctcgctccaatggtgagaagaggaaacgtgatgaagatgtgtctgagggctcagtccccaatggagattcccagagtggtgtggacagtttgcggaagcacttgcgagctgacaccttcacccagcagcagctggaagctttggatcgggtctttgagcgtccttcctaccctgacgtcttccaggcatcagagcacatcaaatcagaacaggggaacgagtactccctcccagccctgacccctgggcttgatgaagtcaagtcgagtctatctgcatccaccaaccctgagctgggcagcaacgtgtcaggcacacagacatacccagttgtgactggtcgtgacatggcgagcaccactctgcctggttacccccctcacgtgccccccactggccagggaagctaccccacctccaccctggcaggaatggtgcctgggagcgagttctccggcaacccgtacagccacccccagtacacggcctacaacgaggcttggagattcagcaaccccgccttactaagttccccttattattatagtgccgccccccggggctccgcccctgccgctgctgccgctgcctatgaccgccactagttaccgcggggaccacatcaagcttcaggccgacagcttcggcctccacatcgtccccgtctgaccccaccccggagggagggaggaccgacgcgacgcgatgcctcccggccaccgccccagcctcaccccatcccacgacccccgcaacccttcacatcacccccctcgaaggtcggacaggacgggtggagccgtgggcgggaccctcaggcccgggcccgccgcccccagccccgcctgccgcccctccccgcctgcctggactgcgcggcgccgtgagggggattcggcccagctcgtcccggcctccaccaagccagccccgaagcccgccagccaccctgccggactcgggcgcgacctgctggcgcgcgccggatgtttctgtgacacacaatcagcgcggaccgcagcgcggcccagccccgggcacccgcctcggacgctcgggcgccaggaggcttcgctggaggggctgggccaaggagattaagaagaaaacgactttctgcaggaggaagagcccgctgccgaatccctgggaaaaattcttttcccccagtgccagccggactgccctcgccttccgggtgtgccctgtcccagaagatggaatgggggtgtgggggtccggctctaggaacgggctttgggggcgtcaggtctttccaaggttgggacccaaggatcggggggcccagcagcccgcaccgatcgagccggactctcggctcttcactgctcctcctggcctgcctagttccccagggcccggcacctcctgctgcgagacccggctctcagccctgccttgcccctacctcagcgtctcttccacctgctggcctcccagtttcccctcctgccagtccttcgcctgtcccttgacgccctgcatcctcctccctgactcgcagccccatcggacgctctcccgggaccgccgcaggaccagtttccatagactgcggactggggtcttcctccagcagttacttgatgccccctcccccgacacagactctcaatctgccggtggtaagaaccggttctgagctggcgtctgagctgctgcggggtggaagtggggggctgcccactccactcctcccatcccctcccagcctcctcctccggcaggaactgaacagaaccacaaaaagtctacatttatttaatatgatggtctttgcaaaaaggaacaaaacaacacaaaagcccaccaggctgctgctttgtggaaagacggtgtgtgtcgtgtgaaggcgaaacccggtgtacataacccctccccctccgccccgccccgcccggccccgtagagtccctgtcgcccgccggccctgcctgtagatacgccccgctgtctgtgctgtgagagtcgccgctcgctgggggggaagggggggacacagctacacgcccattaaagcacagcacgtcctgggggaggggggcattttttatgttacaaaaaaaaattacgaaagaaaagaaatctctatgcaaaatgacgaacatggtcctgtggactcctctggcctgttttgttggctctttctctgtaattccgtgttttcgctttttcctccctgcccctctctccctctgcccctctctcctctccgcttctctccccctctgtctctgtctctctccgtctctgtcgctcttgtctgtctgtctctgctctttcctcggcctctctccccagacctggcccggccgccctgtctccgcaggctagatccgaggtggcagctccagcccccgggctcgccccctcgcgggcgtgccccgcgcgccccgggcggccgaaggccgggccgccccgtcccgccccgtagttgctctttcggtagtggcgatgcgccctgcatgtctcctcacccgtggatcgtgacgactcgaaataacagaaacaaagtcaataaagtgaaaataaataaaaatccttgaacaaatcc

SEQ ID NO: 163318 - DNA, 4140 bp, Homo sapiens
  Payload ID: 12178
  Gene Symbol: PAX2
  Gene Name: paired box 2
  Uniprot ID: Q02962
  ENST ID: ENST00000370296
  CDS Start-End: 551-1741
cgggggcctggcccgcgcgctcccctcccgcaggcgccacctcggacatccccgggattgctacttctctgccaacttcgccaactcgccagcacttggagaggcccggctcccctcccggcgccctctgaccgcccccgccccgcgcgctctccgaccaccgcctctcggatgaccaggttccaggggagctgagcgagtcgcctcccccgcccagcttcagccctggctgcagctgcagcgcgagccatgcgcccccagtgcaccccggcccggcccaccgccccggggccattctgctgaccgcccagccccgagccccgacagtggcaagttgcggctactgcagttgcaagctccggccaacccggaggagccccagcggggagcgcagtgctgcgccccccgcccccgcgcgccccgcagcagccgggcgttcactcatcctccctcccccaccgtccctcccttttctcctcaagtcctgaagttgagtttgagaggcgacacggcggcggcggccgcgctgctcccgctcctctgcctccccatggatatgcactgcaaagcagaccccttctccgcgatgcacccagggcacgggggtgtgaaccagctcgggggggtgtttgtgaacggccggcccctacccgacgtggtgaggcagcgcatcgtggagctggcccaccagggtgtgcggccctgtgacatctcccggcagctgcgggtcagccacggctgtgtcagcaaaatcctgggcaggtactacgagaccggcagcatcaagccgggtgtgatcggtggctccaagcccaaagtggcgacgcccaaagtggtggacaagattgctgaatacaaacgacagaacccgactatgttcgcctgggagattcgagaccggctcctggccgagggcatctgtgacaatgacacagtgcccagcgtctcttccatcaacagaatcatccggaccaaagttcagcagcctttccacccaacgccggatggggctgggacaggagtgaccgcccctggccacaccattgttcccagcacggcctcccctcctgtttccagcgcctccaatgacccagtgggatcctactccatcaatgggatcctggggattcctcgctccaatggtgagaagaggaaacgtgatgaagatgtgtctgagggctcagtccccaatggagattcccagagtggtgtggacagtttgcggaagcacttgcgagctgacaccttcacccagcagcagctggaagctttggatcgggtctttgagcgtccttcctaccctgacgtcttccaggcatcagagcacatcaaatcagaacaggggaacgagtactccctcccagccctgacccctgggcttgatgaagtcaagtcgagtctatctgcatccaccaaccctgagctgggcagcaacgtgtcaggcacacagacatacccagttgtgactggtcgtgacatggcgagcaccactctgcctggttacccccctcacgtgccccccactggccagggaagctaccccacctccaccctggcaggaatggtgcctgaggctgcagttggtccctcatcctccctcatgagcaagccggggaggaagcttgcagaagtgcccccttgtgtgcaacccactggagcgagttctccggcaacccgtacagccacccccagtacacggcctacaacgaggcttggagattcagcaaccccgccttactaagttccccttattattatagtgccgccccccggggctccgcccctgccgctgctgccgctgcctatgaccgccactagttaccgcggggaccacatcaagcttcaggccgacagcttcggcctccacatcgtccccgtctgaccccaccccggagggagggaggaccgacgcgacgcgatgcctcccggccaccgccccagcctcaccccatcccacgacccccgcaacccttcacatcacccccctcgaaggtcggacaggacgggtggagccgtgggcgggaccctcaggcccgggcccgccgcccccagccccgcctgccgcccctccccgcctgcctggactgcgcggcgccgtgagggggattcggcccagctcgtcccggcctccaccaagccagccccgaagcccgccagccaccctgccggactcgggcgcgacctgctggcgcgcgccggatgtttctgtgacacacaatcagcgcggaccgcagcgcggcccagccccgggcacccgcctcggacgctcgggcgccaggaggcttcgctggaggggctgggccaaggagattaagaagaaaacgactttctgcaggaggaagagcccgctgccgaatccctgggaaaaattcttttcccccagtgccagccggactgccctcgccttccgggtgtgccctgtcccagaagatggaatgggggtgtgggggtccggctctaggaacgggctttgggggcgtcaggtctttccaaggttgggacccaaggatcggggggcccagcagcccgcaccgatcgagccggactctcggctcttcactgctcctcctggcctgcctagttccccagggcccggcacctcctgctgcgagacccggctctcagccctgccttgcccctacctcagcgtctcttccacctgctggcctcccagtttcccctcctgccagtccttcgcctgtcccttgacgccctgcatcctcctccctgactcgcagccccatcggacgctctcccgggaccgccgcaggaccagtttccatagactgcggactggggtcttcctccagcagttacttgatgccccctcccccgacacagactctcaatctgccggtggtaagaaccggttctgagctggcgtctgagctgctgcggggtggaagtggggggctgcccactccactcctcccatcccctcccagcctcctcctccggcaggaactgaacagaaccacaaaaagtctacatttatttaatatgatggtctttgcaaaaaggaacaaaacaacacaaaagcccaccaggctgctgctttgtggaaagacggtgtgtgtcgtgtgaaggcgaaacccggtgtacataacccctccccctccgccccgccccgcccggccccgtagagtccctgtcgcccgccggccctgcctgtagatacgccccgctgtctgtgctgtgagagtcgccgctcgctgggggggaagggggggacacagctacacgcccattaaagcacagcacgtcctgggggaggggggcattttttatgttacaaaaaaaaattacgaaagaaaagaaatctctatgcaaaatgacgaacatggtcctgtggactcctctggcctgttttgttggctctttctctgtaattccgtgttttcgctttttcctccctgcccctctctccctctgcccctctctcctctccgcttctctccccctctgtctctgtctctctccgtctctgtcgctcttgtctgtctgtctctgctctttcctcggcctctctccccagacctggcccggccgccctgtctccgcaggctagatccgaggtggcagctccagcccccgggctcgccccctcgcgggcgtgccccgcgcgccccgggcggccgaaggccgggccgccccgtcccgccccgtagttgctctttcggtagtggcgatgcgccctgcatgtctcctcacccgtggatcgtgacgactcgaaataacagaaacaaagtcaataaagtgaaaataaataaaaatccttgaacaaatccgaaaaggcttggagtcctcgcccagatctctctcccctgcgagccctttttatttgagaaggaaaaagagaaaagagaatcgtttaagggaacccggcgcccagccaggctccagtggcccgaacggggcggcgagggcggcgagggcgccgaggtccggcccatcccagtcctgtggggctggccgggcagagaccccggacccaggcccaggcctaacctgctaaatgtccccggacggttctggtctcctcggccactttcagtgcgtcggttcgttttgattctttttcttttgtgcacataagaaataaataataataataaataaagaataaaattttgtatgtca

SEQ ID NO: 163319 - DNA, 4126 bp, Homo sapiens
  Payload ID: 12178
  Gene Symbol: PAX2
  Gene Name: paired box 2
  Uniprot ID: Q02962
  ENST ID: ENST00000428433
  CDS Start-End: 551-1804
cgggggcctggcccgcgcgctcccctcccgcaggcgccacctcggacatccccgggattgctacttctctgccaacttcgccaactcgccagcacttggagaggcccggctcccctcccggcgccctctgaccgcccccgccccgcgcgctctccgaccaccgcctctcggatgaccaggttccaggggagctgagcgagtcgcctcccccgcccagcttcagccctggctgcagctgcagcgcgagccatgcgcccccagtgcaccccggcccggcccaccgccccggggccattctgctgaccgcccagccccgagccccgacagtggcaagttgcggctactgcagttgcaagctccggccaacccggaggagccccagcggggagcgcagtgctgcgccccccgcccccgcgcgccccgcagcagccgggcgttcactcatcctccctcccccaccgtccctcccttttctcctcaagtcctgaagttgagtttgagaggcgacacggcggcggcggccgcgctgctcccgctcctctgcctccccatggatatgcactgcaaagcagaccccttctccgcgatgcacccagggcacgggggtgtgaaccagctcgggggggtgtttgtgaacggccggcccctacccgacgtggtgaggcagcgcatcgtggagctggcccaccagggtgtgcggccctgtgacatctcccggcagctgcgggtcagccacggctgtgtcagcaaaatcctgggcaggtactacgagaccggcagcatcaagccgggtgtgatcggtggctccaagcccaaagtggcgacgcccaaagtggtggacaagattgctgaatacaaacgacagaacccgactatgttcgcctgggagattcgagaccggctcctggccgagggcatctgtgacaatgacacagtgcccagcgtctcttccatcaacagaatcatccggaccaaagttcagcagcctttccacccaacgccggatggggctgggacaggagtgaccgcccctggccacaccattgttcccagcacggcctcccctcctgtttccagcgcctccaatgacccagtgggatcctactccatcaatgggatcctggggattcctcgctccaatggtgagaagaggaaacgtgatgaagttgaggtatacactgatcctgcccacattagaggaggtggaggtttgcatctggtctggactttaagagatgtgtctgagggctcagtccccaatggagattcccagagtggtgtggacagtttgcggaagcacttgcgagctgacaccttcacccagcagcagctggaagctttggatcgggtctttgagcgtccttcctaccctgacgtcttccaggcatcagagcacatcaaatcagaacaggggaacgagtactccctcccagccctgacccctgggcttgatgaagtcaagtcgagtctatctgcatccaccaaccctgagctgggcagcaacgtgtcaggcacacagacatacccagttgtgactggtcgtgacatggcgagcaccactctgcctggttacccccctcacgtgccccccactggccagggaagctaccccacctccaccctggcaggaatggtgcctgggagcgagttctccggcaacccgtacagccacccccagtacacggcctacaacgaggcttggagattcagcaaccccgccttactaagttccccttattattatagtgccgccccccggggctccgcccctgccgctgctgccgctgcctatgaccgccactagttaccgcggggaccacatcaagcttcaggccgacagcttcggcctccacatcgtccccgtctgaccccaccccggagggagggaggaccgacgcgacgcgatgcctcccggccaccgccccagcctcaccccatcccacgacccccgcaacccttcacatcacccccctcgaaggtcggacaggacgggtggagccgtgggcgggaccctcaggcccgggcccgccgcccccagccccgcctgccgcccctccccgcctgcctggactgcgcggcgccgtgagggggattcggcccagctcgtcccggcctccaccaagccagccccgaagcccgccagccaccctgccggactcgggcgcgacctgctggcgcgcgccggatgtttctgtgacacacaatcagcgcggaccgcagcgcggcccagccccgggcacccgcctcggacgctcgggcgccaggaggcttcgctggaggggctgggccaaggagattaagaagaaaacgactttctgcaggaggaagagcccgctgccgaatccctgggaaaaattcttttcccccagtgccagccggactgccctcgccttccgggtgtgccctgtcccagaagatggaatgggggtgtgggggtccggctctaggaacgggctttgggggcgtcaggtctttccaaggttgggacccaaggatcggggggcccagcagcccgcaccgatcgagccggactctcggctcttcactgctcctcctggcctgcctagttccccagggcccggcacctcctgctgcgagacccggctctcagccctgccttgcccctacctcagcgtctcttccacctgctggcctcccagtttcccctcctgccagtccttcgcctgtcccttgacgccctgcatcctcctccctgactcgcagccccatcggacgctctcccgggaccgccgcaggaccagtttccatagactgcggactggggtcttcctccagcagttacttgatgccccctcccccgacacagactctcaatctgccggtggtaagaaccggttctgagctggcgtctgagctgctgcggggtggaagtggggggctgcccactccactcctcccatcccctcccagcctcctcctccggcaggaactgaacagaaccacaaaaagtctacatttatttaatatgatggtctttgcaaaaaggaacaaaacaacacaaaagcccaccaggctgctgctttgtggaaagacggtgtgtgtcgtgtgaaggcgaaacccggtgtacataacccctccccctccgccccgccccgcccggccccgtagagtccctgtcgcccgccggccctgcctgtagatacgccccgctgtctgtgctgtgagagtcgccgctcgctgggggggaagggggggacacagctacacgcccattaaagcacagcacgtcctgggggaggggggcattttttatgttacaaaaaaaaattacgaaagaaaagaaatctctatgcaaaatgacgaacatggtcctgtggactcctctggcctgttttgttggctctttctctgtaattccgtgttttcgctttttcctccctgcccctctctccctctgcccctctctcctctccgcttctctccccctctgtctctgtctctctccgtctctgtcgctcttgtctgtctgtctctgctctttcctcggcctctctccccagacctggcccggccgccctgtctccgcaggctagatccgaggtggcagctccagcccccgggctcgccccctcgcgggcgtgccccgcgcgccccgggcggccgaaggccgggccgccccgtcccgccccgtagttgctctttcggtagtggcgatgcgccctgcatgtctcctcacccgtggatcgtgacgactcgaaataacagaaacaaagtcaataaagtgaaaataaataaaaatccttgaacaaatccgaaaaggcttggagtcctcgcccagatctctctcccctgcgagccctttttatttgagaaggaaaaagagaaaagagaatcgtttaagggaacccggcgcccagccaggctccagtggcccgaacggggcggcgagggcggcgagggcgccgaggtccggcccatcccagtcctgtggggctggccgggcagagaccccggacccaggcccaggcctaacctgctaaatgtccccggacggttctggtctcctcggccactttcagtgcgtcggttcgttttgattctttttcttttgtgcacataagaaataaataataataataaataaagaataaaattttgtatgtca

SEQ ID NO: 163320 - DNA, 677 bp, Homo sapiens
  Payload ID: 12178
  Gene Symbol: PAX2
  Gene Name: paired box 2
  ENST ID: ENST00000427256
  CDS Start-End: 34-677
gcggccgcgctgctcccgctcctctgcctccccatggatatgcactgcaaagcagaccccttctccgcgatgcacccagggcacgggggtgtgaaccagctcgggggggtgtttgtgaacggccggcccctacccgacgtggtgaggcagcgcatcgtggagctggcccaccagggtgtgcggccctgtgacatctcccggcagctgcgggtcagccacggctgtgtcagcaaaatcctgggcaggtactacgagaccggcagcatcaagccgggtgtgatcggtggctccaagcccaaagtggcgacgcccaaagtggtggacaagattgctgaatacaaacgacagaacccgactatgttcgcctgggagattcgagaccggctcctggccgagggcatctgtgacaatgacacagtgcccagcgtctcttccatcaacagaatcatccggaccaaagttcagcagcctttccacccaacgccggatggggctgggacaggagtgaccgcccctggccacaccattgttcccagcacggcctcccctcctgtttccagcgcctccaatgacccagtgggatcctactccatcaatgggatcctggggattcctcgctccaatggtgagaagaggaaacgtgatgaagttgaggtatacactgatcctgcccacat

SEQ ID NO: 163321 - DNA, 1755 bp, Homo sapiens
  Payload ID: 12178
  Gene Symbol: PAX2
  Gene Name: paired box 2
  ENST ID: ENST00000554172
  CDS Start-End: 842-1755
cgccccgagagttattaactcgccagcgaggcctatgccgtgccacctgggcgagacggtgggccccaaccaggctctgcgaggcgcggcaggcaggcgagcccaagcagccggcattctctgcctgctgcctggagccgctctgcctccctgtctctgagcgcagcagaccccgggcccctgcctcatccgccttccttgctctacttcagatactaaggaggtgaaagagagatacggtccccctacagataaataacattagaaaaacttcccatcaaaaacaaacaacacaggaaagaggtagaaaaattccgattacaatttaatactttttaaagaagaggcagagagcaaaggggggtgtgtgtgtcaggcacttatcccctgtctgtgctaggagctcggataaacagtcagccgagcctcgacgcccccaaatcgtccgcctccaagccccgcacgcgcggacagctcccgggttgcctgcggcgcaggcgggatgctgcttcgcactagtccagtcctctgccaggcccttcctctcctcgctttcttacgccctttccgctggcatgaattcccctttggcattttctcccctctcccctcttttctgtcatctggtttctctccagtcccccctttgctttctaccttgcgtcgcaaggcctgagtcgccctctcgcccagcccccagtcttcagcccagcgtctgtgcttccagtccccactcctccgcgtggtcgtggaggtccaccacctttcttctcaagctcgggaacatgcccttccgccctgcctgcttccttcgcccgtcccgggccgcggaccctgactaatggccggtccctgctgtgtgtggggtgttgtgtttttttcttgtctctccccagcagggcacgggggtgtgaaccagctcgggggggtgtttgtgaacggccggcccctacccgacgtggtgaggcagcgcatcgtggagctggcccaccagggtgtgcggccctgtgacatctcccggcagctgcgggtcagccacggctgtgtcagcaaaatcctgggcaggtactacgagaccggcagcatcaagccgggtgtgatcggtggctccaagcccaaagtggcgacgcccaaagtggtggacaagattgctgaatacaaacgacagaacccgactatgttcgcctgggagattcgagaccggctcctggccgagggcatctgtgacaatgacacagtgcccagcgtctcttccatcaacagaatcatccggaccaaagttcagcagcctttccacccaacgccggatggggctgggacaggagtgaccgcccctggccacaccattgttcccagcacggcctcccctcctgtttccagcgcctccaatgacccagtgggatcctactccatcaatgggatcctggggattcctcgctccaatgatgtgtctgagggctcagtccccaatggagattcccagagtggtgtggacagtttgcggaagcacttgcgagctgacaccttcacccagcagcagctggaagctttggatcgggtctttgagcgtccttcctaccctgacgtcttccaggcatcagagcacatcaaatcagaacaggggaacgagtactccctcccagccctgacccctgggcttgatgaagtcaagtcgagtctatctgcatccaccaaccctgagctgggcagcaacgtgtcaggcacacagacatacccagttgtgactggtcgtga

SEQ ID NO: 163322 - DNA, 958 bp, Homo sapiens
  Payload ID: 12179
  Gene Symbol: PAX3
  Gene Name: paired box 3
  Uniprot ID: P23760
  ENST ID: ENST00000258387
  CDS Start-End: 251-871
caaacttttccgccctgggctcgggatcctggactccggggcctccccgtcctcccctttcccgggttccagctccggcctctggactaggaaccgacagcccccctccccgcgtccctccctctctctccagccgttttggggaggggctctccacgctccggatagttcccgagggtcatccgcgccgcactcgcctttccgtttcgccttcacctggatataatttccgagcgaagctgcccccaggatgaccacgctggccggcgctgtgcccaggatgatgcggccgggcccggggcagaactacccgcgtagcgggttcccgctggaagtgtccactcccctcggccagggccgcgtcaaccagctcggcggtgtttttatcaacggcaggccgctgcccaaccacatccgccacaagatcgtggagatggcccaccacggcatccggccctgcgtcatctcgcgccagctgcgcgtgtcccacggctgcgtctccaagatcctgtgcaggtaccaggagactggctccatacgtcctggtgccatcggcggcagcaagcccaagcaggtgacaacgcctgacgtggagaagaaaattgaggaatacaaaagagagaacccgggcatgttcagctgggaaatccgagacaaattactcaaggacgcggtctgtgatcgaaacaccgtgccgtcagtgagttccatcagccgcatcctgagaagtaaattcgggaaaggtgaagaggaggaggccgacttggagaggaaggaggcagaggaaagcgagaagaaggccaaacacagcatcgacggcatcctgagcgagcgaggaaaggccctggtctccggagtttcctcgcattaaaggagagagagagagagtactcttttgggcaacggccctccaaaattgcccccacattggctgccttataaatatgtctgtgtgttg

SEQ ID NO: 163323 - DNA, 2038 bp, Homo sapiens
  Payload ID: 12179
  Gene Symbol: PAX3
  Gene Name: paired box 3
  Uniprot ID: P23760
  ENST ID: ENST00000336840
  CDS Start-End: 382-1605
actcggtgtcaccacaggaggagactcaggcaggccgcgctccagcctcaccaggctccccggctcgccgtggctctctgagcccccttttcagggaccccagtcgctggaacatttgcccagactcgtaccaaacttttccgccctgggctcgggatcctggactccggggcctccccgtcctcccctttcccgggttccagctccggcctctggactaggaaccgacagcccccctccccgcgtccctccctctctctccagccgttttggggaggggctctccacgctccggatagttcccgagggtcatccgcgccgcactcgcctttccgtttcgccttcacctggatataatttccgagcgaagctgcccccaggatgaccacgctggccggcgctgtgcccaggatgatgcggccgggcccggggcagaactacccgcgtagcgggttcccgctggaagtgtccactcccctcggccagggccgcgtcaaccagctcggcggtgtttttatcaacggcaggccgctgcccaaccacatccgccacaagatcgtggagatggcccaccacggcatccggccctgcgtcatctcgcgccagctgcgcgtgtcccacggctgcgtctccaagatcctgtgcaggtaccaggagactggctccatacgtcctggtgccatcggcggcagcaagcccaagcaggtgacaacgcctgacgtggagaagaaaattgaggaatacaaaagagagaacccgggcatgttcagctgggaaatccgagacaaattactcaaggacgcggtctgtgatcgaaacaccgtgccgtcagtgagttccatcagccgcatcctgagaagtaaattcgggaaaggtgaagaggaggaggccgacttggagaggaaggaggcagaggaaagcgagaagaaggccaaacacagcatcgacggcatcctgagcgagcgagcctcagcaccccaatcagatgaaggctctgatattgactctgaaccagatttaccactaaagaggaaacagcgcagaagccgaaccaccttcacagcagaacagctggaggaactggagcgtgcttttgagagaactcattaccctgacatttatactagggaggaactggcccagagggcgaagctcaccgaggcccgagtacaggtctggtttagcaaccgccgtgcaagatggaggaagcaagctggggccaatcaactgatggctttcaaccatctcattcccggggggttccctcccactgccatgccgaccttgccaacgtaccagctgtcggagacctcttaccagcccacatctattccacaagctgtgtcagatcccagcagcaccgttcacagacctcaaccgcttcctccaagcactgtacaccaaagcacgattccttccaacccagacagcagctctgcctactgcctccccagcaccaggcatggattttccagctatacagacagctttgtgcctccgtcggggccctccaaccccatgaaccccaccattggcaatggcctctcacctcaggtgcctttcattatctcaagccagatatcgcttggtttcaaatccttttgaacacgttcgacaaaagcagtggagaagaggaagacctggagcaataaaagacaaatgcaacattttaaggcaatggtttcacatggttacatatcaaaacatcccaattctttagtgctgatcatcgaggagctagaacattccatttgcttgtgtgcgtgcgtgcgtgtgtgtgtgtgtgtgtgtattgagatttacccagactggtttgggcaagcagactgttctaaaatataatagaataccctaaagtataacatgtcgatgttcgatgctgatacttctacaactttaaaactgctcatttcatgaagcaagaatggaggaatccttgactcttacacactggaaattgaaataaagataaatgcaaccatttttaggaagctagactagctgtaaaggacctcctaaataaattatttgttactgt

SEQ ID NO: 163324 - DNA, 3109 bp, Homo sapiens
  Payload ID: 12179
  Gene Symbol: PAX3
  Gene Name: paired box 3
  Uniprot ID: P23760
  ENST ID: ENST00000344493
  CDS Start-End: 382-1593
actcggtgtcaccacaggaggagactcaggcaggccgcgctccagcctcaccaggctccccggctcgccgtggctctctgagcccccttttcagggaccccagtcgctggaacatttgcccagactcgtaccaaacttttccgccctgggctcgggatcctggactccggggcctccccgtcctcccctttcccgggttccagctccggcctctggactaggaaccgacagcccccctccccgcgtccctccctctctctccagccgttttggggaggggctctccacgctccggatagttcccgagggtcatccgcgccgcactcgcctttccgtttcgccttcacctggatataatttccgagcgaagctgcccccaggatgaccacgctggccggcgctgtgcccaggatgatgcggccgggcccggggcagaactacccgcgtagcgggttcccgctggaagtgtccactcccctcggccagggccgcgtcaaccagctcggcggtgtttttatcaacggcaggccgctgcccaaccacatccgccacaagatcgtggagatggcccaccacggcatccggccctgcgtcatctcgcgccagctgcgcgtgtcccacggctgcgtctccaagatcctgtgcaggtaccaggagactggctccatacgtcctggtgccatcggcggcagcaagcccaagcaggtgacaacgcctgacgtggagaagaaaattgaggaatacaaaagagagaacccgggcatgttcagctgggaaatccgagacaaattactcaaggacgcggtctgtgatcgaaacaccgtgccgtcagtgagttccatcagccgcatcctgagaagtaaattcgggaaaggtgaagaggaggaggccgacttggagaggaaggaggcagaggaaagcgagaagaaggccaaacacagcatcgacggcatcctgagcgagcgagcctcagcaccccaatcagatgaaggctctgatattgactctgaaccagatttaccactaaagaggaaacagcgcagaagccgaaccaccttcacagcagaacagctggaggaactggagcgtgcttttgagagaactcattaccctgacatttatactagggaggaactggcccagagggcgaagctcaccgaggcccgagtacaggtctggtttagcaaccgccgtgcaagatggaggaagcaagctggggccaatcaactgatggctttcaaccatctcattcccggggggttccctcccactgccatgccgaccttgccaacgtaccagctgtcggagacctcttaccagcccacatctattccacaagctgtgtcagatcccagcagcaccgttcacagacctcaaccgcttcctccaagcactgtacaccaaagcacgattccttccaacccagacagcagctctgcctactgcctccccagcaccaggcatggattttccagctatacagacagctttgtgcctccgtcggggccctccaaccccatgaaccccaccattggcaatggcctctcacctcaggtgcctttcattatctcaagccagatatcgcgtaagtgaactgtccacttggagctaaaactggccctgtttctggtcttcgcagcctagatatgaagaatctgctctgaaaacaaaaaaaaattacccttttgttggggggggtggggcagtggtcccaataggagacaaaggagagtgattgattttcttcctccaatagttggtttcaaatccttttgaacacgttcgacaaaagcagtggagaagaggaagacctggagcaataaaagacaaatgcaacattttaaggcaatggtttcacatggttacatatcaaaacatcccaattctttagtgctgatcatcgaggagctagaacattccatttgcttgtgtgcgtgcgtgcgtgtgtgtgtgtgtgtgtgtattgagatttacccagactggtttgggcaagcagactgttctaaaatataatagaataccctaaagtataacatgtcgatgttcgatgctgatacttctacaactttaaaactgctcatttcatgaagcaagaatggaggaatccttgactcttacacactggaaattgaaataaagataaatgcaaccatttttaggaagctagactagctgtaaaggacctcctaaataaattatttgttactgtatcctcatttgtaatctagttgtcaataaatggcccggacatgtcttgctaacaggatatgggctaccaggaagaaggacttgtttccctttcctgtgtggggagaggtgtgtgacgtttttccagttcacatttatttggtagcccacctgggttggaggaagggcacggtggagagaaagtgacatgcattcacatatctgcttatcagtgtgcaatactgtgtacctcatggatgctttggcaatgcccaaggcgatataagcaaaatcagaagtatatttttgcaggtgcttttattttcacagcccataattcatagtgatagagtgcagtgatgtttgccatttgctggacaaccaacacccgggttgctcctttgattagagaccagatcagataattatgcttttaaactgattacgtttacattcttctcttttctatgaaaggcagggcaagaacagaagtgttcacatggctctcatgtacttttaaattatacaatgatatccaatattaaaagattataggaactgaggtttacatacgtttgtgtggtgacattttagaatgtcaataaatttgctttttgagatgttgagaggaacaagaaggtggaaggcagtgttatttatttctttctattcttggaaccacgaatgaggtaggcacaaatacattccttttagagttaagaactatgacgtagcgagttagtgagactagacatagtaccgaatttagttcatgcattggtcttagagggtgatggaacaagagaagtactatctttgtgttgcagcctcaaccaacaacaatgtgttgtaaaaatgtctttcatgtaaaaagtgcagtaaatatttactatttataatgaataaacagttatgaaaactt

SEQ ID NO: 163325 - DNA, 3610 bp, Homo sapiens
  Payload ID: 12179
  Gene Symbol: PAX3
  Gene Name: paired box 3
  Uniprot ID: P23760
  ENST ID: ENST00000350526
  CDS Start-End: 138-1577
gtccctccctctctctccagccgttttggggaggggctctccacgctccggatagttcccgagggtcatccgcgccgcactcgcctttccgtttcgccttcacctggatataatttccgagcgaagctgcccccaggatgaccacgctggccggcgctgtgcccaggatgatgcggccgggcccggggcagaactacccgcgtagcgggttcccgctggaagtgtccactcccctcggccagggccgcgtcaaccagctcggcggtgtttttatcaacggcaggccgctgcccaaccacatccgccacaagatcgtggagatggcccaccacggcatccggccctgcgtcatctcgcgccagctgcgcgtgtcccacggctgcgtctccaagatcctgtgcaggtaccaggagactggctccatacgtcctggtgccatcggcggcagcaagcccaagcaggtgacaacgcctgacgtggagaagaaaattgaggaatacaaaagagagaacccgggcatgttcagctgggaaatccgagacaaattactcaaggacgcggtctgtgatcgaaacaccgtgccgtcagtgagttccatcagccgcatcctgagaagtaaattcgggaaaggtgaagaggaggaggccgacttggagaggaaggaggcagaggaaagcgagaagaaggccaaacacagcatcgacggcatcctgagcgagcgagcctcagcaccccaatcagatgaaggctctgatattgactctgaaccagatttaccactaaagaggaaacagcgcagaagccgaaccaccttcacagcagaacagctggaggaactggagcgtgcttttgagagaactcattaccctgacatttatactagggaggaactggcccagagggcgaagctcaccgaggcccgagtacaggtctggtttagcaaccgccgtgcaagatggaggaagcaagctggggccaatcaactgatggctttcaaccatctcattcccggggggttccctcccactgccatgccgaccttgccaacgtaccagctgtcggagacctcttaccagcccacatctattccacaagctgtgtcagatcccagcagcaccgttcacagacctcaaccgcttcctccaagcactgtacaccaaagcacgattccttccaacccagacagcagctctgcctactgcctccccagcaccaggcatggattttccagctatacagacagctttgtgcctccgtcggggccctccaaccccatgaaccccaccattggcaatggcctctcacctcaggtaatgggactcctgaccaaccacggtggggtacctcatcagccccagactgattacgcgctctcccctctcaccgggggtctggaacctaccaccacggtgtcggccagctgcagtcagagactagaccatatgaagagcttggacagtctgccaacatctcagtcctactgtccacccacctatagcaccacaggctacagtatggaccctgtcacaggctaccaatatgggcagtatggacaaagtaagccttggactttttagggggcaatttctcctggaagggagataaactcaactcttccttaagaaaggtgaattagaggcaagattaagccacacatgccggtatcaatttttttttttttttgcaaagccagctgactgttccagcaggggcttccttgtgtaattattttcttaactgatgtcaacaacatcttgcggttattaattgttgagacgtgaaacctgattgccactaggtaaaacacaagggttggccaaaatgaaataatccctgacattagaaacacatgttcttaatgaggtcagctccaggatcatatgggggataatcccagggacacaaagttgtgtcaaacttgtctcaggaataaaaatattagtctcaagcctttgatagcacggtattaaatatgacattgtcagcctgtagctgatcttgcccctgactgtgaattgtcccagcatgacctaaaaagctgcgtgtgtttccttacaggtgcctttcattatctcaagccagatatcgcgtaagtgaactgtccacttggagctaaaactggccctgtttctggtcttcgcagcctagatatgaagaatctgctctgaaaacaaaaaaaaattacccttttgttggggggggtggggcagtggtcccaataggagacaaaggagagtgattgattttcttcctccaatagttggtttcaaatccttttgaacacgttcgacaaaagcagtggagaagaggaagacctggagcaataaaagacaaatgcaacattttaaggcaatggtttcacatggttacatatcaaaacatcccaattctttagtgctgatcatcgaggagctagaacattccatttgcttgtgtgcgtgcgtgcgtgtgtgtgtgtgtgtgtgtattgagatttacccagactggtttgggcaagcagactgttctaaaatataatagaataccctaaagtataacatgtcgatgttcgatgctgatacttctacaactttaaaactgctcatttcatgaagcaagaatggaggaatccttgactcttacacactggaaattgaaataaagataaatgcaaccatttttaggaagctagactagctgtaaaggacctcctaaataaattatttgttactgtatcctcatttgtaatctagttgtcaataaatggcccggacatgtcttgctaacaggatatgggctaccaggaagaaggacttgtttccctttcctgtgtggggagaggtgtgtgacgtttttccagttcacatttatttggtagcccacctgggttggaggaagggcacggtggagagaaagtgacatgcattcacatatctgcttatcagtgtgcaatactgtgtacctcatggatgctttggcaatgcccaaggcgatataagcaaaatcagaagtatatttttgcaggtgcttttattttcacagcccataattcatagtgatagagtgcagtgatgtttgccatttgctggacaaccaacacccgggttgctcctttgattagagaccagatcagataattatgcttttaaactgattacgtttacattcttctcttttctatgaaaggcagggcaagaacagaagtgttcacatggctctcatgtacttttaaattatacaatgatatccaatattaaaagattataggaactgaggtttacatacgtttgtgtggtgacattttagaatgtcaataaatttgctttttgagatgttgagaggaacaagaaggtggaaggcagtgttatttatttctttctattcttggaaccacgaatgaggtaggcacaaatacattccttttagagttaagaactatgacgtagcgagttagtgagactagacatagtaccgaatttagttcatgcattggtcttagagggtgatggaacaagagaagtactatctttgtgttgcagcctcaaccaacaacaatgtgttgtaaaaatgtctttcatgtaaaaagtgcagtaaatatttactatttataatgaataaacagttatgaaaa

SEQ ID NO: 163326 - DNA, 3170 bp, Homo sapiens
  Payload ID: 12179
  Gene Symbol: PAX3
  Gene Name: paired box 3
  Uniprot ID: P23760
  ENST ID: ENST00000392069
  CDS Start-End: 367-1884
aggaggagactcaggcaggccgcgctccagcctcaccaggctccccggctcgccgtggctctctgagcccccttttcagggaccccagtcgctggaacatttgcccagactcgtaccaaacttttccgccctgggctcgggatcctggactccggggcctccccgtcctcccctttcccgggttccagctccggcctctggactaggaaccgacagcccccctccccgcgtccctccctctctctccagccgttttggggaggggctctccacgctccggatagttcccgagggtcatccgcgccgcactcgcctttccgtttcgccttcacctggatataatttccgagcgaagctgcccccaggatgaccacgctggccggcgctgtgcccaggatgatgcggccgggcccggggcagaactacccgcgtagcgggttcccgctggaagtgtccactcccctcggccagggccgcgtcaaccagctcggcggtgtttttatcaacggcaggccgctgcccaaccacatccgccacaagatcgtggagatggcccaccacggcatccggccctgcgtcatctcgcgccagctgcgcgtgtcccacggctgcgtctccaagatcctgtgcaggtaccaggagactggctccatacgtcctggtgccatcggcggcagcaagcccaagcaggtgacaacgcctgacgtggagaagaaaattgaggaatacaaaagagagaacccgggcatgttcagctgggaaatccgagacaaattactcaaggacgcggtctgtgatcgaaacaccgtgccgtcagtgagttccatcagccgcatcctgagaagtaaattcgggaaaggtgaagaggaggaggccgacttggagaggaaggaggcagaggaaagcgagaagaaggccaaacacagcatcgacggcatcctgagcgagcgagcctcagcaccccaatcagatgaaggctctgatattgactctgaaccagatttaccactaaagaggaaacagcgcagaagccgaaccaccttcacagcagaacagctggaggaactggagcgtgcttttgagagaactcattaccctgacatttatactagggaggaactggcccagagggcgaagctcaccgaggcccgagtacaggtctggtttagcaaccgccgtgcaagatggaggaagcaagctggggccaatcaactgatggctttcaaccatctcattcccggggggttccctcccactgccatgccgaccttgccaacgtaccagctgtcggagacctcttaccagcccacatctattccacaagctgtgtcagatcccagcagcaccgttcacagacctcaaccgcttcctccaagcactgtacaccaaagcacgattccttccaacccagacagcagctctgcctactgcctccccagcaccaggcatggattttccagctatacagacagctttgtgcctccgtcggggccctccaaccccatgaaccccaccattggcaatggcctctcacctcaggtaatgggactcctgaccaaccacggtggggtacctcatcagccccagactgattacgcgctctcccctctcaccgggggtctggaacctaccaccacggtgtcggccagctgcagtcagagactagaccatatgaagagcttggacagtctgccaacatctcagtcctactgtccacccacctatagcaccacaggctacagtatggaccctgtcacaggctaccaatatgggcagtatggacaaagtgcctttcattatctcaagccagatatcgcttggtttcaaatccttttgaacacgttcgacaaaagcagtggagaagaggaagacctggagcaataaaagacaaatgcaacattttaaggcaatggtttcacatggttacatatcaaaacatcccaattctttagtgctgatcatcgaggagctagaacattccatttgcttgtgtgcgtgcgtgcgtgtgtgtgtgtgtgtgtgtattgagatttacccagactggtttgggcaagcagactgttctaaaatataatagaataccctaaagtataacatgtcgatgttcgatgctgatacttctacaactttaaaactgctcatttcatgaagcaagaatggaggaatccttgactcttacacactggaaattgaaataaagataaatgcaaccatttttaggaagctagactagctgtaaaggacctcctaaataaattatttgttactgtatcctcatttgtaatctagttgtcaataaatggcccggacatgtcttgctaacaggatatgggctaccaggaagaaggacttgtttccctttcctgtgtggggagaggtgtgtgacgtttttccagttcacatttatttggtagcccacctgggttggaggaagggcacggtggagagaaagtgacatgcattcacatatctgcttatcagtgtgcaatactgtgtacctcatggatgctttggcaatgcccaaggcgatataagcaaaatcagaagtatatttttgcaggtgcttttattttcacagcccataattcatagtgatagagtgcagtgatgtttgccatttgctggacaaccaacacccgggttgctcctttgattagagaccagatcagataattatgcttttaaactgattacgtttacattcttctcttttctatgaaaggcagggcaagaacagaagtgttcacatggctctcatgtacttttaaattatacaatgatatccaatattaaaagattataggaactgaggtttacatacgtttgtgtggtgacattttagaatgtcaataaatttgctttttgagatgttgagaggaacaagaaggtggaaggcagtgttatttatttctttctattcttggaaccacgaatgaggtaggcacaaatacattccttttagagttaagaactatgacgtagcgagttagtgagactagacatagtaccgaatttagttcatgcattggtcttagagggtgatggaacaagagaagtactatctttgtgttgcagcctcaaccaacaacaatgtgttgtaaaaatgtctttcatgtaaaaagtgcagtaaatatttactatttataatgaataaacagttatgaaaactt

SEQ ID NO: 163327 - DNA, 2258 bp, Homo sapiens
  Payload ID: 12179
  Gene Symbol: PAX3
  Gene Name: paired box 3
  Uniprot ID: P23760
  ENST ID: ENST00000392070
  CDS Start-End: 382-1836
actcggtgtcaccacaggaggagactcaggcaggccgcgctccagcctcaccaggctccccggctcgccgtggctctctgagcccccttttcagggaccccagtcgctggaacatttgcccagactcgtaccaaacttttccgccctgggctcgggatcctggactccggggcctccccgtcctcccctttcccgggttccagctccggcctctggactaggaaccgacagcccccctccccgcgtccctccctctctctccagccgttttggggaggggctctccacgctccggatagttcccgagggtcatccgcgccgcactcgcctttccgtttcgccttcacctggatataatttccgagcgaagctgcccccaggatgaccacgctggccggcgctgtgcccaggatgatgcggccgggcccggggcagaactacccgcgtagcgggttcccgctggaagtgtccactcccctcggccagggccgcgtcaaccagctcggcggtgtttttatcaacggcaggccgctgcccaaccacatccgccacaagatcgtggagatggcccaccacggcatccggccctgcgtcatctcgcgccagctgcgcgtgtcccacggctgcgtctccaagatcctgtgcaggtaccaggagactggctccatacgtcctggtgccatcggcggcagcaagcccaagcaggtgacaacgcctgacgtggagaagaaaattgaggaatacaaaagagagaacccgggcatgttcagctgggaaatccgagacaaattactcaaggacgcggtctgtgatcgaaacaccgtgccgtcagtgagttccatcagccgcatcctgagaagtaaattcgggaaaggtgaagaggaggaggccgacttggagaggaaggaggcagaggaaagcgagaagaaggccaaacacagcatcgacggcatcctgagcgagcgagcctcagcaccccaatcagatgaaggctctgatattgactctgaaccagatttaccactaaagaggaaacagcgcagaagccgaaccaccttcacagcagaacagctggaggaactggagcgtgcttttgagagaactcattaccctgacatttatactagggaggaactggcccagagggcgaagctcaccgaggcccgagtacaggtctggtttagcaaccgccgtgcaagatggaggaagcaagctggggccaatcaactgatggctttcaaccatctcattcccggggggttccctcccactgccatgccgaccttgccaacgtaccagctgtcggagacctcttaccagcccacatctattccacaagctgtgtcagatcccagcagcaccgttcacagacctcaaccgcttcctccaagcactgtacaccaaagcacgattccttccaacccagacagcagctctgcctactgcctccccagcaccaggcatggattttccagctatacagacagctttgtgcctccgtcggggccctccaaccccatgaaccccaccattggcaatggcctctcacctcaggtaatgggactcctgaccaaccacggtggggtacctcatcagccccagactgattacgcgctctcccctctcaccgggggtctggaacctaccaccacggtgtcggccagctgcagtcagagactagaccatatgaagagcttggacagtctgccaacatctcagtcctactgtccacccacctatagcaccacaggctacagtatggaccctgtcacaggctaccaatatgggcagtatggacaaagtgcctttcattatctcaagccagatatcgcgtaagtgaactgtccacttggagctaaaactggccctgtttctggtcttcgcagcctagatatgaagaatctgctctgaaaacaaaaaaaaattacccttttgttggggggggtggggcagtggtcccaataggagacaaaggagagtgattgattttcttcctccaatagttggtttcaaatccttttgaacacgttcgacaaaagcagtggagaagaggaagacctggagcaataaaagacaaatgcaacattttaaggcaatggtttcacatggttacatatcaaaacatcccaattctttagtgctgatcatcgaggagctagaacattccatttgcttgtgtgcgtgcgtgcgtgtgtgtgtgtgtgtgtgtattgagatttacccagactggtttgggcaagcagactgttctaaaatat

SEQ ID NO: 163328 - DNA, 1782 bp, Homo sapiens
  Payload ID: 12179
  Gene Symbol: PAX3
  Gene Name: paired box 3
  Uniprot ID: P23760
  ENST ID: ENST00000409551
  CDS Start-End: 281-1732
agtcgctggaacatttgcccagactcgtaccaaacttttccgccctgggctcgggatcctggactccggggcctccccgtcctcccctttcccgggttccagctccggcctctggactaggaaccgacagcccccctccccgcgtccctccctctctctccagccgttttggggaggggctctccacgctccggatagttcccgagggtcatccgcgccgcactcgcctttccgtttcgccttcacctggatataatttccgagcgaagctgcccccaggatgaccacgctggccggcgctgtgcccaggatgatgcggccgggcccggggcagaactacccgcgtagcgggttcccgctggaagtgtccactcccctcggccagggccgcgtcaaccagctcggcggtgtttttatcaacggcaggccgctgcccaaccacatccgccacaagatcgtggagatggcccaccacggcatccggccctgcgtcatctcgcgccagctgcgcgtgtcccacggctgcgtctccaagatcctgtgcaggtaccaggagactggctccatacgtcctggtgccatcggcggcagcaagcccaaggtgacaacgcctgacgtggagaagaaaattgaggaatacaaaagagagaacccgggcatgttcagctgggaaatccgagacaaattactcaaggacgcggtctgtgatcgaaacaccgtgccgtcagtgagttccatcagccgcatcctgagaagtaaattcgggaaaggtgaagaggaggaggccgacttggagaggaaggaggcagaggaaagcgagaagaaggccaaacacagcatcgacggcatcctgagcgagcgagcctcagcaccccaatcagatgaaggctctgatattgactctgaaccagatttaccactaaagaggaaacagcgcagaagccgaaccaccttcacagcagaacagctggaggaactggagcgtgcttttgagagaactcattaccctgacatttatactagggaggaactggcccagagggcgaagctcaccgaggcccgagtacaggtctggtttagcaaccgccgtgcaagatggaggaagcaagctggggccaatcaactgatggctttcaaccatctcattcccggggggttccctcccactgccatgccgaccttgccaacgtaccagctgtcggagacctcttaccagcccacatctattccacaagctgtgtcagatcccagcagcaccgttcacagacctcaaccgcttcctccaagcactgtacaccaaagcacgattccttccaacccagacagcagctctgcctactgcctccccagcaccaggcatggattttccagctatacagacagctttgtgcctccgtcggggccctccaaccccatgaaccccaccattggcaatggcctctcacctcaggtaatgggactcctgaccaaccacggtggggtacctcatcagccccagactgattacgcgctctcccctctcaccgggggtctggaacctaccaccacggtgtcggccagctgcagtcagagactagaccatatgaagagcttggacagtctgccaacatctcagtcctactgtccacccacctatagcaccacaggctacagtatggaccctgtcacaggctaccaatatgggcagtatggacaaagtgcctttcattatctcaagccagatatcgcgtaagtgaactgtccacttggagctaaaactggccctgtttctggtcttcgcag

SEQ ID NO: 163329 - DNA, 1254 bp, Homo sapiens
  Payload ID: 12179
  Gene Symbol: PAX3
  Gene Name: paired box 3
  Uniprot ID: P23760
  ENST ID: ENST00000409828
  CDS Start-End: 132-779
ccctctctctccagccgttttggggaggggctctccacgctccggatagttcccgagggtcatccgcgccgcactcgcctttccgtttcgccttcacctggatataatttccgagcgaagctgcccccaggatgaccacgctggccggcgctgtgcccaggatgatgcggccgggcccggggcagaactacccgcgtagcgggttcccgctggaagtgtccactcccctcggccagggccgcgtcaaccagctcggcggtgtttttatcaacggcaggccgctgcccaaccacatccgccacaagatcgtggagatggcccaccacggcatccggccctgcgtcatctcgcgccagctgcgcgtgtcccacggctgcgtctccaagatcctgtgcaggtaccaggagactggctccatacgtcctggtgccatcggcggcagcaagcccaagcaggtgacaacgcctgacgtggagaagaaaattgaggaatacaaaagagagaacccgggcatgttcagctgggaaatccgagacaaattactcaaggacgcggtctgtgatcgaaacaccgtgccgtcagtgagttccatcagccgcatcctgagaagtaaattcgggaaaggtgaagaggaggaggccgacttggagaggaaggaggcagaggaaagcgagaagaaggccaaacacagcatcgacggcatcctgagcgagcgaggtaagcggtggcgccttgggcggcgcacttgctgggtgacttggagggcatcggctagctgacattggtgatctgacggcagccaagcccagctcggatcaaggtcccttcatgcgcggtgtctctgcgcctgagtaacgacatggaactgaaagaccagagggacactaggaatcaaaacaaacatttctattctgcttagtttttctgttttgtaaatctttctttcttaaccactttcagcccctgggattctagaactgtgaattgtgctctgttgtagggggcaggggaagctctcactctgttgccattaaatgtatgagactgggcatctctgagcaattgtagggccggggatagagggtacttgaatcttcagaagttgaagtagcttttatgccctcaggaaaggccctggtctccggagtttcctcgcattaaaggagagagagagagagtactcttttgggcaacggccctccaaaattgcccccacattggctgccttataaatatgtctgtgtgttgactggt

SEQ ID NO: 163330 - DNA, 2010 bp, Homo sapiens
  Payload ID: 12180
  Gene Symbol: PAX4
  Gene Name: paired box 4
  Uniprot ID: O43316
  ENST ID: ENST00000341640
  CDS Start-End: 207-1238
caaagactcacccgtgagccagctctcaaagaaagcagcttgcgttgacagcctgggggcagcaaggatgcagtctcccaggagaggatgcactcggtggtgggaagccaggctggaggggcctgagtgaccctctccacaggcgggcagggcagtgggagaggtggtgtgtggatacctctgtctcacgcccagggatcagcagcatgaaccagcttggggggctctttgtgaatggccggcccctgcctctggatacccggcagcagattgtgcggctagcagtcagtggaatgcggccctgtgacatctcacggatccttaaggtatctaatggctgtgtgagcaagatcctagggcgttactaccgcacaggtgtcttggagccaaagggcattgggggaagcaagccacggctggctacaccccctgtggtggctcgaattgcccagctgaagggtgagtgtccagccctctttgcctgggaaatccaacgccagctttgtgctgaagggctttgcacccaggacaagactcccagtgtctcctccatcaaccgagtcctgcgggcattacaggaggaccagggactaccgtgcacacggctcaggtcaccagctgttttggctccagctgtcctcactccccatagtggctctgagactccccggggtacccacccagggaccggccaccggaatcggactatcttctccccaagccaagcagaggcactggagaaagagttccagcgtgggcagtatcctgattcagtggcccgtggaaagctggctactgccacctctctgcctgaggacacggtgagggtctggttttccaacagaagagccaaatggcgtcggcaagagaagctcaagtgggaaatgcagctgccaggtgcttcccaggggctgactgtaccaagggttgccccaggaatcatctctgcacagcagtcccctggcagtgtgcccacagcagccctgcctgccctggaaccactgggtccctcctgctatcagctgtgctgggcaacagcaccagaaaggtgtctgagtgacaccccacctaaagcctgtctcaagccctgctggggccacttgcccccacagccgaattccctggactcaggactgctttgccttccttgcccttcctcccactgtcacctggccagtcttagtggctctcaggccctgctctggcctggctgcccactactgtatggcttggaatgaggcaggagtgggaaggagatggcatagagaagatctaataccatcctgcccattgtccttaccgtcctgcccatacagactgtggctccttcctccttcctgtgattgctccctcctgtgtggacgttgcctggccctgcctcgatgcctctctggcgcatcacctgattggaggggctggtaaagcaacacccacccacttctcacactagccttaagaggcctccactcagcagtaataaaagctgtttttattagcagtagttctgttgtccatcatgttttccctatgagcacccctatgcccactctaatattcaacaattatagacaatttgccctatcatttatttacatctatgtatctaccatctaatctatgcatgtatgtaggcaatacatgtatctaaacaatgtatttgtcaatgcatcaatttacctactctatgtatgcatctatatgtgtattatgtatgcgtgcatgcgtgcgcgcacacacacacacacacacacacactgacattatatcatggcattttattcctaaatcttccagcatgcatccccaaaaaacaagaaacttgtcttacataatcacaataatatatccacatctaagaaaatttactgtaacttcttaatctaagaaaattatgtatttttgtcatatgtattttgtcatatgtattttgtatttgcatatgtattttgtatttgcatatgtatttttgtcatagcagcaaacagagtgaaatgccatttttcatattct

SEQ ID NO: 163331 - DNA, 1085 bp, Homo sapiens
  Payload ID: 12180
  Gene Symbol: PAX4
  Gene Name: paired box 4
  ENST ID: ENST00000338516
  CDS Start-End: 1-1050
atgcatcaggacgggatcagcagcatgaaccagcttggggggctctttgtgaatggccggcccctgcctctggatacccggcagcagattgtgcggctagcagtcagtggaatgcggccctgtgacatctcacggatccttaaggtatctaatggctgtgtgagcaagatcctagggcgttactaccgcacaggtgtcttggagccaaagggcattgggggaagcaagccacggctggctacaccccctgtggtggctcgaattgcccagctgaagggtgagtgtccagccctctttgcctgggaaatccaacgccagctttgtgctgaagggctttgcacccaggacaagactcccagtgtctcctccatcaaccgagtcctgcgggcattacaggaggaccagggactaccgtgcacacggctcaggtcaccagctgttttggctccagctgtcctcactccccatagtggctctgagactccccggggtacccacccagggaccggccaccggaatcggactatcttctccccaagccaagcagaggcactggagaaagagttccagcgtgggcagtatcctgattcagtggcccgtggaaagctggctactgccacctctctgcctgaggacacggtgagggtctggttttccaacagaagagccaaatggcgtcggcaagagaagctcaagtgggaaatgcagctgccaggtgcttcccaggggctgactgtaccaagggttgccccaggaatcatctctgcacagcagtcccctggcagtgtgcccacagcagccctgcctgccctggaaccactgggtccctcctgctatcagctgtgctgggcaacagcaccagaaaggtgtctgagtgacaccccacctaaagcctgtctcaagccctgctgggactgtggctccttcctccttcctgtgattgctccctcctgtgtggacgttgcctggccctgcctcgatgcctctctggcgcatcacctgattggaggggctggtaaagcaacacccacccacttctcacacccttaagaggcctccactcagcagtaataaaagctgttttt

SEQ ID NO: 163332 - DNA, 1088 bp, Homo sapiens
  Payload ID: 12180
  Gene Symbol: PAX4
  Gene Name: paired box 4
  ENST ID: ENST00000378740
  CDS Start-End: 25-1047
atgcatcaggacgggatcagcagcatgaaccagcttggggggctctttgtgaatggccggcccctgcctctggatacccggcagcagattgtgcggctagcagtcagtggaatgcggccctgtgacatctcacggatccttaaggtatctaatggctgtgtgagcaagatcctagggcgttactaccgcacaggtgtcttggagccaaagggcattgggggaagcaagccacggctggctacaccccctgtggtggctcgaattgcccagctgaagggtgagtgtccagccctctttgcctgggaaatccaacgccagctttgtgctgaagggctttgcacccaggacaagactcccagtgtctcctccatcaaccgagtcctgcgggcattacaggaggaccagggactaccgtgcacacggctcaggtcaccagctgttttggctccagctgtcctcactccccatagtggctctgagactccccggggtacccacccagggaccggccaccggaatcggactatcttctccccaagccaagcagaggcactggagaaagagttccagcgtgggcagtatcctgattcagtggcccgtggaaagctggctactgccacctctctgcctgaggacacggtgagggtctggttttccaacagaagagccaaatggcgtcggcaagagaagctcaagtgggaaatgcagctgccaggtgcttcccaggggctgactgtaccaagggttgccccaggaatcatctctgcacagcagtcccctggcagtgtgcccacagcagccctgcctgccctggaaccactgggtccctcctgctatcagctgtgctgggcaacagcaccagaaaggtgtctgagtgacaccccacctaaagcctgtctcaagccctgctgggactgtggctccttcctccttcctgtgattgctccctcctgtgtggacgttgcctggccctgcctcgatgcctctctggcgcatcacctgattggaggggctggtaaagcaacacccacccacttctcacactagccttaagaggcctccactcagcagtaataaaagctgttttt

SEQ ID NO: 163333 - DNA, 1613 bp, Homo sapiens
  Payload ID: 12180
  Gene Symbol: PAX4
  Gene Name: paired box 4
  ENST ID: ENST00000463946
  CDS Start-End: 462-1487
gggcagcaaggatgcagtctcccaggagaggatgcactcggtggtgggaagccaggctggaggggcctgagtgaccctctccacaggcgggcagggcagtgggagaggtggtgtgtggatacctctgtctcacgcccagggatcagcagcatgaaccagcttggggggctctttgtgaatggccggcccctgcctctggatacccggcagcagattgtgcggctagcagtcagtggaatgcggccctgtgacatctcacggatccttaaggtaatgggccagcacctttacccagtgatggggacaggaagcagggagaaagggctcctctgaaggcaagagcctggggctgttgcaggctctgagggcttctgggacttgggtcacttcctgggagatcctctcggaggttgaaaaggggagcctcaggccctcaaaggtgaggctggactcccgacttcatggcctggtccagtaagtcttggctttgtcttatagcctcctcctgtcccagggacactctccttccttctgcccatcatgcctcacctgtccctgcttctcacctgactcaggtatctaatggctgtgtgagcaagatcctagggcgttactaccgcacaggtgtcttggagccaaagggcattgggggaagcaagccacggctggctacaccccctgtggtggctcgaattgcccagctgaagggtgagtgtccagccctctttgcctgggaaatccaacgccagctttgtgctgaagggctttgcacccaggacaagactcccagtgtctcctccatcaaccgagtcctgcgggcattacaggaggaccagggactaccgtgcacacggctcaggtcaccagctgttttggctccagctgtcctcactccccatagtggctctgagactccccggggtacccacccagggaccggccaccggaatcggactatcttctccccaagccaagcagaggcactggagaaagagttccagcgtgggcagtatcctgattcagtggcccgtggaaagctggctactgccacctctctgcctgaggacacggtgagggtctggttttccaacagaagagccaaatggcgtcggcaagagaagctcaagtgggaaatgcagctgccaggtgcttcccaggggctgactgtaccaagggttgccccaggaatcatctctgcacagcagtcccctggcagtgtgcccacagcagccctgcctgccctggaaccactgggtccctcctgctatcagctgtgctgggcaacagcaccagaaaggtgtctgagtgacaccccacctaaagcctgtctcaagccctgctggggccacttgcccccacagccgaattccctggactcaggactgctttgccttccttgcccttcctcccactgtcacctggccagtcttagtggctctcaggccctgctctggcctggctgcccactactgtatggcttggaatgaggcaggagtgggaaggagatggcatagagaagatctaataccatcctgcccattgtccttaccgtcctgcccatacagactgtggctccttcctccttcctgtgattgctccctcctgtgtggacg

SEQ ID NO: 163334 - DNA, 1565 bp, Homo sapiens
  Payload ID: 12180
  Gene Symbol: PAX4
  Gene Name: paired box 4
  ENST ID: ENST00000483494
  CDS Start-End: 462-1235
gggcagcaaggatgcagtctcccaggagaggatgcactcggtggtgggaagccaggctggaggggcctgagtgaccctctccacaggcgggcagggcagtgggagaggtggtgtgtggatacctctgtctcacgcccagggatcagcagcatgaaccagcttggggggctctttgtgaatggccggcccctgcctctggatacccggcagcagattgtgcggctagcagtcagtggaatgcggccctgtgacatctcacggatccttaaggtaatgggccagcacctttacccagtgatggggacaggaagcagggagaaagggctcctctgaaggcaagagcctggggctgttgcaggctctgagggcttctgggacttgggtcacttcctgggagatcctctcggaggttgaaaaggggagcctcaggccctcaaaggtgaggctggactcccgacttcatggcctggtccagtaagtcttggctttgtcttatagcctcctcctgtcccagggacactctccttccttctgcccatcatgcctcacctgtccctgcttctcacctgactcaggtatctaatggctgtgtgagcaagatcctagggcgttactaccgcacaggtgtcttggagccaaagggcattgggggaagcaagccacggctggctacaccccctgtggtggctcgaattgcccagctgaagggtgagtgtccagccctctttgcctgggaaatccaacgccagctttgtgctgaagggctttgcacccaggacaagactcccagtgtctcctccatcaaccgagtcctgcgggcattacaggaggaccagggactaccgtgcacacggctcaggtcaccagctgttttggctccagctgtcctcactccccatagtggctctgagactccccggggtacccacccagggaccggccaccggaatcggactatcttctccccaagccaagcagaggcactggagaaagagttccagcgtgggcagtatcctgattcagtggcccgtggaaagctggctactgccacctctctgcctgaggacacggtgagggtctggttttccaacagaagagccaaatggcgtcggcaagagaagctcaagtgggaaatgcagctgccaggtgcttcccaggggctgactgtaccaagggttgccccaggaatcatctctgcacagggccccacagtgttcatgtcaagaaagtactaacccaaagtctactatgtgaatggtgccctctggagttgtgcaggatactacttgggtggcaggcagctctggggtcccggcgttctctacaggaggcatcactggaagctaaggttcttctcttgctttttttttttagcagtcccctggcagtgtgcccacagcagccctgcctgccctggaaccactgggtccctcctgctatcagctgtgctgggcaacagcaccagaaaggtgtctgagtgacaccccacctaaagcctgtctcaagccctgctgggactgtggctccttcctccttcctgtgattgctccctcctgtgtggacgt

SEQ ID NO: 163335 - DNA, 1235 bp, Homo sapiens
  Payload ID: 12180
  Gene Symbol: PAX4
  Gene Name: paired box 4
  ENST ID: ENST00000611453
  CDS Start-End: 462-1235
gggcagcaaggatgcagtctcccaggagaggatgcactcggtggtgggaagccaggctggaggggcctgagtgaccctctccacaggcgggcagggcagtgggagaggtggtgtgtggatacctctgtctcacgcccagggatcagcagcatgaaccagcttggggggctctttgtgaatggccggcccctgcctctggatacccggcagcagattgtgcggctagcagtcagtggaatgcggccctgtgacatctcacggatccttaaggtaatgggccagcacctttacccagtgatggggacaggaagcagggagaaagggctcctctgaaggcaagagcctggggctgttgcaggctctgagggcttctgggacttgggtcacttcctgggagatcctctcggaggttgaaaaggggagcctcaggccctcaaaggtgaggctggactcccgacttcatggcctggtccagtaagtcttggctttgtcttatagcctcctcctgtcccagggacactctccttccttctgcccatcatgcctcacctgtccctgcttctcacctgactcaggtatctaatggctgtgtgagcaagatcctagggcgttactaccgcacaggtgtcttggagccaaagggcattgggggaagcaagccacggctggctacaccccctgtggtggctcgaattgcccagctgaagggtgagtgtccagccctctttgcctgggaaatccaacgccagctttgtgctgaagggctttgcacccaggacaagactcccagtgtctcctccatcaaccgagtcctgcgggcattacaggaggaccagggactaccgtgcacacggctcaggtcaccagctgttttggctccagctgtcctcactccccatagtggctctgagactccccggggtacccacccagggaccggccaccggaatcggactatcttctccccaagccaagcagaggcactggagaaagagttccagcgtgggcagtatcctgattcagtggcccgtggaaagctggctactgccacctctctgcctgaggacacggtgagggtctggttttccaacagaagagccaaatggcgtcggcaagagaagctcaagtgggaaatgcagctgccaggtgcttcccaggggctgactgtaccaagggttgccccaggaatcatctctgcacagggccccacagtgttcatgtcaagaaagtactaa

SEQ ID NO: 163336 - DNA, 8615 bp, Homo sapiens
  Payload ID: 12181
  Gene Symbol: PAX5
  Gene Name: paired box 5
  Uniprot ID: Q02548
  ENST ID: ENST00000358127
  CDS Start-End: 155-1330
agctcggcgggggagcggaaggcttgaattattccgacctgtgagcggcccctggcaccaaaaaaaaaaaaaaaaaaaaaaaaaaaagaaaaaaaaaggcacaaaaaagtggaaacttttccctgtccattccatcaagtcctgaaaaatcaaaatggatttagagaaaaattatccgactcctcggaccagcaggacaggacatggaggagtgaatcagcttgggggggtttttgtgaatggacggccactcccggatgtagtccgccagaggatagtggaacttgctcatcaaggtgtcaggccctgcgacatctccaggcagcttcgggtcagccatggttgtgtcagcaaaattcttggcaggtattatgagacaggaagcatcaagcctggggtaattggaggatccaaaccaaaggtcgccacacccaaagtggtggaaaaaatcgctgaatataaacgccaaaatcccaccatgtttgcctgggagatcagggaccggctgctggcagagcgggtgtgtgacaatgacaccgtgcctagcgtcagttccatcaacaggatcatccggacaaaagtacagcagccacccaaccaaccagtcccagcttccagtcacagcatagtgtccactggctccgtgacgcaggtgtcctcggtgagcacggattcggccggctcgtcgtactccatcagcggcatcctgggcatcacgtcccccagcgccgacaccaacaagcgcaagagagacgaaggtattcaggagtctccggtgccgaacggccactcgcttccgggcagagacttcctccggaagcagatgcggggagacttgttcacacagcagcagctggaggtgctggaccgcgtgtttgagaggcagcactactcagacatcttcaccaccacagagcccatcaagcccgagcagaccacagagtattcagccatggcctcgctggctggtgggctggacgacatgaaggccaatctggccagccccacccctgctgacatcgggagcagtgtgccaggcccgcagtcctaccccattgtgacaggccgtgacttggcgagcacgaccctccccgggtaccctccacacgtcccccccgctggacagggcagctactcagcaccgacgctgacagggatggtgcctgggagtgagttttccgggagtccctacagccaccctcagtattcctcgtacaacgactcctggaggttccccaacccggggctgcttggctccccctactattatagcgctgccgcccgaggagccgccccacctgcagccgccactgcctatgaccgtcactgacccttggagccaggcgggcaccaaacactgatggcacctattgagggtgacagccacccagccctcctgaagatagccagagagcccatgagaccgtcccccagcatcccccacttgcctgaagctcccctcttcctctcttcctccagggactctggggccctttggtggggccgttggacttctggatgcttgtctatttctaaaagccaatctatgagcttctcccgatggccactgggtctctgcaaaccaatagactgtcctgcaaataaccgcagccccagcccagcctgcctgtcctccagctgtctgactatccatccatcataaccaccccagcctgggaaggagagcttgcttttgttgcttcagcagcacccatgtaaataccttcttgcttttctgtgggcctgaaggtccgactgagaagactgctccacccatgatgcatctcgcactcttggtgcatcaccggacatcttagacctatggcagagcatcctctctgccctgggtgaccctggcaggtgcgctcagagctgtcctcaagatggaggatgctgcccttgggccccagcctcctgctcatccctccttctttagtatctttacgaggagtctcactgggctggttgtgctgcaggctccccctgaggcccctctccaagaggagcacactttggggagatgtcctggtttcctgcctccatttctctgggaccgatgcagtatcagcagctcttttccagatcaaagaactcaaagaaaactgtctgggagattcctcagctacttttccgaagcagaatgtcatccgaggtattgattacattgtggactttgaatgtgagggctggatgggacgcaggagatcatctgatcccagccaaggaggggcctgaggctctccctactccctcagcccctggaacggtgttttctgaggcatgcccaggttcaggtcacttcggacacctgccatggacacttcacccaccctccaggaccccagcaagtggattctgggcaagcctgttccggtgatgtagacaataattaacacagaggactttcccccacacccagatcacaaacagcctacagccagaacttctgagcatcctctcggggcagaccctccccgtcctcgtggagcttagcaggcagctgggcatggaggtgctggggctggggcagatgcctaatttcgcacaatgcatgcccacctgttgatctaaggggccgcgatggtcagggccacggccaagggccacgggaacttggagagggagcttggagaactcactgtgggctagggtggtcagaggaagccagcagggaagatctgggggacagaggaaggcctcctgagggaggggcaggagagcagtgaggagctgctgtgtgacctgggagtgattttgacatgggggtgccaggtgccatcatctctttacctggggccttaattccttgcatagtctctcttgtcaagtcagaacagccaggtagagcccttgtccaaacctgggctgaatgacagtgatgagagggggcttggccttcttaggtgacaatgtcccccatatctgtatgtcaccaggatggcagagagccagggcagagagagactggacttgggatcagcaggccaggcaggtcttgtcctggtcctggccacatgtctttgctgtgggacctcagacaaaaccctgcacctctttgagccttggctgccttggtgcagcagggtcatctgtagggccaccccacagctctttccttcccctcctctctccagggagccggggctgtgagaggatcatctggggcaggccctccacttccaagcaagcagatgggggtgggcacctgaggcccaataatatttggaccaagtgggaaacaagaacactcggaggggcgggaatcagaagagcctggaaaaagacctagcccaacttcccttgtgggaaactgaggcccagcttggggaaggccaggaccatgcagggagaaaaagcagacttcctctggccaccgctaagtattttgttccctaagtcccccacagggtggtggaacagaagagaaaactaaggctcagcaaggtggagtcctcaagcagtgactggtgggggtggggctgggactcgggctcctgacccccaacccatggtgttccctgtcaccctggtctatccacatctcctattcctgaggagagttgacagtaagagcagtgagagatggttctgggccccatgccctagacaatcagtctgtaagaactgccaaggaagcctggtcacccaggccagggatggagcccagcgagctcacagcaggcacatgcacccccgcccccacccagaacctgcggggcaaagaagggaggtagttggggccagagtccacctccaggagccagggtgagctggctgcagcttccacctgtcaggtaaggtaggagaaggtatgttacctggcatctctctccctgcctccctccatttagcaggaagtggtggggtcaggggtcttcagcacagacttcttgagcctctgccccctgtcacccttcttttggaatgatgtgtacccacatctttggatcctgccctccttgtggttccaggctgttgggaggaggtcagcctcccctgaaccagctgcctgaggcatgcagcatccttcctcggcaaagcccacctggctcacagcggccccctctccccatcctgttcctcttcttgccctgtaatgagctccccccatacctttcctccctcacctgaggctttgctggtcctcagattggttttgtatttgtgagacaaccacttgactcctgggctgccaggcggaagcacaagcgcacatggatgcacacggatgttctcacacacacacgcccgctctcaccaattcacagcacctcgtggtccagcggagctgcctgggagcttggtgaggatggctccaaaggacacaagccgttgagtagatgccagagaattctgaatggaaaacacaagtccggggcctcaccagcatcgtggcagaaggcctggggcatttctccatgggccttcttccctgtgttcgagctctgacttttggaaaaggacattgtggattttatgaaaatttctcataccatcagtctagctccaacctagaaaaattggatgatatatcaaacccaacatccctttcccaaggcaccttagttaaggctagcccttccataactgacattgtacggtgctttgcaatcctcaaccactctgtggagcaaagagcatgatgcctactttatagacggggaaattgacatttggggctctcacggcaacatagaggcgaagtgaattctcagatctccaggccccattctctctccaccgagttgtgctcctgtcatgggagtgtatggcttaaagacactcccccacccccattccctagaaatcccccagacccacaatcaggcaagaaagaacagggacccagaggctggcctgacctaggggcctgcaggttggcggctttgtttcctaagaacattgaaacctgcggagtctttgaccaaatccacaacagtgcttctgaggtttcatccagactctttcccagctgtccctgaggttcagagggtatcagagtcaattcaaggccatgccataatccctgaccaggcctggacatgggtccagccctgactccaggggtccaggtgccaaggtcatgtgctgtcccccacttccctttctttgccttcgcactttggaacaggctccaggcctggctgtgacagtatgcaggagtgcccaagccagggccaccagggtgtccacagcccctggaaacacagatcacaatctcaagtcccctgaatgaactgcttcctgggtgaacggggtggtgtagccttgccactcgggcagcgcaccagacagtacggtgcagcagtgcccgagatgcccagaagtgtgcctgcccccctgagtggcattcaagtatgaaaacttgtaaaattttctgtcggcctaaagaaaaatgtccatgggccaaacttgacccactgggcaccagcctgtgagccccaatgcctgtcaattgccccctttctcattcacctcctgtcctttgttgcagatttggaggagatgggagcccagagaggtgagagatgtgcttcagggtgtccagcaaggcaggggtagaaacgggcacgcccagagcctgccactctcccaggcctcatcttgggctcttgcaagtcttgcgctttgaagatggagttgggtggaaggtcagaggcgctggggacgggattggggagctgctgggttttcaggggaggtcagtgctgcttgggcacctttcacatgtgcagggaagagactcagatgtggccacagggcactgaggggtgaaatccatttaccagaagtcacgctccagaacgactgcccagccttggcagccagtggctccagccaccccctcctcatgacattcagccagaattgagctccaagccagggaagcaaatcttaaaaaccaaccaagcaccctgacacagccctagaaacacgatgagtctgaaatacagcttcccaggaggggagtctaagatacagcttcccgggagggtggaaaccaactcctgccccacggccaggccaggcccaggcaggcatgggtggatcccacagggctctgagctagaccggctccacggtggccccactacgaggccagttctgcagtcttggccttgtcacccatcgagaggctgctctgatggttcccagccacacaccagctctcctggggaaactatttctttcgttcttttggcctcggagaggtccgaggcaagtacatttcttaaaaggtaataaaatgcattattggaaagttggacagtcaggccacgactcctagcccacggcgtgccccacctcccagcagccccttcagccccttgcccctgttgccccaaacctcagggttccctcttgcatattcatgggggaaccacagtgctgatgtgtacttccccactgtcagctcggctgcacctcgtgtggcgccaggtcccaagggcctctgcagaggccaggctgtgagccccttgcctgcctgctcccctgatgaggcaacagcttctctgaaatgagctgccggccaggagcaggcaggcaccagcctgtctttccttttctggtaattcctcagcactgaggctccgttcctgggcaccccaggattgaagggaacctcagaatcatgtcactgccattctagagtttcaatccaaggggtcccctttagctcatctccaagatgggtaaacgtagccaccattcagaaagcccagaaattcttgttcccacatcttagacccctgagcaacacaaggagaaaatgcagctgcttacctattaatatctactgagggacaatcagcaaagcctcaaaggagtcgtctcaggtagggtacttggcctgtggcaggagagacagaggcacaaacccacccacccatcagcttccggtggctgatcggggcccagggagggaagcaggtgaaacagcagggtgggggtgacttggcagtcgtgcatctcctccccgactctgaggcctggcaggaggaggccacaccagcctcacctgccctgacccccgccccccaccctgtgaccctgtggctatggccgctggtcgcccttgtccccaaaatcaccatgcctgtggccacgtccctcatcttctccaaaagcatcattaagaacaagtgattttggatgatggatttttgatttacaaacggcgcatttcccttggagtggaacagaaaggaaaccatttaatggcgcccttcttttcaagcatgaatacattttaatgaaactattttattgtatttgaggaaatggagagttgaacattccaaccaatcaatagccaattaattgctataaagctaaaaagaaaataaataaatcctgagtctattttaaacactgcaaaaagttcagagcctcagaatctggccttcccctccataaggtgcacgagcatgtaaacacacacacacacacacacacacacacacacacactcactcactcccctacacctcagacatacttgaaactcagaaacagcactgagtctccccatgccaattcttgcctgctgtcttcgacttgggtcagagaaggtgagcagacccggcagcagcctgtcccggggctcaggaagaggcaggcccatcccctggccccaagcacccagcacaacagagggtggcgggcagtgagggcctggcgttgcctgggccccacttctcagccccagctgctgggcctccaaggttgggctgaggatggagttttggctctgggtttgccctgactcctgctggaagacgctgccctggtttttcaccctctagtggccttggacattgagtatttgtagaaatgcagattacattgcaaatggaaacctttgccaggaagacacatgcattttgcttttaattctttgagacatttgattttgtcttagggactgacctttcagcatcaaagaaatacatatctactgtatccgccaaagtttgtgatgcctgcatagacgcttacttgtaaaaaaaaaaaaatacaaaaaaatacaaaaaaaccaacaacaaaaaccacaattgaattgcctttgaaagtgggagatgatctgtctccaacggattgaaaaaaaaaaatgcttcttaaaaaatgtgtatgttttgtattctttttttctagtagaaaataactgacttgaaatattggtggtttttttcttagtgacgtgtgttgcttttgtgtgtaataatatttgaatgtaattacagcagtgccaatttgccaaagatgttggacatatttttcttttttggggaggagggcagggctaggggtgggacttgggagaaaacaggggtggggttttggtttaattttttttttacttttttttccttgtcaaacctgaaatttgtggcttccttttaagttaaatggttgactgcaacacctttattttagattagttggagaaacatgcaataagattggcgtagtttcaatatctgtgtgtcttttcatgagtggctgttacttgtgaagaattgattttatgtaacctttatgtgagataattatttgtaaatatttgccataattttattggttcctaaaataaaagtaattttttaagttca

SEQ ID NO: 163337 - DNA, 1444 bp, Homo sapiens
  Payload ID: 12181
  Gene Symbol: PAX5
  Gene Name: paired box 5
  Uniprot ID: Q02548
  ENST ID: ENST00000377840
  CDS Start-End: 11-877
aaaaatcaaaatggatttagagaaaaattatccgactcctcggaccagcaggacaggacatggaggagtgaatcagcttgggggggtttttgtgaatggacggccactcccggatgtagtccgccagaggatagtggaacttgctcatcaaggtgtcaggccctgcgacatctccaggcagcttcgggtcagccatggttgtgtcagcaaaattcttggcaggtattatgagacaggaagcatcaagcctggggtaattggaggatccaaaccaaaggtcgccacacccaaagtggtggaaaaaatcgctgaatataaacgccaaaatcccaccatgtttgcctgggagatcagggaccggctgctggcagagcgggtgtgtgacaatgacaccgtgcctagcgtcagttccatcaacaggatcatccggacaaaagtacagcagccacccaaccaaccagtcccagcttccagtcacagcatagtgtccactggctccgtgacgcaggtgtcctcggtgagcacggattcggccggctcgtcgtactccatcagcggcatcctgggcatcacgtcccccagcgccgacaccaacaagcgcaagagagacgaaggtattcaggagtctccggtgccgaacggccactcgcttccgggcagagacttcctccggaagcagatgcggggagacttgttcacacagcagcagctggaggtgctggaccgcgtgtttgagaggcagcactactcagacatcttcaccaccacagagcccatcaagcccgagcaggccgtgacttggcgagcacgaccctccccgggtaccctccacacgtcccccccgctggacagggcagctactcagcaccgacgctgacagggatggtgcctgggagtgagttttccgggagtccctacagccaccctcagtattcctcgtacaacgactcctggaggttccccaacccggggctgcttggctccccctactattatagcgctgccgcccgaggagccgccccacctgcagccgccactgcctatgaccgtcactgacccttggagccaggcgggcaccaaacactgatggcacctattgagggtgacagccacccagccctcctgaagatagccagagagcccatgagaccgtcccccagcatcccccacttgcctgaagctcccctcttcctctcttcctccagggactctggggccctttggtggggccgttggacttctggatgcttgtctatttctaaaagccaatctatgagcttctcccgatggccactgggtctctgcaaaccaatagactgtcctgcaaataaccgcagccccagcccagcctgcctgtcctccagctgtctgactatccatccatcataaccaccccagcctgggaaggagagcttgcttttgttgcttcagcagcacccatgta

SEQ ID NO: 163338 - DNA, 996 bp, Homo sapiens
  Payload ID: 12181
  Gene Symbol: PAX5
  Gene Name: paired box 5
  Uniprot ID: Q02548
  ENST ID: ENST00000377847
  CDS Start-End: 1-987
atggatttagagaaaaattatccgactcctcggaccagcaggacaggacatggaggagtgaatcagcttgggggggtttttgtgaatggacggccactcccggatgtagtccgccagaggatagtggaacttgctcatcaaggtgtcaggccctgcgacatctccaggcagcttcgggtcagccatggttgtgtcagcaaaattcttggcaggtattatgagacaggaagcatcaagcctggggtaattggaggatccaaaccaaaggtcgccacacccaaagtggtggaaaaaatcgctgaatataaacgccaaaatcccaccatgtttgcctgggagatcagggaccggctgctggcagagcgggtgtgtgacaatgacaccgtgcctagcgtcagttccatcaacaggatcatccggacaaaagtacagcagccacccaaccaaccagtcccagcttccagtcacagcatagtgtccactggctccgtgacgcaggtgtcctcggtgagcacggattcggccggctcgtcgtactccatcagcggcatcctgggcatcacgtcccccagcgccgacaccaacaagcgcaagagagacgaaggtattcaggagtctccggtgccgaacggccactcgcttccgggcagagacttcctccggaagcagatgcggggagacttgttcacacagcagcagctggaggtgctggaccgcgtgtttgagaggcagcactactcagacatcttcaccaccacagagcccatcaagcccgagcagaccacagagtattcagccatggcctcgctggctggtgggctggacgacatgaaggccaatctggccagccccacccctgctgacatcgggagcagtgtgccaggcccgcagtcctaccccattgtgacaggctccccctactattatagcgctgccgcccgaggagccgccccacctgcagccgccactgcctatgaccgtcactgacccttggag

SEQ ID NO: 163339 - DNA, 1472 bp, Homo sapiens
  Payload ID: 12181
  Gene Symbol: PAX5
  Gene Name: paired box 5
  Uniprot ID: Q02548
  ENST ID: ENST00000377852
  CDS Start-End: 11-1084
aaaaatcaaaatggatttagagaaaaattatccgactcctcggaccagcaggacaggacatggaggagtgaatcagcttgggggggtttttgtgaatggacggccactcccggatgtagtccgccagaggatagtggaacttgctcatcaaggtgtcaggccctgcgacatctccaggcagcttcgggtcagccatggttgtgtcagcaaaattcttggcaggtattatgagacaggaagcatcaagcctggggtaattggaggatccaaaccaaaggtcgccacacccaaagtggtggaaaaaatcgctgaatataaacgccaaaatcccaccatgtttgcctgggagatcagggaccggctgctggcagagcgggtgtgtgacaatgacaccgtgcctagcgtcagttccatcaacaggatcatccggacaaaagtacagcagccacccaaccaaccagtcccagcttccagtcacagcatagtgtccactggctccgtgacgcaggtgtcctcggtgagcacggattcggccggctcgtcgtactccatcagcggcatcctgggcatcacgtcccccagcgccgacaccaacaagcgcaagagagacgaaggtattcaggagtctccggtgccgaacggccactcgcttccgggcagagacttcctccggaagcagatgcggggagacttgttcacacagcagcagctggaggtgctggaccgcgtgtttgagaggcagcactactcagacatcttcaccaccacagagcccatcaagcccgagcagaccacagagtattcagccatggcctcgctggctggtgggctggacgacatgaaggccaatctggccagccccacccctgctgacatcgggagcagtgtgccaggcccgcagtcctaccccattgtgacagggagtgagttttccgggagtccctacagccaccctcagtattcctcgtacaacgactcctggaggttccccaacccggggctgcttggctccccctactattatagcgctgccgcccgaggagccgccccacctgcagccgccactgcctatgaccgtcactgacccttggagccaggcgggcaccaaacactgatggcacctattgagggtgacagccacccagccctcctgaagatagccagagagcccatgagaccgtcccccagcatcccccacttgcctgaagctcccctcttcctctcttcctccagggactctggggccctttggtggggccgttggacttctggatgcttgtctatttctaaaagccaatctatgagcttctcccgatggccactgggtctctgcaaaccaatagactgtcctgcaaataaccgcagccccagcccagcctgcctgtcctccagctgtctgactatccatccatcataaccaccccagcctgggaaggagagcttgcttttgttgcttcagcagcacccatgta

SEQ ID NO: 163340 - DNA, 1487 bp, Homo sapiens
  Payload ID: 12181
  Gene Symbol: PAX5
  Gene Name: paired box 5
  Uniprot ID: Q02548
  ENST ID: ENST00000377853
  CDS Start-End: 11-1099
aaaaatcaaaatggatttagagaaaaattatccgactcctcggaccagcaggacaggacatggaggagtgaatcagcttgggggggtttttgtgaatggacggccactcccggatgtagtccgccagaggatagtggaacttgctcatcaaggtgtcaggccctgcgacatctccaggcagcttcgggtcagccatggttgtgtcagcaaaattcttggcaggtattatgagacaggaagcatcaagcctggggtaattggaggatccaaaccaaaggtcgccacacccaaagtggtggaaaaaatcgctgaatataaacgccaaaatcccaccatgtttgcctgggagatcagggaccggctgctggcagagcgggtgtgtgacaatgacaccgtgcctagcgtcagttccatcaacaggatcatccggacaaaagtacagcagccacccaaccaaccagtcccagcttccagtcacagcatagtgtccactggctccgtgacgcaggtgtcctcggtgagcacggattcggccggctcgtcgtactccatcagcggcatcctgggcatcacgtcccccagcgccgacaccaacaagcgcaagagagacgaaggtattcaggagtctccggtgccgaacggccactcgcttccgggcagagacttcctccggaagcagatgcggggagacttgttcacacagcagcagctggaggtgctggaccgcgtgtttgagaggcagcactactcagacatcttcaccaccacagagcccatcaagcccgagcagaccacagagtattcagccatggcctcgctggctggtgggctggacgacatgaaggccaatctggccagccccacccctgctgacatcgggagcagtgtgccaggcccgcagtcctaccccattgtgacaggccgtgacttggcgagcacgaccctccccgggtaccctccacacgtcccccccgctggacagggcagctactcagcaccgacgctgacagggatggtgcctggctccccctactattatagcgctgccgcccgaggagccgccccacctgcagccgccactgcctatgaccgtcactgacccttggagccaggcgggcaccaaacactgatggcacctattgagggtgacagccacccagccctcctgaagatagccagagagcccatgagaccgtcccccagcatcccccacttgcctgaagctcccctcttcctctcttcctccagggactctggggccctttggtggggccgttggacttctggatgcttgtctatttctaaaagccaatctatgagcttctcccgatggccactgggtctctgcaaaccaatagactgtcctgcaaataaccgcagccccagcccagcctgcctgtcctccagctgtctgactatccatccatcataaccaccccagcctgggaaggagagcttgcttttgttgcttcagcagcacccatgta

SEQ ID NO: 163341 - DNA, 885 bp, Homo sapiens
  Payload ID: 12181
  Gene Symbol: PAX5
  Gene Name: paired box 5
  Uniprot ID: Q02548
  ENST ID: ENST00000446742
  CDS Start-End: 1-876
atggatttagagaaaaattatccgactcctcggaccagcaggacaggacatggaggagtgaatcagcttgggggggtttttgtgaatggacggccactcccggatgtagtccgccagaggatagtggaacttgctcatcaaggtgtcaggccctgcgacatctccaggcagcttcgggtcagccatggttgtgtcagcaaaattcttggcaggatcatccggacaaaagtacagcagccacccaaccaaccagtcccagcttccagtcacagcatagtgtccactggctccgtgacgcaggtgtcctcggtgagcacggattcggccggctcgtcgtactccatcagcggcatcctgggcatcacgtcccccagcgccgacaccaacaagcgcaagagagacgaaggtattcaggagtctccggtgccgaacggccactcgcttccgggcagagacttcctccggaagcagatgcggggagacttgttcacacagcagcagctggaggtgctggaccgcgtgtttgagaggcagcactactcagacatcttcaccaccacagagcccatcaagcccgagcagaccacagagtattcagccatggcctcgctggctggtgggctggacgacatgaaggccaatctggccagccccacccctgctgacatcgggagcagtgtgccaggcccgcagtcctaccccattgtgacagggagtgagttttccgggagtccctacagccaccctcagtattcctcgtacaacgactcctggaggttccccaacccggggctgcttggctccccctactattatagcgctgccgcccgaggagccgccccacctgcagccgccactgcctatgaccgtcactgacccttggag

SEQ ID NO: 163342 - DNA, 1056 bp, Homo sapiens
  Payload ID: 12181
  Gene Symbol: PAX5
  Gene Name: paired box 5
  Uniprot ID: Q02548
  ENST ID: ENST00000414447
  CDS Start-End: 1-1047
atggatttagagaaaaattatccgactcctcggaccagcaggacaggacatggaggagtgaatcagcttgggggggtttttgtgaatggacggccactcccggatgtagtccgccagaggatagtggaacttgctcatcaaggtgtcaggccctgcgacatctccaggcagcttcgggtcagccatggttgtgtcagcaaaattcttggcaggtattatgagacaggaagcatcaagcctggggtaattggaggatccaaaccaaaggtcgccacacccaaagtggtggaaaaaatcgctgaatataaacgccaaaatcccaccatgtttgcctgggagatcagggaccggctgctggcagagcgggtgtgtgacaatgacaccgtgcctagcgtcagttccatcaacaggatcatccggacaaaagtacagcagccacccaaccaaccagtcccagcttccagtcacagcataggtattcaggagtctccggtgccgaacggccactcgcttccgggcagagacttcctccggaagcagatgcggggagacttgttcacacagcagcagctggaggtgctggaccgcgtgtttgagaggcagcactactcagacatcttcaccaccacagagcccatcaagcccgagcagaccacagagtattcagccatggcctcgctggctggtgggctggacgacatgaaggccaatctggccagccccacccctgctgacatcgggagcagtgtgccaggcccgcagtcctaccccattgtgacaggccgtgacttggcgagcacgaccctccccgggtaccctccacacgtcccccccgctggacagggcagctactcagcaccgacgctgacagggatggtgcctgggagtgagttttccgggagtccctacagccaccctcagtattcctcgtacaacgactcctggaggttccccaacccggggctgcttggctccccctactattatagcgctgccgcccgaggagccgccccacctgcagccgccactgcctatgaccgtcactgacccttggag

SEQ ID NO: 163343 - DNA, 184 bp, Homo sapiens
  Payload ID: 12181
  Gene Symbol: PAX5
  Gene Name: paired box 5
  ENST ID: ENST00000522932
  CDS Start-End: 1-182
tgtcctcggtgagcacggattcggccggctcgtcgtactccatcagcggcatcctgggcatcacgtcccccagcgccgacaccaacaagcgcaagagagacgaaggctccccctactattatagcgctgccgcccgaggagccgccccacctgcagccgccactgcctatgaccgtcactgacc

SEQ ID NO: 163344 - DNA, 830 bp, Homo sapiens
  Payload ID: 12181
  Gene Symbol: PAX5
  Gene Name: paired box 5
  ENST ID: ENST00000523145
  CDS Start-End: 159-821
atggatttagagaaaaattatccgactcctcggaccagcaggacaggtattatgagacaggaagcatcaagcctggggtaattggaggatccaaaccaaaggtcgccacacccaaagtggtggaaaaaatcgctgaatataaacgccaaaatcccaccatgtttgcctgggagatcagggaccggctgctggcagagcgggtgtgtgacaatgacaccgtgcctagcgtcagttccatcaacaggatcatccggacaaaagtacagcagccacccaaccaaccagtcccagcttccagtcacagcatagtgtccactggctccgtgacgcaggtgtcctcggtgagcacggattcggccggctcgtcgtactccatcagcggcatcctgggcatcacgtcccccagcgccgacaccaacaagcgcaagagagacgaaggtattcaggagtctccggtgccgaacggccactcgcttccgggcagagacttcctccggaagcagatgcggggagacttgttcacacagcagcagctggaggtgctggaccgcgtgtttgagaggcagcactactcagacatcttcaccaccacagagcccatcaagcccgagcagaccacagagtattcagccatggcctcgctggctggtgggctggacgacatgaaggccaatctggccagccccacccctgctgacatcgggagcagtgtgccaggcccgcagtcctaccccattgtgacaggctccccctactattatagcgctgccgcccgaggagccgccccacctgcagccgccactgcctatgaccgtcactgacccttggag

SEQ ID NO: 163345 - DNA, 1255 bp, Homo sapiens
  Payload ID: 12181
  Gene Symbol: PAX5
  Gene Name: paired box 5
  ENST ID: ENST00000520154
  CDS Start-End: 11-898
aaaaatcaaaatggatttagagaaaaattatccgactcctcggaccagcaggacaggacatggaggagtgaatcagcttgggggggtttttgtgaatggacggccactcccggatgtagtccgccagaggatagtggaacttgctcatcaaggtgtcaggccctgcgacatctccaggcagcttcgggtcagccatggttgtgtcagcaaaattcttggcaggtattatgagacaggaagcatcaagcctggggtaattggaggatccaaaccaaaggtcgccacacccaaagtggtggaaaaaatcgctgaatataaacgccaaaatcccaccatgtttgcctgggagatcagggaccggctgctggcagagcgggtgtgtgacaatgacaccgtgcctagcgtcagttccatcaacaggatcatccggacaaaagtacagcagccacccaaccaaccagtcccagcttccagtcacagcatagtgtccactggctccgtgacgcaggtgtcctcggtgagcacggattcggccggctcgtcgtactccatcagcggcatcctgggcatcacgtcccccagcgccgacaccaacaagcgcaagagagacgaaggtattcaggagtctccggtgccgaacggccactcgcttccgggcagagacttcctccggaagcagatgcggggagacttgttcacacagcagcagctggaggtgctggaccgcgtgtttgagaggcagcactactcagacatcttcaccaccacagagcccatcaagcccgagcaggctccccctactattatagcgctgccgcccgaggagccgccccacctgcagccgccactgcctatgaccgtcactgacccttggagccaggcgggcaccaaacactgatggcacctattgagggtgacagccacccagccctcctgaagatagccagagagcccatgagaccgtcccccagcatcccccacttgcctgaagctcccctcttcctctcttcctccagggactctggggccctttggtggggccgttggacttctggatgcttgtctatttctaaaagccaatctatgagcttctcccgatggccactgggtctctgcaaaccaatagactgtcctgcaaataaccgcagccccagcccagcctgcctgtcctccagctgtctgactatccatccatcataaccaccccagcctgggaaggagagcttgcttttgttgcttcagcagcacccatgta

SEQ ID NO: 163346 - DNA, 1019 bp, Homo sapiens
  Payload ID: 12181
  Gene Symbol: PAX5
  Gene Name: paired box 5
  ENST ID: ENST00000522003
  CDS Start-End: 159-1010
atggatttagagaaaaattatccgactcctcggaccagcaggacaggtattatgagacaggaagcatcaagcctggggtaattggaggatccaaaccaaaggtcgccacacccaaagtggtggaaaaaatcgctgaatataaacgccaaaatcccaccatgtttgcctgggagatcagggaccggctgctggcagagcgggtgtgtgacaatgacaccgtgcctagcgtcagttccatcaacaggatcatccggacaaaagtacagcagccacccaaccaaccagtcccagcttccagtcacagcatagtgtccactggctccgtgacgcaggtgtcctcggtgagcacggattcggccggctcgtcgtactccatcagcggcatcctgggcatcacgtcccccagcgccgacaccaacaagcgcaagagagacgaaggtattcaggagtctccggtgccgaacggccactcgcttccgggcagagacttcctccggaagcagatgcggggagacttgttcacacagcagcagctggaggtgctggaccgcgtgtttgagaggcagcactactcagacatcttcaccaccacagagcccatcaagcccgagcagaccacagagtattcagccatggcctcgctggctggtgggctggacgacatgaaggccaatctggccagccccacccctgctgacatcgggagcagtgtgccaggcccgcagtcctaccccattgtgacaggccgtgacttggcgagcacgaccctccccgggtaccctccacacgtcccccccgctggacagggcagctactcagcaccgacgctgacagggatggtgcctgggagtgagttttccgggagtccctacagccaccctcagtattcctcgtacaacgactcctggaggttccccaacccggggctgcttggctccccctactattatagcgctgccgcccgaggagccgccccacctgcagccgccactgcctatgaccgtcactgacccttggag

SEQ ID NO: 163347 - DNA, 659 bp, Homo sapiens
  Payload ID: 12181
  Gene Symbol: PAX5
  Gene Name: paired box 5
  ENST ID: ENST00000524340
  CDS Start-End: 1-657
gacaccaacaagcgcaagagagacgaaggtattcaggagtctccggtgccgaacggccactcgcttccgggcagagacttcctccggaagcagatgcggggagacttgttcacacagcagcagctggaggtgctggaccgcgtgtttgagaggcagcactactcagacatcttcaccaccacagagcccatcaagcccgagcagtggtgccccgtgctgatgagacaatacttggtgcagccccaggcagtccttttccagaccacagagtattcagccatggcctcgctggctggtgggctggacgacatgaaggccaatctggccagccccacccctgctgacatcgggagcagtgtgccaggcccgcagtcctaccccattgtgacaggccgtgacttggcgagcacgaccctccccgggtaccctccacacgtcccccccgctggacagggcagctactcagcaccgacgctgacagggatggtgcctgggagtgagttttccgggagtccctacagccaccctcagtattcctcgtacaacgactcctggaggttccccaacccggggctgcttggctccccctactattatagcgctgccgcccgaggagccgccccacctgcagccgccactgcctatgaccgtcactgacc

SEQ ID NO: 163348 - DNA, 1342 bp, Homo sapiens
  Payload ID: 12181
  Gene Symbol: PAX5
  Gene Name: paired box 5
  ENST ID: ENST00000523241
  CDS Start-End: 11-985
aaaaatcaaaatggatttagagaaaaattatccgactcctcggaccagcaggacaggacatggaggagtgaatcagcttgggggggtttttgtgaatggacggccactcccggatgtagtccgccagaggatagtggaacttgctcatcaaggtgtcaggccctgcgacatctccaggcagcttcgggtcagccatggttgtgtcagcaaaattcttggcaggtattatgagacaggaagcatcaagcctggggtaattggaggatccaaaccaaaggtcgccacacccaaagtggtggaaaaaatcgctgaatataaacgccaaaatcccaccatgtttgcctgggagatcagggaccggctgctggcagagcgggtgtgtgacaatgacaccgtgcctagcgtcagttccatcaacaggatcatccggacaaaagtacagcagccacccaaccaaccagtcccagcttccagtcacagcatagtgtccactggctccgtgacgcaggtgtcctcggtgagcacggattcggccggctcgtcgtactccatcagcggcatcctgggcatcacgtcccccagcgccgacaccaacaagcgcaagagagacgaaggtattcaggagtctccggtgccgaacggccactcgcttccgggcagagacttcctccggaagcagatgcggggagacttgttcacacagcagcagctggaggtgctggaccgcgtgtttgagaggcagcactactcagacatcttcaccaccacagagcccatcaagcccgagcagggagtgagttttccgggagtccctacagccaccctcagtattcctcgtacaacgactcctggaggttccccaacccggggctgcttggctccccctactattatagcgctgccgcccgaggagccgccccacctgcagccgccactgcctatgaccgtcactgacccttggagccaggcgggcaccaaacactgatggcacctattgagggtgacagccacccagccctcctgaagatagccagagagcccatgagaccgtcccccagcatcccccacttgcctgaagctcccctcttcctctcttcctccagggactctggggccctttggtggggccgttggacttctggatgcttgtctatttctaaaagccaatctatgagcttctcccgatggccactgggtctctgcaaaccaatagactgtcctgcaaataaccgcagccccagcccagcctgcctgtcctccagctgtctgactatccatccatcataaccaccccagcctgggaaggagagcttgcttttgttgcttcagcagcacccatgta

SEQ ID NO: 163349 - DNA, 969 bp, Homo sapiens
  Payload ID: 12181
  Gene Symbol: PAX5
  Gene Name: paired box 5
  Uniprot ID: Q02548
  ENST ID: ENST00000520281
  CDS Start-End: 1-960
atggatttagagaaaaattatccgactcctcggaccagcaggacaggacatggaggagtgaatcagcttgggggggtttttgtgaatggacggccactcccggatgtagtccgccagaggatagtggaacttgctcatcaaggtgtcaggccctgcgacatctccaggcagcttcgggtcagccatggttgtgtcagcaaaattcttggcaggtattatgagacaggaagcatcaagcctggggtaattggaggatccaaaccaaaggtcgccacacccaaagtggtggaaaaaatcgctgaatataaacgccaaaatcccaccatgtttgcctgggagatcagggaccggctgctggcagagcgggtgtgtgacaatgacaccgtgcctagcgtcagttccatcaacaggatcatccggacaaaagtacagcagccacccaaccaaccagtcccagcttccagtcacagcataggtattcaggagtctccggtgccgaacggccactcgcttccgggcagagacttcctccggaagcagatgcggggagacttgttcacacagcagcagctggaggtgctggaccgcgtgtttgagaggcagcactactcagacatcttcaccaccacagagcccatcaagcccgagcagaccacagagtattcagccatggcctcgctggctggtgggctggacgacatgaaggccaatctggccagccccacccctgctgacatcgggagcagtgtgccaggcccgcagtcctaccccattgtgacaggccgtgacttggcgagcacgaccctccccgggtaccctccacacgtcccccccgctggacagggcagctactcagcaccgacgctgacagggatggtgcctggctccccctactattatagcgctgccgcccgaggagccgccccacctgcagccgccactgcctatgaccgtcactgacccttggag

SEQ ID NO: 163350 - DNA, 1112 bp, Homo sapiens
  Payload ID: 12181
  Gene Symbol: PAX5
  Gene Name: paired box 5
  Uniprot ID: Q02548
  ENST ID: ENST00000523493
  CDS Start-End: 1-924
atggatttagagaaaaattatccgactcctcggaccagcaggacaggacatggaggagtgaatcagcttgggggggtttttgtgaatggacggccactcccggatgtagtccgccagaggatagtggaacttgctcatcaaggtgtcaggccctgcgacatctccaggcagcttcgggtcagccatggttgtgtcagcaaaattcttggcaggtattatgagacaggaagcatcaagcctggggtaattggaggatccaaaccaaaggtcgccacacccaaagtggtggaaaaaatcgctgaatataaacgccaaaatcccaccatgtttgcctgggagatcagggaccggctgctggcagagcgggtgtgtgacaatgacaccgtgcctagcgtcagttccatcaacaggatcatccggacaaaagtacagcagccacccaaccaaccagtcccagcttccagtcacagcatagtgtccactggctccgtgacgcaggtgtcctcggtgagcacggattcggccggctcgtcgtactccatcagcggcatcctgggcatcacgtcccccagcgccgacaccaacaagcgcaagagagacgaaggtattcaggagtctccggtgccgaacggccactcgcttccgggcagagacttcctccggaagcagatgcggggagacttgttcacacagcagcagctggaggtgctggaccgcgtgtttgagaggcagcactactcagacatcttcaccaccacagagcccatcaagcccgagcagtggtgccccgtgctgatgagacaatacttggtgcagccccaggcagtccttttccaggccgtgacttggcgagcacgaccctccccgggtaccctccacacgtcccccccgctggacagggcagctactcagcaccgacgctgacagggatggtgcctgggagtgagttttccgggagtccctacagccaccctcagtattcctcgtacaacgactcctggaggttccccaacccggggctgcttggctccccctactattatagcgctgccgcccgaggagccgccccacctgcagccgccactgcctatgaccgtcactgacccttggag

SEQ ID NO: 163351 - DNA, 1631 bp, Homo sapiens
  Payload ID: 12182
  Gene Symbol: PAX6
  Gene Name: paired box 6
  Uniprot ID: P26367
  ENST ID: ENST00000241001
  CDS Start-End: 342-1610
gttttgctggaggatgatgacagaggaatctgagaattgctctcacacaccaacccagcaacatccgtggagaaaactctcaccagcaactcctttaaaacaccgtcatttcaaaccattgtggtcttcaagcaacaacagcagcacaaaaaaccccaaccaaacaaaactcttgacagaagctgtgacaaccagaaaggatgcctcataaagggggaagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggccgtgcgacatttcccgaattctgcaggtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagcgtgtcatcaataaacagagttcttcgcaacctggctagcgaaaagcaacagatgggcgcagacggcatgtatgataaactaaggatgttgaacgggcagaccggaagctggggcacccgccctggttggtatccggggacttcggtgccagggcaacctacgcaagatggctgccagcaacaggaaggagggggagagaataccaactccatcagttccaacggagaagattcagatgaggctcaaatgcgacttcagctgaagcggaagctgcaaagaaatagaacatcctttacccaagagcaaattgaggccctggagaaagagtttgagagaacccattatccagatgtgtttgcccgagaaagactagcagccaaaatagatctacctgaagcaagaatacaggtatggttttctaatcgaagggccaaatggagaagagaagaaaaactgaggaatcagagaagacaggccagcaacacacctagtcatattcctatcagcagtagtttcagcaccagtgtctaccaaccaattccacaacccaccacaccggtttcctccttcacatctggctccatgttgggccgaacagacacagccctcacaaacacctacagcgctctgccgcctatgcccagcttcaccatggcaaataacctgcctatgcaacccccagtccccagccagacctcctcatactcctgcatgctgcccaccagcccttcggtgaatgggcggagttatgatacctacacccccccacatatgcagacacacatgaacagtcagccaatgggcacctcgggcaccacttcaacaggactcatttcccctggtgtgtcagttccagttcaagttcccggaagtgaacctgatatgtctcaatactggccaagattacagtaaaaaaaaaaaaaaaaaaaaaaa

SEQ ID NO: 163352 - DNA, 2591 bp, Homo sapiens
  Payload ID: 12182
  Gene Symbol: PAX6
  Gene Name: paired box 6
  Uniprot ID: P26367
  ENST ID: ENST00000379107
  CDS Start-End: 529-1839
cgcccgcccgccggccctcgggctttgtgccgcactgggctccggcgcagaagagtcagccggcactcgagcgccgaggggggcaccgcgcccgccaccagcccgagtggagtcagtcggcaaggcagccgcacgctggaggtagagggaagagcgagctagcgcgagccgggaaggaagccaccaggccaaggcggtggaacgcgcgctccgagggagctcagagccgagcgggaggactgtcagcttccacccagcccccgggctcttgcccccaactccactggagcgctgagctcggaacttgaaaactctctgctccccaggcttcccccgactctcatctcccttgccttgcggaggctggggctcttccctgttctccggccccctgcgcttgggggaagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggccgtgcgacatttcccgaattctgcagacccatgcagatgcaaaagtccaagtgctggacaatcaaaacgtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagcgtgtcatcaataaacagagttcttcgcaacctggctagcgaaaagcaacagatgggcgcagacggcatgtatgataaactaaggatgttgaacgggcagaccggaagctggggcacccgccctggttggtatccggggacttcggtgccagggcaacctacgcaagatggctgccagcaacaggaaggagggggagagaataccaactccatcagttccaacggagaagattcagatgaggctcaaatgcgacttcagctgaagcggaagctgcaaagaaatagaacatcctttacccaagagcaaattgaggccctggagaaagagtttgagagaacccattatccagatgtgtttgcccgagaaagactagcagccaaaatagatctacctgaagcaagaatacaggtatggttttctaatcgaagggccaaatggagaagagaagaaaaactgaggaatcagagaagacaggccagcaacacacctagtcatattcctatcagcagtagtttcagcaccagtgtctaccaaccaattccacaacccaccacaccggtttcctccttcacatctggctccatgttgggccgaacagacacagccctcacaaacacctacagcgctctgccgcctatgcccagcttcaccatggcaaataacctgcctatgcaacccccagtccccagccagacctcctcatactcctgcatgctgcccaccagcccttcggtgaatgggcggagttatgatacctacacccccccacatatgcagacacacatgaacagtcagccaatgggcacctcgggcaccacttcaacaggactcatttcccctggtgtgtcagttccagttcaagttcccggaagtgaacctgatatgtctcaatactggccaagattacagtaaaaaaaaaaaaaaaaaaaaaaaggaaaggaaatattgtgttaattcagtcagtgactatggggacacaacagttgagctttcaggaaagaaagaaaaatggctgttagagccgcttcagttctacaattgtgtcctgtattgtaccactggggaaggaatggacttgaaacaaggacctttgtatacagaaggcacgatatcagttggaacaaatcttcattttggtatccaaacttttattcattttggtgtattatttgtaaatgggcatttgtatgttataatgaaaaaaagaacaatgtagactggatggatgtttgatctgtgttggtcatgaagttgttttttttttttttaaaaagaaaaccatgatcaacaagctttgccacgaatttaagagttttatcaagatatatcgaatacttctacccatctgttcatagtttatggactgatgttccaagtttgtatcattcctttgcatataattaaacctggaacaacatgcactagatttatgtcagaaatatctgttggttttccaaaggttgttaacagatgaagtttatgtgcaaaaaagggtaagatataaattcaaggaagaaaaaaagttgatagctaaaaggtagagtgtgtcttcgatataatccaatttgttttatgtcaaaatgtaagtatttgtcttccctagaaatcctcagaatgatttctataataaagttaatttcatttatatttgacaagaatataga

SEQ ID NO: 163353 - DNA, 2157 bp, Homo sapiens
  Payload ID: 12182
  Gene Symbol: PAX6
  Gene Name: paired box 6
  Uniprot ID: P26367
  ENST ID: ENST00000379109
  CDS Start-End: 891-2157
ctacttccagcgaaagcccgcgtcggagggcgactgccggcgagcgggagcggcgcagggctcggggcgggcggccagctcagccccagcgccagcgccagcgccagcgcgggctgagctcgcgggaagaagggagactccaggcgcgacagcagccgcggctcctagccccagcgtcgcccaatgctcccgacccgcgggaaaagacgaagaggctctgtggtgcccaaggccctggaacggccgcagagagcaaccgctgccggctgctttgtccagcccgaggcccagcgaacgcgcagagagcgggcgctccgaggactcgccgagggagcgccgagggaacctgctcgccgcgtctccgcccgcccgccggccctcgggctttgtgccgcactgggctccggcgcagaagagtcagccggcactcgagcgccgaggggggcaccgcgcccgccaccagcccgagtggagtcagtcggcaaggcagccgcacgctggaggtagagggaagagcgagctagcgcgagccgggaaggaagccaccaggccaaggcggtggaacgcgcgctccgagggagctcagagccgagcgggaggactgtcagcttccacccagcccccgggctcttgcccccaactccactggagcgctgagctcggaacttgaaaactctctgctccccaggcttcccccgactctcatctcccttgccttgcggaggctggggctcttccctgttctccggccccctgcgcttgggggaagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggccgtgcgacatttcccgaattctgcaggtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagcgtgtcatcaataaacagagttcttcgcaacctggctagcgaaaagcaacagatgggcgcagacggcatgtatgataaactaaggatgttgaacgggcagaccggaagctggggcacccgccctggttggtatccggggacttcggtgccagggcaacctacgcaagatggctgccagcaacaggaaggagggggagagaataccaactccatcagttccaacggagaagattcagatgaggctcaaatgcgacttcagctgaagcggaagctgcaaagaaatagaacatcctttacccaagagcaaattgaggccctggagaaagagtttgagagaacccattatccagatgtgtttgcccgagaaagactagcagccaaaatagatctacctgaagcaagaatacaggtatggttttctaatcgaagggccaaatggagaagagaagaaaaactgaggaatcagagaagacaggccagcaacacacctagtcatattcctatcagcagtagtttcagcaccagtgtctaccaaccaattccacaacccaccacaccggtttcctccttcacatctggctccatgttgggccgaacagacacagccctcacaaacacctacagcgctctgccgcctatgcccagcttcaccatggcaaataacctgcctatgcaacccccagtccccagccagacctcctcatactcctgcatgctgcccaccagcccttcggtgaatgggcggagttatgatacctacacccccccacatatgcagacacacatgaacagtcagccaatgggcacctcgggcaccacttcaacaggactcatttcccctggtgtgtcagttccagttcaagttcccggaagtgaacctgatatgtctcaatactggccaagattacagt

SEQ ID NO: 163354 - DNA, 1627 bp, Homo sapiens
  Payload ID: 12182
  Gene Symbol: PAX6
  Gene Name: paired box 6
  Uniprot ID: P26367
  ENST ID: ENST00000379111
  CDS Start-End: 347-1615
ttttattgtcaatctctgtctccttcccaggaatctgagaattgctctcacacaccaacccagcaacatccgtggagaaaactctcaccagcaactcctttaaaacaccgtcatttcaaaccattgtggtcttcaagcaacaacagcagcacaaaaaaccccaaccaaacaaaactcttgacagaagctgtgacaaccagaaaggatgcctcataaagggggaagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggccgtgcgacatttcccgaattctgcaggtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagcgtgtcatcaataaacagagttcttcgcaacctggctagcgaaaagcaacagatgggcgcagacggcatgtatgataaactaaggatgttgaacgggcagaccggaagctggggcacccgccctggttggtatccggggacttcggtgccagggcaacctacgcaagatggctgccagcaacaggaaggagggggagagaataccaactccatcagttccaacggagaagattcagatgaggctcaaatgcgacttcagctgaagcggaagctgcaaagaaatagaacatcctttacccaagagcaaattgaggccctggagaaagagtttgagagaacccattatccagatgtgtttgcccgagaaagactagcagccaaaatagatctacctgaagcaagaatacaggtatggttttctaatcgaagggccaaatggagaagagaagaaaaactgaggaatcagagaagacaggccagcaacacacctagtcatattcctatcagcagtagtttcagcaccagtgtctaccaaccaattccacaacccaccacaccggtttcctccttcacatctggctccatgttgggccgaacagacacagccctcacaaacacctacagcgctctgccgcctatgcccagcttcaccatggcaaataacctgcctatgcaacccccagtccccagccagacctcctcatactcctgcatgctgcccaccagcccttcggtgaatgggcggagttatgatacctacacccccccacatatgcagacacacatgaacagtcagccaatgggcacctcgggcaccacttcaacaggactcatttcccctggtgtgtcagttccagttcaagttcccggaagtgaacctgatatgtctcaatactggccaagattacagtaaaaaaaaaaaaaa

SEQ ID NO: 163355 - DNA, 1763 bp, Homo sapiens
  Payload ID: 12182
  Gene Symbol: PAX6
  Gene Name: paired box 6
  Uniprot ID: P26367
  ENST ID: ENST00000379115
  CDS Start-End: 436-1746
ggtgcatttgcatgttgcggagtgattagtgggtttgaaaagggaaccgtggctcggcctcatttcccgctctggttcaggcgcaggaggaagtgttttgctggaggatgatgacagaggaatctgagaattgctctcacacaccaacccagcaacatccgtggagaaaactctcaccagcaactcctttaaaacaccgtcatttcaaaccattgtggtcttcaagcaacaacagcagcacaaaaaaccccaaccaaacaaaactcttgacagaagctgtgacaaccagaaaggatgcctcataaagggggaagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggccgtgcgacatttcccgaattctgcagacccatgcagatgcaaaagtccaagtgctggacaatcaaaacgtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagcgtgtcatcaataaacagagttcttcgcaacctggctagcgaaaagcaacagatgggcgcagacggcatgtatgataaactaaggatgttgaacgggcagaccggaagctggggcacccgccctggttggtatccggggacttcggtgccagggcaacctacgcaagatggctgccagcaacaggaaggagggggagagaataccaactccatcagttccaacggagaagattcagatgaggctcaaatgcgacttcagctgaagcggaagctgcaaagaaatagaacatcctttacccaagagcaaattgaggccctggagaaagagtttgagagaacccattatccagatgtgtttgcccgagaaagactagcagccaaaatagatctacctgaagcaagaatacaggtatggttttctaatcgaagggccaaatggagaagagaagaaaaactgaggaatcagagaagacaggccagcaacacacctagtcatattcctatcagcagtagtttcagcaccagtgtctaccaaccaattccacaacccaccacaccggtttcctccttcacatctggctccatgttgggccgaacagacacagccctcacaaacacctacagcgctctgccgcctatgcccagcttcaccatggcaaataacctgcctatgcaacccccagtccccagccagacctcctcatactcctgcatgctgcccaccagcccttcggtgaatgggcggagttatgatacctacacccccccacatatgcagacacacatgaacagtcagccaatgggcacctcgggcaccacttcaacaggactcatttcccctggtgtgtcagttccagttcaagttcccggaagtgaacctgatatgtctcaatactggccaagattacagtaaaaaaaaaaaaaaaaaaa

SEQ ID NO: 163356 - DNA, 2160 bp, Homo sapiens
  Payload ID: 12182
  Gene Symbol: PAX6
  Gene Name: paired box 6
  Uniprot ID: P26367
  ENST ID: ENST00000379123
  CDS Start-End: 880-2148
tgcaccctccgaggactgggagtcccgagtccagcttagggggagtgggggcgcgacccccaacccagaaaccttcacttgaccgctcaagttcgcggcagcagggcgggccgcgccgaatctcggcgtgcgcggagcggggagatgcaggcgagcgccagagcccgggctcgggggccctgcgccggggagaggagccgggacccaccggcggagccgaaaacaagtgtattcatattcaaacaaacggaccaattgcaccaggcggggagagggagcatccaatcggctggcgcgaggccccggcgctgctttgcataaagcaatattttgtgtgagagcgagcggtgcatttgcatgttgcggagtgattagtgggtttgaaaagggaaccgtggctcggcctcatttcccgctctggttcaggcgcaggaggaagtgttttgctggaggatgatgacagaggtcaggcttcgctaatgggccagtgaggagcggtggaggcgaggccgggcgccggcacacacacattaacacacttgagccatcaccaatcagcataggaatctgagaattgctctcacacaccaacccagcaacatccgtggagaaaactctcaccagcaactcctttaaaacaccgtcatttcaaaccattgtggtcttcaagcaacaacagcagcacaaaaaaccccaaccaaacaaaactcttgacagaagctgtgacaaccagaaaggatgcctcataaagggggaagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggccgtgcgacatttcccgaattctgcaggtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagcgtgtcatcaataaacagagttcttcgcaacctggctagcgaaaagcaacagatgggcgcagacggcatgtatgataaactaaggatgttgaacgggcagaccggaagctggggcacccgccctggttggtatccggggacttcggtgccagggcaacctacgcaagatggctgccagcaacaggaaggagggggagagaataccaactccatcagttccaacggagaagattcagatgaggctcaaatgcgacttcagctgaagcggaagctgcaaagaaatagaacatcctttacccaagagcaaattgaggccctggagaaagagtttgagagaacccattatccagatgtgtttgcccgagaaagactagcagccaaaatagatctacctgaagcaagaatacaggtatggttttctaatcgaagggccaaatggagaagagaagaaaaactgaggaatcagagaagacaggccagcaacacacctagtcatattcctatcagcagtagtttcagcaccagtgtctaccaaccaattccacaacccaccacaccggtttcctccttcacatctggctccatgttgggccgaacagacacagccctcacaaacacctacagcgctctgccgcctatgcccagcttcaccatggcaaataacctgcctatgcaacccccagtccccagccagacctcctcatactcctgcatgctgcccaccagcccttcggtgaatgggcggagttatgatacctacacccccccacatatgcagacacacatgaacagtcagccaatgggcacctcgggcaccacttcaacaggactcatttcccctggtgtgtcagttccagttcaagttcccggaagtgaacctgatatgtctcaatactggccaagattacagtaaaaaaaaaaaaaa

SEQ ID NO: 163357 - DNA, 2616 bp, Homo sapiens
  Payload ID: 12182
  Gene Symbol: PAX6
  Gene Name: paired box 6
  Uniprot ID: P26367
  ENST ID: ENST00000379129
  CDS Start-End: 282-1592
accctcttttcttatcattgacatttaaactctggggcaggtcctcgcgtagaacgcggctgtcagatctgccacttcccctgccgagcggcggtgagaagtgtgggaaccggcgctgccaggctcacctgcctccccgccctccgctcccagggggaagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggccgtgcgacatttcccgaattctgcagacccatgcagatgcaaaagtccaagtgctggacaatcaaaacgtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagcgtgtcatcaataaacagagttcttcgcaacctggctagcgaaaagcaacagatgggcgcagacggcatgtatgataaactaaggatgttgaacgggcagaccggaagctggggcacccgccctggttggtatccggggacttcggtgccagggcaacctacgcaagatggctgccagcaacaggaaggagggggagagaataccaactccatcagttccaacggagaagattcagatgaggctcaaatgcgacttcagctgaagcggaagctgcaaagaaatagaacatcctttacccaagagcaaattgaggccctggagaaagagtttgagagaacccattatccagatgtgtttgcccgagaaagactagcagccaaaatagatctacctgaagcaagaatacaggtatggttttctaatcgaagggccaaatggagaagagaagaaaaactgaggaatcagagaagacaggccagcaacacacctagtcatattcctatcagcagtagtttcagcaccagtgtctaccaaccaattccacaacccaccacaccggtttcctccttcacatctggctccatgttgggccgaacagacacagccctcacaaacacctacagcgctctgccgcctatgcccagcttcaccatggcaaataacctgcctatgcaacccccagtccccagccagacctcctcatactcctgcatgctgcccaccagcccttcggtgaatgggcggagttatgatacctacacccccccacatatgcagacacacatgaacagtcagccaatgggcacctcgggcaccacttcaacaggactcatttcccctggtgtgtcagttccagttcaagttcccggaagtgaacctgatatgtctcaatactggccaagattacagtaaaaaaaaaaaaaaaaaaaaaaaggaaaggaaatattgtgttaattcagtcagtgactatggggacacaacagttgagctttcaggaaagaaagaaaaatggctgttagagccgcttcagttctacaattgtgtcctgtattgtaccactggggaaggaatggacttgaaacaaggacctttgtatacagaaggcacgatatcagttggaacaaatcttcattttggtatccaaacttttattcattttggtgtattatttgtaaatgggcatttgtatgttataatgaaaaaaagaacaatgtagactggatggatgtttgatctgtgttggtcatgaagttgttttttttttttttaaaaagaaaaccatgatcaacaagctttgccacgaatttaagagttttatcaagatatatcgaatacttctacccatctgttcatagtttatggactgatgttccaagtttgtatcattcctttgcatataattaaacctggaacaacatgcactagatttatgtcagaaatatctgttggttttccaaaggttgttaacagatgaagtttatgtgcaaaaaagggtaagatataaattcaaggaagaaaaaaagttgatagctaaaaggtagagtgtgtcttcgatataatccaatttgttttatgtcaaaatgtaagtatttgtcttccctagaaatcctcagaatgatttctataataaagttaatttcatttatatttgacaagaatatagatgttttatacacattttcatgcaatcatacgtttcttttttggccagcaaaagttaattgttcttagatatagttgtattactgttcacggtccaatcattttgtgcatctagagttcattcctaatcaattaaaagtgcttgcaagagttttaaacttaagtgttttgaagttgttcacaactacatatcaaaattaaccattgttgattgtaaaaaaccatgccaaagcctttgtatttcctttattatacagttttctttttaacctta

SEQ ID NO: 163358 - DNA, 2574 bp, Homo sapiens
  Payload ID: 12182
  Gene Symbol: PAX6
  Gene Name: paired box 6
  Uniprot ID: P26367
  ENST ID: ENST00000379132
  CDS Start-End: 282-1550
accctcttttcttatcattgacatttaaactctggggcaggtcctcgcgtagaacgcggctgtcagatctgccacttcccctgccgagcggcggtgagaagtgtgggaaccggcgctgccaggctcacctgcctccccgccctccgctcccagggggaagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggccgtgcgacatttcccgaattctgcaggtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagcgtgtcatcaataaacagagttcttcgcaacctggctagcgaaaagcaacagatgggcgcagacggcatgtatgataaactaaggatgttgaacgggcagaccggaagctggggcacccgccctggttggtatccggggacttcggtgccagggcaacctacgcaagatggctgccagcaacaggaaggagggggagagaataccaactccatcagttccaacggagaagattcagatgaggctcaaatgcgacttcagctgaagcggaagctgcaaagaaatagaacatcctttacccaagagcaaattgaggccctggagaaagagtttgagagaacccattatccagatgtgtttgcccgagaaagactagcagccaaaatagatctacctgaagcaagaatacaggtatggttttctaatcgaagggccaaatggagaagagaagaaaaactgaggaatcagagaagacaggccagcaacacacctagtcatattcctatcagcagtagtttcagcaccagtgtctaccaaccaattccacaacccaccacaccggtttcctccttcacatctggctccatgttgggccgaacagacacagccctcacaaacacctacagcgctctgccgcctatgcccagcttcaccatggcaaataacctgcctatgcaacccccagtccccagccagacctcctcatactcctgcatgctgcccaccagcccttcggtgaatgggcggagttatgatacctacacccccccacatatgcagacacacatgaacagtcagccaatgggcacctcgggcaccacttcaacaggactcatttcccctggtgtgtcagttccagttcaagttcccggaagtgaacctgatatgtctcaatactggccaagattacagtaaaaaaaaaaaaaaaaaaaaaaaggaaaggaaatattgtgttaattcagtcagtgactatggggacacaacagttgagctttcaggaaagaaagaaaaatggctgttagagccgcttcagttctacaattgtgtcctgtattgtaccactggggaaggaatggacttgaaacaaggacctttgtatacagaaggcacgatatcagttggaacaaatcttcattttggtatccaaacttttattcattttggtgtattatttgtaaatgggcatttgtatgttataatgaaaaaaagaacaatgtagactggatggatgtttgatctgtgttggtcatgaagttgttttttttttttttaaaaagaaaaccatgatcaacaagctttgccacgaatttaagagttttatcaagatatatcgaatacttctacccatctgttcatagtttatggactgatgttccaagtttgtatcattcctttgcatataattaaacctggaacaacatgcactagatttatgtcagaaatatctgttggttttccaaaggttgttaacagatgaagtttatgtgcaaaaaagggtaagatataaattcaaggaagaaaaaaagttgatagctaaaaggtagagtgtgtcttcgatataatccaatttgttttatgtcaaaatgtaagtatttgtcttccctagaaatcctcagaatgatttctataataaagttaatttcatttatatttgacaagaatatagatgttttatacacattttcatgcaatcatacgtttcttttttggccagcaaaagttaattgttcttagatatagttgtattactgttcacggtccaatcattttgtgcatctagagttcattcctaatcaattaaaagtgcttgcaagagttttaaacttaagtgttttgaagttgttcacaactacatatcaaaattaaccattgttgattgtaaaaaaccatgccaaagcctttgtatttcctttattatacagttttctttttaacctta

SEQ ID NO: 163359 - DNA, 567 bp, Homo sapiens
  Payload ID: 12182
  Gene Symbol: PAX6
  Gene Name: paired box 6
  ENST ID: ENST00000423822
  CDS Start-End: 383-567
gcggcggtgagaagtgtgggaaccggcgctgccaggctcacctgcctccccgccctccgctcccaggaatctgagaattgctctcacacaccaacccagcaacatccgtggagaaaactctcaccagcaactcctttaaaacaccgtcatttcaaaccattgtggtcttcaagcaacaacagcagcacaaaaaaccccaaccaaacaaaactcttgacagaagctgtgacaaccagaaaggatgcctcataaagggggaagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggccgtgcgacatttcccgaattctgcagacccatgcagatgcaaaagtccaagtgctggacaatcaaaacgt

SEQ ID NO: 163360 - DNA, 497 bp, Homo sapiens
  Payload ID: 12182
  Gene Symbol: PAX6
  Gene Name: paired box 6
  ENST ID: ENST00000455099
  CDS Start-End: 125-497
aagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggccgtgcgacatttcccgaattctgcagacccatgcagatgcaaaagtccaagtgctggacaatcaaaacgtgtccaacggatgtgtgtcatcaataaacagagttcttcgcaacctggctagcgaaaagcaacagatgggcgcagacggcatgtatgataaactaaggatgttgaacgggcagaccggaagctggggcacccgccctggttggtatccggggacttcggtgccagggcaacctacgcaagatggctgcc

SEQ ID NO: 163361 - DNA, 6922 bp, Homo sapiens
  Payload ID: 12182
  Gene Symbol: PAX6
  Gene Name: paired box 6
  Uniprot ID: P26367
  ENST ID: ENST00000419022
  CDS Start-End: 470-1780
accctcttttcttatcattgacatttaaactctggggcaggtcctcgcgtagaacgcggctgtcagatctgccacttcccctgccgagcggcggtgagaagtgtgggaaccggcgctgccaggctcacctgcctccccgccctccgctcccaggaatctgagaattgctctcacacaccaacccagcaacatccgtggagaaaactctcaccagcaactcctttaaaacaccgtcatttcaaaccattgtggtcttcaagcaacaacagcagcacaaaaaaccccaaccaaacaaaactcttgacagaagctgtgacaaccagaaaggatgcctcataaagggggaagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggccgtgcgacatttcccgaattctgcagacccatgcagatgcaaaagtccaagtgctggacaatcaaaacgtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagcgtgtcatcaataaacagagttcttcgcaacctggctagcgaaaagcaacagatgggcgcagacggcatgtatgataaactaaggatgttgaacgggcagaccggaagctggggcacccgccctggttggtatccggggacttcggtgccagggcaacctacgcaagatggctgccagcaacaggaaggagggggagagaataccaactccatcagttccaacggagaagattcagatgaggctcaaatgcgacttcagctgaagcggaagctgcaaagaaatagaacatcctttacccaagagcaaattgaggccctggagaaagagtttgagagaacccattatccagatgtgtttgcccgagaaagactagcagccaaaatagatctacctgaagcaagaatacaggtatggttttctaatcgaagggccaaatggagaagagaagaaaaactgaggaatcagagaagacaggccagcaacacacctagtcatattcctatcagcagtagtttcagcaccagtgtctaccaaccaattccacaacccaccacaccggtttcctccttcacatctggctccatgttgggccgaacagacacagccctcacaaacacctacagcgctctgccgcctatgcccagcttcaccatggcaaataacctgcctatgcaacccccagtccccagccagacctcctcatactcctgcatgctgcccaccagcccttcggtgaatgggcggagttatgatacctacacccccccacatatgcagacacacatgaacagtcagccaatgggcacctcgggcaccacttcaacaggactcatttcccctggtgtgtcagttccagttcaagttcccggaagtgaacctgatatgtctcaatactggccaagattacagtaaaaaaaaaaaaaaaaaaaaaaaggaaaggaaatattgtgttaattcagtcagtgactatggggacacaacagttgagctttcaggaaagaaagaaaaatggctgttagagccgcttcagttctacaattgtgtcctgtattgtaccactggggaaggaatggacttgaaacaaggacctttgtatacagaaggcacgatatcagttggaacaaatcttcattttggtatccaaacttttattcattttggtgtattatttgtaaatgggcatttgtatgttataatgaaaaaaagaacaatgtagactggatggatgtttgatctgtgttggtcatgaagttgttttttttttttttaaaaagaaaaccatgatcaacaagctttgccacgaatttaagagttttatcaagatatatcgaatacttctacccatctgttcatagtttatggactgatgttccaagtttgtatcattcctttgcatataattaaacctggaacaacatgcactagatttatgtcagaaatatctgttggttttccaaaggttgttaacagatgaagtttatgtgcaaaaaagggtaagatataaattcaaggaagaaaaaaagttgatagctaaaaggtagagtgtgtcttcgatataatccaatttgttttatgtcaaaatgtaagtatttgtcttccctagaaatcctcagaatgatttctataataaagttaatttcatttatatttgacaagaatatagatgttttatacacattttcatgcaatcatacgtttcttttttggccagcaaaagttaattgttcttagatatagttgtattactgttcacggtccaatcattttgtgcatctagagttcattcctaatcaattaaaagtgcttgcaagagttttaaacttaagtgttttgaagttgttcacaactacatatcaaaattaaccattgttgattgtaaaaaaccatgccaaagcctttgtatttcctttattatacagttttctttttaaccttatagtgtggtgttacaaattttatttccatgttagatcaacattctaaaccaatggttactttcacacacactctgttttacatcctgatgatccttaaaaaataatccttatagataccataaatcaaaaacgtgttagaaaaaaattccacttacagcagggtgtagatctgtgcccatttatacccacaacatatatacaaaatggtaacatttcccagttagccatttaattctaaagctcaaagtctagaaataatttaaaaatgcaacaagcgattagctaggaattgttttttgaattaggactggcattttcaatctgggcagatttccattgtcagcctatttcaacaatgatttcactgaagtatattcaaaagtagatttcttaaaggagactttctgaaagctgttgcctttttcaaataggccctctcccttttctgtctccctcccctttgcacaagaggcatcatttcccattgaaccactacagctgttcccatttgaatcttgctttctgtgcggttgtggatggttggagggtggaggggggatgttgcatgtcaaggaataatgagcacagacacatcaacagacaacaacaaagcagactgtgactggccggtgggaattaaaggccttcagtcattggcagcttaagccaaacattcccaaatctatgaagcagggcccattgttggtcagttgttatttgcaatgaagcacagttctgatcatgtttaaagtggaggcacgcagggcaggagtgcttgagcccaagcaaaggatggaaaaaaataagcctttgttgggtaaaaaaggactgtctgagactttcatttgttctgtgcaacatataagtcaatacagataagtcttcctctgcaaacttcactaaaaagcctgggggttctggcagtctagattaaaatgcttgcacatgcagaaacctctggggacaaagacacacttccactgaattatactctgctttaaaaaaatccccaaaagcaaatgatcagaaatgtagaaattaatggaaggatttaaacatgaccttctcgttcaatatctactgttttttagttaaggaattacttgtgaacagataattgagattcattgctccggcatgaaatatactaataattttattccaccagagttgctgcacatttggagacaccttcctaagttgcagtttttgtatgtgtgcatgtagttttgttcagtgtcagcctgcactgcacagcagcacatttctgcaggggagtgagcacacatacgcactgttggtacaattgccggtgcagacatttctacctcctgacattttgcagcctacattccctgagggctgtgtgctgagggaactgtcagagaagggctatgtgggagtgcatgccacagctgctggctggcttacttcttccttctcgctggctgtaatttccaccacggtcaggcagccagttccggcccacggttctgttgtgtagacagcagagactttggagacccggatgtcgcacgccaggtgcaagaggtgggaatgggagaaaaggagtgacgtgggagcggagggtctgtatgtgtgcacttgggcacgtatatgtgtgctctgaaggtcaggattgccagggcaaagtagcacagtctggtatagtctgaagaagcggctgctcagctgcagaagccctctggtccggcaggatgggaacggctgccttgccttctgcccacaccctagggacatgagctgtccttccaaacagagctccaggcactctcttggggacagcatggcaggctctgtgtggtagcagtgcctgggagttggccttttactcattgttgaaataatttttgtttattatttatttaacgatacatatatttatatatttatcaatggggtatctgcagggatgttttgacaccatcttccaggatggagattatttgtgaagacttcagtagaatcccaggactaaacgtctaaattttttctccaaacttgactgacttgggaaaaccaggtgaatagaataagagctgaatgttttaagtaataaacgttcaaactgctctaagtaaaaaaatgcattttactgcaatgaatttctagaatatttttcccccaaagctatgcctcctaacccttaaatggtgaacaactggtttcttgctacagctcactgccatttcttcttactatcatcactaggtttcctaagattcactcatacagtattatttgaagattcagctttgttctgtgaatgtcatcttaggattgtgtctatattcttttgcttatttctttttactctgggcctctcatactagtaagattttaaaaagccttttcttctctgtatgtttggctcaccaaggcgaaatatatattcttctctttttcatttctcaagaataaacctcatctgcttttttgtttttctgtgttttggcttggtactgaatgactcaactgctcggttttaaagttcaaagtgtaagtacttagggttagtactgcttatttcaataatgttgacggtgactatctttggaaagcagtaacatgctgtcttagaaatgacattaataatgggcttaaacaaatgaataggggggtccccccactctccttttgtatgcctatgtgtgtctgatttgttaaaagatggacagggaattgattgcagagtgtcgcttccttctaaagtagttttattttgtctactgttagtatttaaagatcctggaggtggacataaggaataaatggaagagaaaagtagatattgtatggtggctactaaaaggaaattcaaaaagtcttagaacccgagcacctgagcaaactgcagtagtcaaaatatttatctcatgttaaagaaaggcaaatctagtgtaagaaatgagtaccatatagggttttgaagttcatatactagaaacacttaaaagatatcatttcagatattacgtttggcattgttcttaagtatttatatctttgagtcaagctgataattaaaaaaaatctgttaatggagtgtatatttcataatgtatcaaaatggtgtctatacctaaggtagcattattgaagagagatatgtttatgtagtaagttattaacataatgagtaacaaataatgtttccagaagaaaggaaaacacattttcagagtgcgtttttatcagaggaagacaaaaatacacacccctctccagtagcttatttttacaaagccggcccagtgaattagaaaaacaaagcacttggatatgatttttggaaagcccaggtacacttattattcaaaatgcacttttactgagtttgaaaagtttcttttatatttaaaataagggttcaaatatgcatattcaatttttatagtagttatctatttgcaaagcatatattaactagtaattggctgttaattttatagacatggtagccagggaagtatatcaatgacctattaagtattttgacaagcaatttacatatctgatgacctcgtatctctttttcagcaagtcaaatgctatgtaattgttccattgtgtgttgtataaaatgaatcaacacggtaagaaaaaggttagagttattaaaataataaactgactaaaatactcatttgaatttattcagaatgttcataatgctttcaaaggacatagcagagcttttgtggagtatccgcacaacattatttattatctatggactaaatcaattttttgaagttgctttaaaatttaaaagcacctttgcttaatataaagccctttaattttaactgacagatcaattctgaaactttattttgaaaagaaaatggggaagaatctgtgtctttagaattaaaagaaatgaaaaaaataaacccgacattctaaaaaaatagaataagaaacctgatttttagtactaatgaaatagcgggtgacaaaatagttgtctttttgattttgatcacaaaaaataaactggtagtgacaggatatgatggagagatttgacatcctggcaaatcactgtcattgattcaattattctaattctgaataaaagctgtatacagta

SEQ ID NO: 163362 - DNA, 455 bp, Homo sapiens
  Payload ID: 12182
  Gene Symbol: PAX6
  Gene Name: paired box 6
  ENST ID: ENST00000438681
  CDS Start-End: 340-455
tgagccatcaccaatcagcataggaatctgagaattgctctcacacaccaacccagcaacatccgtggagaaaactctcaccagcaactcctttaaaacaccgtcatttcaaaccattgtggtcttcaagcaacaacagcagcacaaaaaaccccaaccaaacaaaactcttgacagaagctgtgacaaccagaaaggatgcctcataaagggggaagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggcc

SEQ ID NO: 163363 - DNA, 574 bp, Homo sapiens
  Payload ID: 12182
  Gene Symbol: PAX6
  Gene Name: paired box 6
  ENST ID: ENST00000524853
  CDS Start-End: 402-574
agtcaacaaatggcacgtgggagaagttggtgagtgtttggtgaggactcttcagggcttttcacaagaaccctctgtacacaaagaatctgagaattgctctcacacaccaacccagcaacatccgtggagaaaactctcaccagcaactcctttaaaacaccgtcatttcaaaccattgtggtcttcaagcaacaacagcagcacaaaaaaccccaaccaaacaaaactcttgacagaagctgtgacaaccagaaaggatgcctcataaagggggaagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggccgtgcgacatttcccgaattctgcaggtgtccaacggatgtgtgagtaaaattctggg

SEQ ID NO: 163364 - DNA, 677 bp, Homo sapiens
  Payload ID: 12182
  Gene Symbol: PAX6
  Gene Name: paired box 6
  ENST ID: ENST00000525535
  CDS Start-End: 672-677
gcagcgtcctcactgtcccggctgccaggggctgcggcgacgcggccagtcagcagcgagttcaggtcgcgcagattttattgatgagctctgactttcagcactttccctaagtcaagaagagtctagcgtacccttcggctgcttcatttcagcctccctgcctcagctcttcagccctattccccctcgccctgtcctggggtgtgtacagcagcccaggccttccttctccttcccggctccgtggcccgaagccgccgagagagctcgggacagcgcaggaccaggcagccgctcgctctcctgtcaccttaactgcaggctccgaggggcgcctttggagtgtactgaggaatctgagaattgctctcacacaccaacccagcaacatccgtggagaaaactctcaccagcaactcctttaaaacaccgtcatttcaaaccattgtggtcttcaagcaacaacagcagcacaaaaaaccccaaccaaacaaaactcttgacagaagctgtgacaaccagaaaggatgcctcataaagggggaagactttaactaggggcgcgcagatgtgtgaggccttttattgtgagagtggacagacatccgagatttcagagccccatattcgagccccgtggaatcccgcggcccccagccagagccagcatgcag

SEQ ID NO: 163365 - DNA, 6860 bp, Homo sapiens
  Payload ID: 12182
  Gene Symbol: PAX6
  Gene Name: paired box 6
  Uniprot ID: P26367
  ENST ID: ENST00000606377
  CDS Start-End: 408-1718
gcacttagtcaacaaatggcacgtgggagaagttggtgagtgtttggtgaggactcttcagggcttttcacaagaaccctctgtacacaaagaatctgagaattgctctcacacaccaacccagcaacatccgtggagaaaactctcaccagcaactcctttaaaacaccgtcatttcaaaccattgtggtcttcaagcaacaacagcagcacaaaaaaccccaaccaaacaaaactcttgacagaagctgtgacaaccagaaaggatgcctcataaagggggaagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggccgtgcgacatttcccgaattctgcagacccatgcagatgcaaaagtccaagtgctggacaatcaaaacgtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagcgtgtcatcaataaacagagttcttcgcaacctggctagcgaaaagcaacagatgggcgcagacggcatgtatgataaactaaggatgttgaacgggcagaccggaagctggggcacccgccctggttggtatccggggacttcggtgccagggcaacctacgcaagatggctgccagcaacaggaaggagggggagagaataccaactccatcagttccaacggagaagattcagatgaggctcaaatgcgacttcagctgaagcggaagctgcaaagaaatagaacatcctttacccaagagcaaattgaggccctggagaaagagtttgagagaacccattatccagatgtgtttgcccgagaaagactagcagccaaaatagatctacctgaagcaagaatacaggtatggttttctaatcgaagggccaaatggagaagagaagaaaaactgaggaatcagagaagacaggccagcaacacacctagtcatattcctatcagcagtagtttcagcaccagtgtctaccaaccaattccacaacccaccacaccggtttcctccttcacatctggctccatgttgggccgaacagacacagccctcacaaacacctacagcgctctgccgcctatgcccagcttcaccatggcaaataacctgcctatgcaacccccagtccccagccagacctcctcatactcctgcatgctgcccaccagcccttcggtgaatgggcggagttatgatacctacacccccccacatatgcagacacacatgaacagtcagccaatgggcacctcgggcaccacttcaacaggactcatttcccctggtgtgtcagttccagttcaagttcccggaagtgaacctgatatgtctcaatactggccaagattacagtaaaaaaaaaaaaaaaaaaaaaaaggaaaggaaatattgtgttaattcagtcagtgactatggggacacaacagttgagctttcaggaaagaaagaaaaatggctgttagagccgcttcagttctacaattgtgtcctgtattgtaccactggggaaggaatggacttgaaacaaggacctttgtatacagaaggcacgatatcagttggaacaaatcttcattttggtatccaaacttttattcattttggtgtattatttgtaaatgggcatttgtatgttataatgaaaaaaagaacaatgtagactggatggatgtttgatctgtgttggtcatgaagttgttttttttttttttaaaaagaaaaccatgatcaacaagctttgccacgaatttaagagttttatcaagatatatcgaatacttctacccatctgttcatagtttatggactgatgttccaagtttgtatcattcctttgcatataattaaacctggaacaacatgcactagatttatgtcagaaatatctgttggttttccaaaggttgttaacagatgaagtttatgtgcaaaaaagggtaagatataaattcaaggaagaaaaaaagttgatagctaaaaggtagagtgtgtcttcgatataatccaatttgttttatgtcaaaatgtaagtatttgtcttccctagaaatcctcagaatgatttctataataaagttaatttcatttatatttgacaagaatatagatgttttatacacattttcatgcaatcatacgtttcttttttggccagcaaaagttaattgttcttagatatagttgtattactgttcacggtccaatcattttgtgcatctagagttcattcctaatcaattaaaagtgcttgcaagagttttaaacttaagtgttttgaagttgttcacaactacatatcaaaattaaccattgttgattgtaaaaaaccatgccaaagcctttgtatttcctttattatacagttttctttttaaccttatagtgtggtgttacaaattttatttccatgttagatcaacattctaaaccaatggttactttcacacacactctgttttacatcctgatgatccttaaaaaataatccttatagataccataaatcaaaaacgtgttagaaaaaaattccacttacagcagggtgtagatctgtgcccatttatacccacaacatatatacaaaatggtaacatttcccagttagccatttaattctaaagctcaaagtctagaaataatttaaaaatgcaacaagcgattagctaggaattgttttttgaattaggactggcattttcaatctgggcagatttccattgtcagcctatttcaacaatgatttcactgaagtatattcaaaagtagatttcttaaaggagactttctgaaagctgttgcctttttcaaataggccctctcccttttctgtctccctcccctttgcacaagaggcatcatttcccattgaaccactacagctgttcccatttgaatcttgctttctgtgcggttgtggatggttggagggtggaggggggatgttgcatgtcaaggaataatgagcacagacacatcaacagacaacaacaaagcagactgtgactggccggtgggaattaaaggccttcagtcattggcagcttaagccaaacattcccaaatctatgaagcagggcccattgttggtcagttgttatttgcaatgaagcacagttctgatcatgtttaaagtggaggcacgcagggcaggagtgcttgagcccaagcaaaggatggaaaaaaataagcctttgttgggtaaaaaaggactgtctgagactttcatttgttctgtgcaacatataagtcaatacagataagtcttcctctgcaaacttcactaaaaagcctgggggttctggcagtctagattaaaatgcttgcacatgcagaaacctctggggacaaagacacacttccactgaattatactctgctttaaaaaaatccccaaaagcaaatgatcagaaatgtagaaattaatggaaggatttaaacatgaccttctcgttcaatatctactgttttttagttaaggaattacttgtgaacagataattgagattcattgctccggcatgaaatatactaataattttattccaccagagttgctgcacatttggagacaccttcctaagttgcagtttttgtatgtgtgcatgtagttttgttcagtgtcagcctgcactgcacagcagcacatttctgcaggggagtgagcacacatacgcactgttggtacaattgccggtgcagacatttctacctcctgacattttgcagcctacattccctgagggctgtgtgctgagggaactgtcagagaagggctatgtgggagtgcatgccacagctgctggctggcttacttcttccttctcgctggctgtaatttccaccacggtcaggcagccagttccggcccacggttctgttgtgtagacagcagagactttggagacccggatgtcgcacgccaggtgcaagaggtgggaatgggagaaaaggagtgacgtgggagcggagggtctgtatgtgtgcacttgggcacgtatatgtgtgctctgaaggtcaggattgccagggcaaagtagcacagtctggtatagtctgaagaagcggctgctcagctgcagaagccctctggtccggcaggatgggaacggctgccttgccttctgcccacaccctagggacatgagctgtccttccaaacagagctccaggcactctcttggggacagcatggcaggctctgtgtggtagcagtgcctgggagttggccttttactcattgttgaaataatttttgtttattatttatttaacgatacatatatttatatatttatcaatggggtatctgcagggatgttttgacaccatcttccaggatggagattatttgtgaagacttcagtagaatcccaggactaaacgtctaaattttttctccaaacttgactgacttgggaaaaccaggtgaatagaataagagctgaatgttttaagtaataaacgttcaaactgctctaagtaaaaaaatgcattttactgcaatgaatttctagaatatttttcccccaaagctatgcctcctaacccttaaatggtgaacaactggtttcttgctacagctcactgccatttcttcttactatcatcactaggtttcctaagattcactcatacagtattatttgaagattcagctttgttctgtgaatgtcatcttaggattgtgtctatattcttttgcttatttctttttactctgggcctctcatactagtaagattttaaaaagccttttcttctctgtatgtttggctcaccaaggcgaaatatatattcttctctttttcatttctcaagaataaacctcatctgcttttttgtttttctgtgttttggcttggtactgaatgactcaactgctcggttttaaagttcaaagtgtaagtacttagggttagtactgcttatttcaataatgttgacggtgactatctttggaaagcagtaacatgctgtcttagaaatgacattaataatgggcttaaacaaatgaataggggggtccccccactctccttttgtatgcctatgtgtgtctgatttgttaaaagatggacagggaattgattgcagagtgtcgcttccttctaaagtagttttattttgtctactgttagtatttaaagatcctggaggtggacataaggaataaatggaagagaaaagtagatattgtatggtggctactaaaaggaaattcaaaaagtcttagaacccgagcacctgagcaaactgcagtagtcaaaatatttatctcatgttaaagaaaggcaaatctagtgtaagaaatgagtaccatatagggttttgaagttcatatactagaaacacttaaaagatatcatttcagatattacgtttggcattgttcttaagtatttatatctttgagtcaagctgataattaaaaaaaatctgttaatggagtgtatatttcataatgtatcaaaatggtgtctatacctaaggtagcattattgaagagagatatgtttatgtagtaagttattaacataatgagtaacaaataatgtttccagaagaaaggaaaacacattttcagagtgcgtttttatcagaggaagacaaaaatacacacccctctccagtagcttatttttacaaagccggcccagtgaattagaaaaacaaagcacttggatatgatttttggaaagcccaggtacacttattattcaaaatgcacttttactgagtttgaaaagtttcttttatatttaaaataagggttcaaatatgcatattcaatttttatagtagttatctatttgcaaagcatatattaactagtaattggctgttaattttatagacatggtagccagggaagtatatcaatgacctattaagtattttgacaagcaatttacatatctgatgacctcgtatctctttttcagcaagtcaaatgctatgtaattgttccattgtgtgttgtataaaatgaatcaacacggtaagaaaaaggttagagttattaaaataataaactgactaaaatactcatttgaatttattcagaatgttcataatgctttcaaaggacatagcagagcttttgtggagtatccgcacaacattatttattatctatggactaaatcaattttttgaagttgctttaaaatttaaaagcacctttgcttaatataaagccctttaattttaactgacagatcaattctgaaactttattttgaaaagaaaatggggaagaatctgtgtctttagaattaaaagaaatgaaaaaaataaacccgacattctaaaaaaatagaataagaaacctgatttttagtactaatgaaatagcgggtgacaaaatagttgtctttttgattttgatcacaaaaaataaactggtagtgacaggatatgatggagagatttgacatcctggcaaatcactgtcattgattcaattattctaattctgaataaaagctgtatacagta

SEQ ID NO: 163366 - DNA, 2260 bp, Homo sapiens
  Payload ID: 12183
  Gene Symbol: PAX7
  Gene Name: paired box 7
  Uniprot ID: P23759
  ENST ID: ENST00000375375
  CDS Start-End: 599-2161
gaaagctggtgtggagggagaagcgagtgtggtccggagaaagaaggcgtggagaagagggagggagcgagagcgagagaataaatatataaataaatacgagaacgaaatccactccgcagtctccgggctcggaaactttggccccgagcgccagagcgccagagcgcgagagcgcggcgctcgccactctgaggctggcggcctcgattccggccgcgttcccccggcccccctccgccgcggggcctggtctccgggttctgccaggcgcatcagcccgcacaacttctggccgaggccagccggcagaggcggacttggggttggagtgtttgtttgtttgaacttcctcgtcgtcgccaccttccctccccccaacctccaccccacctcacccccctccccagcttctggacgcgtttgactgcagccaggggtggggggtgggggtagggagtgtgtgtggaggggagggagaagaggttaaaaaaaagaagacgaagaagacggaaagaaagagatcgcagcaggggtgaagggagcggacgggaagcgatttttgccgactttggattcgtccccggcgtgcgcaagaatggcggcccttcccggcacggtaccgagaatgatgcggccggctccggggcagaactacccccgcacgggattccctttggaagtgtccaccccgcttggccaaggccgggtcaatcagctgggaggggtcttcatcaatgggcgacccctgcctaaccacatccgccacaagatagtggagatggcccaccatggcatccggccctgtgtcatctcccgacagctgcgtgtctcccacggctgcgtctccaagattctttgccgctaccaggagaccgggtccatccggcctggggccatcggcggcagcaagcccagacaggtggcgactccggatgtagagaaaaagattgaggagtacaagagggaaaacccaggcatgttcagctgggagatccgggacaggctgctgaaggatgggcactgtgaccgaagcactgtgccctcaggtttagtgagttcgattagccgcgtgctcagaatcaagttcgggaagaaagaggaggaggatgaagcggacaagaaggaggacgacggcgaaaagaaggccaaacacagcatcgacggcatcctgggcgacaaagggaaccggctggacgagggctcggatgtggagtcggaacctgacctcccactgaagcgcaagcagcgacgcagtcggaccacattcacggccgagcagctggaggagctggagaaggcctttgagaggacccactacccagacatatacacccgcgaggagctggcgcagaggaccaagctgacagaggcgcgtgtgcaggtctggttcagtaaccgccgcgcccgttggcgtaagcaggcaggagccaaccagctggcggcgttcaaccaccttctgccaggaggcttcccacccaccggcatgcccacgctgcccccctaccagctgccggactccacctaccccaccaccaccatctcccaagatgggggcagcactgtgcaccggcctcagcccctgccaccgtccaccatgcaccagggcgggctggctgcagcggctgcagccgccgacaccagctctgcctacggagcccgccacagcttctccagctactctgacagcttcatgaatccggcggcgccctccaaccacatgaacccggtcagcaacggcctgtctcctcaggtgatgagcatcttgggcaaccccagtgcggtgcccccgcagccacaggctgacttctccatctccccgctgcatggcggcctggactcggccacctccatctcagccagctgcagccagcgggccgactccatcaagccaggagacagcctgcccacctcccaggcctactgcccacccacctacagcaccaccggctacagcgtggaccccgtggccggctatcagtacggccagtacggccagagtgagtgcctggtgccctgggcgtcccccgtccccattccttctcccacccccagggcctcctgcttgtttatggagagctacaaggtggtgtcagggtggggaatgtccatttcacagatggaaaaattgaagtccagccagatggaacagttcacctaaaatgacactgagttgggcaaaacccaggacatctcctggctaagcctctgcttccgtactatggctccaacagaaataaaatacacaacacaaatatca

SEQ ID NO: 163367 - DNA, 1700 bp, Homo sapiens
  Payload ID: 12183
  Gene Symbol: PAX7
  Gene Name: paired box 7
  Uniprot ID: P23759
  ENST ID: ENST00000400661
  CDS Start-End: 81-1637
aagagatcgcagcaggggtgaagggagcggacgggaagcgatttttgccgactttggattcgtccccggcgtgcgcaagaatggcggcccttcccggcacggtaccgagaatgatgcggccggctccggggcagaactacccccgcacgggattccctttggaagtgtccaccccgcttggccaaggccgggtcaatcagctgggaggggtcttcatcaatgggcgacccctgcctaaccacatccgccacaagatagtggagatggcccaccatggcatccggccctgtgtcatctcccgacagctgcgtgtctcccacggctgcgtctccaagattctttgccgctaccaggagaccgggtccatccggcctggggccatcggcggcagcaagcccagacaggtggcgactccggatgtagagaaaaagattgaggagtacaagagggaaaacccaggcatgttcagctgggagatccgggacaggctgctgaaggatgggcactgtgaccgaagcactgtgccctcagtgagttcgattagccgcgtgctcagaatcaagttcgggaagaaagaggaggaggatgaagcggacaagaaggaggacgacggcgaaaagaaggccaaacacagcatcgacggcatcctgggcgacaaagggaaccggctggacgagggctcggatgtggagtcggaacctgacctcccactgaagcgcaagcagcgacgcagtcggaccacattcacggccgagcagctggaggagctggagaaggcctttgagaggacccactacccagacatatacacccgcgaggagctggcgcagaggaccaagctgacagaggcgcgtgtgcaggtctggttcagtaaccgccgcgcccgttggcgtaagcaggcaggagccaaccagctggcggcgttcaaccaccttctgccaggaggcttcccacccaccggcatgcccacgctgcccccctaccagctgccggactccacctaccccaccaccaccatctcccaagatgggggcagcactgtgcaccggcctcagcccctgccaccgtccaccatgcaccagggcgggctggctgcagcggctgcagccgccgacaccagctctgcctacggagcccgccacagcttctccagctactctgacagcttcatgaatccggcggcgccctccaaccacatgaacccggtcagcaacggcctgtctcctcaggtgatgagcatcttgggcaaccccagtgcggtgcccccgcagccacaggctgacttctccatctccccgctgcatggcggcctggactcggccacctccatctcagccagctgcagccagcgggccgactccatcaagccaggagacagcctgcccacctcccaggcctactgcccacccacctacagcaccaccggctacagcgtggaccccgtggccggctatcagtacggccagtacggccagagtgagtgcctggtgccctgggcgtcccccgtccccattccttctcccacccccagggcctcctgcttgtttatggagagctacaaggtggtgtcagggtggggaatgtccatttcacagatggaaaaattgaagtccagccagatggaacagttcacctaaaatgacactgagttgggcaaaacccaggacatctcctggctaagcctctgcttccgtactatg

SEQ ID NO: 163368 - DNA, 5538 bp, Homo sapiens
  Payload ID: 12183
  Gene Symbol: PAX7
  Gene Name: paired box 7
  Uniprot ID: P23759
  ENST ID: ENST00000420770
  CDS Start-End: 84-1601
agaaagagatcgcagcaggggtgaagggagcggacgggaagcgatttttgccgactttggattcgtccccggcgtgcgcaagaatggcggcccttcccggcacggtaccgagaatgatgcggccggctccggggcagaactacccccgcacgggattccctttggaagtgtccaccccgcttggccaaggccgggtcaatcagctgggaggggtcttcatcaatgggcgacccctgcctaaccacatccgccacaagatagtggagatggcccaccatggcatccggccctgtgtcatctcccgacagctgcgtgtctcccacggctgcgtctccaagattctttgccgctaccaggagaccgggtccatccggcctggggccatcggcggcagcaagcccagacaggtggcgactccggatgtagagaaaaagattgaggagtacaagagggaaaacccaggcatgttcagctgggagatccgggacaggctgctgaaggatgggcactgtgaccgaagcactgtgccctcaggtttagtgagttcgattagccgcgtgctcagaatcaagttcgggaagaaagaggaggaggatgaagcggacaagaaggaggacgacggcgaaaagaaggccaaacacagcatcgacggcatcctgggcgacaaagggaaccggctggacgagggctcggatgtggagtcggaacctgacctcccactgaagcgcaagcagcgacgcagtcggaccacattcacggccgagcagctggaggagctggagaaggcctttgagaggacccactacccagacatatacacccgcgaggagctggcgcagaggaccaagctgacagaggcgcgtgtgcaggtctggttcagtaaccgccgcgcccgttggcgtaagcaggcaggagccaaccagctggcggcgttcaaccaccttctgccaggaggcttcccacccaccggcatgcccacgctgcccccctaccagctgccggactccacctaccccaccaccaccatctcccaagatgggggcagcactgtgcaccggcctcagcccctgccaccgtccaccatgcaccagggcgggctggctgcagcggctgcagccgccgacaccagctctgcctacggagcccgccacagcttctccagctactctgacagcttcatgaatccggcggcgccctccaaccacatgaacccggtcagcaacggcctgtctcctcaggtgatgagcatcttgggcaaccccagtgcggtgcccccgcagccacaggctgacttctccatctccccgctgcatggcggcctggactcggccacctccatctcagccagctgcagccagcgggccgactccatcaagccaggagacagcctgcccacctcccaggcctactgcccacccacctacagcaccaccggctacagcgtggaccccgtggccggctatcagtacggccagtacggccagactgctgttgattatctggccaaaaatgtgagcctctccacccagcgtcgcatgaagctcggggagcactctgctgtgctgggactcctgcctgtggaaactggccaggcctactagggcccctggggcgacttgccccagcccaattcccagcccaaccctaactgacccctgagcttcccagccttgccgcctcacccccctgttgtcctaggaggccaggaaaggagcccacctgcttctcatcaccagccccctggaggtagacagccagcttgtcactcacctgtggttagggatccagagtgatgcccttggagtctgctccccactttccccaaggagggtttctggtcagcctgaggtcctcccctgtcaaatcccatggtggcctctgtgccatctcaggcatggagattggggcccaccttgaacaccttgggtgtccagaggaggatggtgcctgagaggaggtcctacagccctttggacccaactccagtgggggccctagctagaagtggaggtgaagctttcagggctgctctcagctggatgtactgggagccagccctgcaaggagggtctctggctcagtgtcagaaccacagccctttcctcctctagacattgggactccagcaaagaggggaccctggccctggggtcttcccaggggagtcagcaggggggcagtctcacccccacccaggaatttgaaggacttcagaaccctccccagacacctctactgggtgcatggggaaatctagcacaggcagggagactggggagaccaggaagaggcttaaccagagggtaggggcacatgggggtggggcttgtcagccgtgggcccgcccaggatacaaggacccaactcaggcttctggaagcagagggctcttatcctgaagcccaagttcccagcatgtccactccatctggggcctggggagcccacagaacttttcagtttccttcattagctgaatcagatgagatggggaggggataaagtcttgaggatacatgagtggaggagcaggaagtgggctcagaaggcactttcataaccagatccctctgtttgtgggagggcaagcctttgttgcccaaggcttcagctctctgcctgcaagtccacaccccagggagttgagattttgcccaaagccttccgcagaggcccgagcccatccttaccatgccccatcctctaggaagaggtctccatcttccccaaacccctttcagtttgtggggatgcagagagctaccctcagagctttggaggagggttgtagactgggcagggatggtttgccccacagacaagatgatcccccctggcatgttgttaggggcaaattgctgtcctgctcagagtggcatctttcaatgttgcctccatcttggccaagaggtccctgcctcctgatccggcacagctgagctgaggcagatgtgaccagttttcaagctaccagccctgggcagaggaagatgtcaacaattccagagcagagggaagaggcaccttccttgaccacaccagtggcctcctgaagttccatgcttttaagagctgggaccttgggaggatgattcaaaccctcaattcctcctccctgggaactttttaccacctttacctatttatcaaaatcatattcatctttaccatcactgtcactgtaatctacattccatcacctttatcaggtgctgctgagtacaaagcacttgggatgggagacacagcactgaattcacaaacattggaccaaactgtttgtccccatctgggttcatgaggccacctctttgctcaatccatgcctcttgccctcagtcaacaagacattcctagagggaaagggctgctgctctgggagtcaacctgagttcctccctcctgggaagctgggttggcaagattctaggacactcacctgcatggacatcacctctgtgacaaatgcttacctgtttctcatcttcagacttggcgatatcaagcctgttctggaccatgaccaggctggctcatatctctggtttagagaaacctatgaataactggggacaaacagactctttggtagcagcagacacatgtgatccatcaagatcaaccaaggttgcaactggagcgtccactgccagagacctttggctcttcaagctcgggacaaaaaagaagactctgttgtcccttggtaacccagtccctgcttttgtagctatcacagcagaaagcaactcttcctgaagaccaaacactcgtcatccacattccttgaatggccaatccttccatctggaggcctggctcagaaagtatctgagtatcctgacaccctctgtgactcaggagcagggatctcaggcagctgatatcaaaaccacccagccccatccccaggaggcgacattccaatgctaggaccaatcccagatatctggtcccgatggtgaaatggaacaaagacctgcttgggaataaaccaaatgatttctcatgacgttgaacataagttctcccaagccatcatcttggtagaaaatgggacttattccttgacaggccccacccccttcagaaagaggcccttgaccctgataggttctctctaaaacccgtatattaacgcatctggccaacttgggttataaaattcagccttgtgttggcaactcgaaacatcaccagagaggtgatgttgaatgagagacacaaggcctccatctctttggggctgaccacagcctgagaaagaaggtctgggttccagtggccaggccgtcccagaaacaacccccatccatccctgtaaatagagtctgtagcaaaataagagctgcttcctccaacttatcacaagtcgccgttggtcctctctaaggagggctctcttctgagttcattgtacaatagttggaaacgtggtgatgtgctgttcgtttatagaaagctgactttttataaatatatatatatactaaaaaaggaaagaaatcccccacagtgtgtgtcgtgctagtgccagagaccatctgtagggatatatcttcatattgtgtgtttcaaattatgcattccaggctctagtgggttctttcaatcttgttcctttatttttttcatttggtatttctctcttgctatataaagaaaaaaagaagtgatgtgtaagaaccaagctatgcttttatacttccattttatacttgatttagctttgttgttcttttgccagaggaacatcaaagggcagagcaaacagagaactagggggataagagagaagaaaagaagaatggagagagaggtttgcccagaaggaaaacgaagagccagattgaaatctgactctggcttgagaacaggacgggtcccagagtttgaccactgccagaatccagtgtttcaagatggagttggtgaagcatccaagattttggatcctgggcctcagtgacactccatcacccaactaaaaagatgttctctgggacctctctcaggctgatgttcttctcatcaagctcccgaatgtgtctcgcactattggacactttttgggggtacacaggtcttctctcctcccctcctgcagaggcaccaaaaccaagaccaaatgggggttctctagccgccaacttgaaacgctctgagacttctgtgtatttgatgcttcttcaagtcagctctgacgtggccaattccctgacctgggaaatatttacatagtactctagatcattccttcttcctagtaactgcaactttgttgcttctgtgtttgactcacagccactttcccccatgcggaagtgagtgggtgtacgtgagggtgtgagtggggtgtgtgcgtgggcgtgtgggcgtgaggtgtgtgtttaaatataatcacaccataatttattcagctatatggagtagtagactagaaagagaaactggtatttgctttaactacctgctgcttgtaagcgcttcctctgtaactcaggcgtaactgttatacattaaaagaaattaaaagca

SEQ ID NO: 163369 - DNA, 4152 bp, Homo sapiens
  Payload ID: 12184
  Gene Symbol: PAX8
  Gene Name: paired box 8
  Uniprot ID: Q06710
  ENST ID: ENST00000263334
  CDS Start-End: 264-1616
gggaacaaacttcagaaggaggagagacaccgggcccagggcaccctcgcgggcggacccaagcagtgagggcctgcagccggccggccagacgatgcaggtgtaaaggatgaggcctggggagggggcctgaggatgcaggcatcgaatctcatcgcatctcatgcccttctcctgggtttgtgcagggcagcggcaggcgcggcccggacctacgggaggaagccccgagccctcggcgggctgcgagcgactccccggcgatgcctcacaactccatcagatctggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaatagaatcatccggaccaaagtgcagcaaccattcaacctccctatggacagctgcgtggccaccaagtccctgagtcccggacacacgctgatccccagctcagctgtaactcccccggagtcaccccagtcggattccctgggctccacctactccatcaatgggctcctgggcatcgctcagcctggcagcgacaagaggaaaatggatgacagtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcagggcctctacccgctgcccttgctcaacagcaccctggacgacgggaaggccaccctgaccccttccaacacgccactggggcgcaacctctcgactcaccagacctaccccgtggtggcagatcctcactcacccttcgccataaagcaggaaacccccgaggtgtccagttctagctccaccccttcctctttatctagctccgcctttttggatctgcagcaagtcggctccggggtcccgcccttcaatgcctttccccatgctgcctccgtgtacgggcagttcacgggccaggccctcctctcagggcgagagatggtggggcccacgctgcccggatacccaccccacatccccaccagcggacagggcagctatgcctcctctgccatcgcaggcatggtggcaggaagtgaatactctggcaatgcctatggccacaccccctactcctcctacagcgaggcctggcgcttccccaactccagcttgctgagttccccatattattacagttccacatcaaggccgagtgcaccgcccaccactgccacggcctttgaccatctgtagttgccatggggacagtgggagcgactgagcaacaggaggactcagcctgggacaggccccagagagtcacacaaaggaatctttatttattacatgaaaaataaccacaagtccagcattgcggcacactccctgtgtggttaatttaatgaaccatgaaagacaggatgaccttggacaaggccaaactgtcctccaagactccttaatgaggggcaggagtcccagggaaagagaaccatgccatgctgaaaaagacaaaattgaagaagaaatgtagcccccagccggtacccaccaaaggagagaagaagcaatagccgaggaacttggggggatggcgaatggttcctgcccgggcccaaggggtgcacagggcacctccatggctccattattaacacaactctagcaattatggaccataagcacttccctccagcccacaagtcacagcctggtgccgaggctctcctcaccagccacccagggagtcacctccctcagcctcccgcctgccccacacggaggctctggctgtcctctttctccactccatttgcttggctctttctacacctccctcttgggcatgggctgagggctggagcgagtccctcagaaattccaccaggctgtcagctgacctcttttgcctgctgctgtgaaggtatagcaccaccccaggtcctcctgcagtgcggcatccccttggcagctgccgtcagccaggccagccccagggagcttaaaacagacattccacagggcctgggcccctgggaggtgaggtgtggtgtgcggcttcacccagggcagaacaaggcagaatcgcaggaaacccgcttccccttcctgacagctcctgccaagccaaatgtgcttcctgcagctcacgcccaccagctactgaagggacccaaggcaccccctgaagccagcgatagagggtccctctctgctccccagcagctcctgcccccaaggcctgactgtatatactgtaaatgaaactttgtttgggtcaagcttccttctttctaacccccagactttggcctctgagtgaaatgtctctctttgccctgtggggcttctctccttgatgcttctttctttttttaaagacaacctgccattaccacatgactcaataaaccattgctcttcatctcaggctttggggttggctggggaaggaggcatcccggggctgggctttctcccaagaacatcagagctgagtagccgacaaactcactttggggccgtgggctggaagggaccatctgatgccccagagctctggcttggccttctccctctgcctttaattcacgttgaacgctgggtacctcactcatcccaagttcttcaacactgagcaaatgcaaggatagcacagtactgagccaaccatagactccccacaaggagttgctgttgttattaacaggaagccagagaatcagcagggtgggttagtgagggatccgggaatagctgtgactggagcctgcataaacagctctgaagggagagagaagactgggctctcttgtgtgccaggcacagtatggaaggcttcatataagttaagctgaaattagccctgttttacatacagcttcattttacatatgaggaaactgaggctttgaaaaaaatgagatgtcttgtccaagatgaaaagtagtagattcaaccaagtcctcttactctaagcccaacgcttttacccaaaaccccagagtcctcatcagggatgccaaatggttctagacccagtggaggttctggagctgccactggggatttaatttcttttgatttgctaaagatttgacctgactgaatggagaggtagagtgtagtgtggccaggacaaggtgagggaggctgtagagacttagcactttaggccaaccacctccaggaaatctgggaaatgcaatgtgacagctcgggctctgcactccagggggctgtctggtgtccacatggaccttctccatgtgggacacagctggaacaagggggcaggggcctgcagctgggatgcccaggtgaatatgggcagctggacaaacaacactgggattgagtcagatagaaggggcccaaggactccagggctgggaggacagaggctgggagagagggctcttacctccttaggcctcccaaagagcggttagggatgctgccatggatggcatggcagggggaaccctcctggaagaaaatccatctcttctgaagggatctgagatgcggctggtttttcaatggcagaacttccctctgcagcgcgactccgaatccatgacatctgagagtcttcctgaccacaaacctctgggatcccgagggctccctacccaagaatcactttgagcacagcatcccaaggagcccatagagcgatcccttgcattcacagccacagcccctctggggacactctgtacccccggcagaccctttccaactcacaaccaataaaggggcttgggctgtgctttgactaaggtga

SEQ ID NO: 163370 - DNA, 3735 bp, Homo sapiens
  Payload ID: 12184
  Gene Symbol: PAX8
  Gene Name: paired box 8
  Uniprot ID: Q06710
  ENST ID: ENST00000263335
  CDS Start-End: 157-1122
ttcagaaggaggagagacaccgggcccagggcaccctcgcgggcggacccaagcagtgagggcctgcagccggccggccagggcagcggcaggcgcggcccggacctacgggaggaagccccgagccctcggcgggctgcgagcgactccccggcgatgcctcacaactccatcagatctggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaatagaatcatccggaccaaagtgcagcaaccattcaacctccctatggacagctgcgtggccaccaagtccctgagtcccggacacacgctgatccccagctcagctgtaactcccccggagtcaccccagtcggattccctgggctccacctactccatcaatgggctcctgggcatcgctcagcctggcagcgacaagaggaaaatggatgacagtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcagggcgagagatggtggggcccacgctgcccggatacccaccccacatccccaccagcggacagggcagctatgcctcctctgccatcgcaggcatggtggcaggaagtgaatactctggcaatgcctatggccacaccccctactcctcctacagcgaggcctggcgcttccccaactccagcttgctgagttccccatattattacagttccacatcaaggccgagtgcaccgcccaccactgccacggcctttgaccatctgtagttgccatggggacagtgggagcgactgagcaacaggaggactcagcctgggacaggccccagagagtcacacaaaggaatctttatttattacatgaaaaataaccacaagtccagcattgcggcacactccctgtgtggttaatttaatgaaccatgaaagacaggatgaccttggacaaggccaaactgtcctccaagactccttaatgaggggcaggagtcccagggaaagagaaccatgccatgctgaaaaagacaaaattgaagaagaaatgtagcccccagccggtacccaccaaaggagagaagaagcaatagccgaggaacttggggggatggcgaatggttcctgcccgggcccaaggggtgcacagggcacctccatggctccattattaacacaactctagcaattatggaccataagcacttccctccagcccacaagtcacagcctggtgccgaggctctcctcaccagccacccagggagtcacctccctcagcctcccgcctgccccacacggaggctctggctgtcctctttctccactccatttgcttggctctttctacacctccctcttgggcatgggctgagggctggagcgagtccctcagaaattccaccaggctgtcagctgacctcttttgcctgctgctgtgaaggtatagcaccaccccaggtcctcctgcagtgcggcatccccttggcagctgccgtcagccaggccagccccagggagcttaaaacagacattccacagggcctgggcccctgggaggtgaggtgtggtgtgcggcttcacccagggcagaacaaggcagaatcgcaggaaacccgcttccccttcctgacagctcctgccaagccaaatgtgcttcctgcagctcacgcccaccagctactgaagggacccaaggcaccccctgaagccagcgatagagggtccctctctgctccccagcagctcctgcccccaaggcctgactgtatatactgtaaatgaaactttgtttgggtcaagcttccttctttctaacccccagactttggcctctgagtgaaatgtctctctttgccctgtggggcttctctccttgatgcttctttctttttttaaagacaacctgccattaccacatgactcaataaaccattgctcttcatctcaggctttggggttggctggggaaggaggcatcccggggctgggctttctcccaagaacatcagagctgagtagccgacaaactcactttggggccgtgggctggaagggaccatctgatgccccagagctctggcttggccttctccctctgcctttaattcacgttgaacgctgggtacctcactcatcccaagttcttcaacactgagcaaatgcaaggatagcacagtactgagccaaccatagactccccacaaggagttgctgttgttattaacaggaagccagagaatcagcagggtgggttagtgagggatccgggaatagctgtgactggagcctgcataaacagctctgaagggagagagaagactgggctctcttgtgtgccaggcacagtatggaaggcttcatataagttaagctgaaattagccctgttttacatacagcttcattttacatatgaggaaactgaggctttgaaaaaaatgagatgtcttgtccaagatgaaaagtagtagattcaaccaagtcctcttactctaagcccaacgcttttacccaaaaccccagagtcctcatcagggatgccaaatggttctagacccagtggaggttctggagctgccactggggatttaatttcttttgatttgctaaagatttgacctgactgaatggagaggtagagtgtagtgtggccaggacaaggtgagggaggctgtagagacttagcactttaggccaaccacctccaggaaatctgggaaatgcaatgtgacagctcgggctctgcactccagggggctgtctggtgtccacatggaccttctccatgtgggacacagctggaacaagggggcaggggcctgcagctgggatgcccaggtgaatatgggcagctggacaaacaacactgggattgagtcagatagaaggggcccaaggactccagggctgggaggacagaggctgggagagagggctcttacctccttaggcctcccaaagagcggttagggatgctgccatggatggcatggcagggggaaccctcctggaagaaaatccatctcttctgaagggatctgagatgcggctggtttttcaatggcagaacttccctctgcagcgcgactccgaatccatgacatctgagagtcttcctgaccacaaacctctgggatcccgagggctccctacccaagaatcactttgagcacagcatcccaaggagcccatagagcgatcccttgcattcacagccacagcccctctggggacactctgtacccccggcagaccctttccaactcacaaccaataaaggggcttgggctgtgctttgactaaggtga

SEQ ID NO: 163371 - DNA, 3966 bp, Homo sapiens
  Payload ID: 12184
  Gene Symbol: PAX8
  Gene Name: paired box 8
  Uniprot ID: Q06710
  ENST ID: ENST00000348715
  CDS Start-End: 157-1353
ttcagaaggaggagagacaccgggcccagggcaccctcgcgggcggacccaagcagtgagggcctgcagccggccggccagggcagcggcaggcgcggcccggacctacgggaggaagccccgagccctcggcgggctgcgagcgactccccggcgatgcctcacaactccatcagatctggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaatagaatcatccggaccaaagtgcagcaaccattcaacctccctatggacagctgcgtggccaccaagtccctgagtcccggacacacgctgatccccagctcagctgtaactcccccggagtcaccccagtcggattccctgggctccacctactccatcaatgggctcctgggcatcgctcagcctggcagcgacaagaggaaaatggatgacagtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcagggcctctacccgctgcccttgctcaacagcaccctggacgacgggaaggccaccctgaccccttccaacacgccactggggcgcaacctctcgactcaccagacctaccccgtggtggcagctccgcctttttggatctgcagcaagtcggctccggggtcccgcccttcaatgcctttccccatgctgcctccgtgtacgggcagttcacgggccaggccctcctctcagggcgagagatggtggggcccacgctgcccggatacccaccccacatccccaccagcggacagggcagctatgcctcctctgccatcgcaggcatggtggcaggaagtgaatactctggcaatgcctatggccacaccccctactcctcctacagcgaggcctggcgcttccccaactccagcttgctgagttccccatattattacagttccacatcaaggccgagtgcaccgcccaccactgccacggcctttgaccatctgtagttgccatggggacagtgggagcgactgagcaacaggaggactcagcctgggacaggccccagagagtcacacaaaggaatctttatttattacatgaaaaataaccacaagtccagcattgcggcacactccctgtgtggttaatttaatgaaccatgaaagacaggatgaccttggacaaggccaaactgtcctccaagactccttaatgaggggcaggagtcccagggaaagagaaccatgccatgctgaaaaagacaaaattgaagaagaaatgtagcccccagccggtacccaccaaaggagagaagaagcaatagccgaggaacttggggggatggcgaatggttcctgcccgggcccaaggggtgcacagggcacctccatggctccattattaacacaactctagcaattatggaccataagcacttccctccagcccacaagtcacagcctggtgccgaggctctcctcaccagccacccagggagtcacctccctcagcctcccgcctgccccacacggaggctctggctgtcctctttctccactccatttgcttggctctttctacacctccctcttgggcatgggctgagggctggagcgagtccctcagaaattccaccaggctgtcagctgacctcttttgcctgctgctgtgaaggtatagcaccaccccaggtcctcctgcagtgcggcatccccttggcagctgccgtcagccaggccagccccagggagcttaaaacagacattccacagggcctgggcccctgggaggtgaggtgtggtgtgcggcttcacccagggcagaacaaggcagaatcgcaggaaacccgcttccccttcctgacagctcctgccaagccaaatgtgcttcctgcagctcacgcccaccagctactgaagggacccaaggcaccccctgaagccagcgatagagggtccctctctgctccccagcagctcctgcccccaaggcctgactgtatatactgtaaatgaaactttgtttgggtcaagcttccttctttctaacccccagactttggcctctgagtgaaatgtctctctttgccctgtggggcttctctccttgatgcttctttctttttttaaagacaacctgccattaccacatgactcaataaaccattgctcttcatctcaggctttggggttggctggggaaggaggcatcccggggctgggctttctcccaagaacatcagagctgagtagccgacaaactcactttggggccgtgggctggaagggaccatctgatgccccagagctctggcttggccttctccctctgcctttaattcacgttgaacgctgggtacctcactcatcccaagttcttcaacactgagcaaatgcaaggatagcacagtactgagccaaccatagactccccacaaggagttgctgttgttattaacaggaagccagagaatcagcagggtgggttagtgagggatccgggaatagctgtgactggagcctgcataaacagctctgaagggagagagaagactgggctctcttgtgtgccaggcacagtatggaaggcttcatataagttaagctgaaattagccctgttttacatacagcttcattttacatatgaggaaactgaggctttgaaaaaaatgagatgtcttgtccaagatgaaaagtagtagattcaaccaagtcctcttactctaagcccaacgcttttacccaaaaccccagagtcctcatcagggatgccaaatggttctagacccagtggaggttctggagctgccactggggatttaatttcttttgatttgctaaagatttgacctgactgaatggagaggtagagtgtagtgtggccaggacaaggtgagggaggctgtagagacttagcactttaggccaaccacctccaggaaatctgggaaatgcaatgtgacagctcgggctctgcactccagggggctgtctggtgtccacatggaccttctccatgtgggacacagctggaacaagggggcaggggcctgcagctgggatgcccaggtgaatatgggcagctggacaaacaacactgggattgagtcagatagaaggggcccaaggactccagggctgggaggacagaggctgggagagagggctcttacctccttaggcctcccaaagagcggttagggatgctgccatggatggcatggcagggggaaccctcctggaagaaaatccatctcttctgaagggatctgagatgcggctggtttttcaatggcagaacttccctctgcagcgcgactccgaatccatgacatctgagagtcttcctgaccacaaacctctgggatcccgagggctccctacccaagaatcactttgagcacagcatcccaaggagcccatagagcgatcccttgcattcacagccacagcccctctggggacactctgtacccccggcagaccctttccaactcacaaccaataaaggggcttgggctgtgctttgactaaggtga

SEQ ID NO: 163372 - DNA, 3633 bp, Homo sapiens
  Payload ID: 12184
  Gene Symbol: PAX8
  Gene Name: paired box 8
  Uniprot ID: Q06710
  ENST ID: ENST00000397647
  CDS Start-End: 157-1020
ttcagaaggaggagagacaccgggcccagggcaccctcgcgggcggacccaagcagtgagggcctgcagccggccggccagggcagcggcaggcgcggcccggacctacgggaggaagccccgagccctcggcgggctgcgagcgactccccggcgatgcctcacaactccatcagatctggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaatagaatcatccggaccaaagtgcagcaaccattcaacctccctatggacagctgcgtggccaccaagtccctgagtcccggacacacgctgatccccagctcagctgtaactcccccggagtcaccccagtcggattccctgggctccacctactccatcaatgggctcctgggcatcgctcagcctggcagcgacaagaggaaaatggatgacagtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcaggaagtgaatactctggcaatgcctatggccacaccccctactcctcctacagcgaggcctggcgcttccccaactccagcttgctgagttccccatattattacagttccacatcaaggccgagtgcaccgcccaccactgccacggcctttgaccatctgtagttgccatggggacagtgggagcgactgagcaacaggaggactcagcctgggacaggccccagagagtcacacaaaggaatctttatttattacatgaaaaataaccacaagtccagcattgcggcacactccctgtgtggttaatttaatgaaccatgaaagacaggatgaccttggacaaggccaaactgtcctccaagactccttaatgaggggcaggagtcccagggaaagagaaccatgccatgctgaaaaagacaaaattgaagaagaaatgtagcccccagccggtacccaccaaaggagagaagaagcaatagccgaggaacttggggggatggcgaatggttcctgcccgggcccaaggggtgcacagggcacctccatggctccattattaacacaactctagcaattatggaccataagcacttccctccagcccacaagtcacagcctggtgccgaggctctcctcaccagccacccagggagtcacctccctcagcctcccgcctgccccacacggaggctctggctgtcctctttctccactccatttgcttggctctttctacacctccctcttgggcatgggctgagggctggagcgagtccctcagaaattccaccaggctgtcagctgacctcttttgcctgctgctgtgaaggtatagcaccaccccaggtcctcctgcagtgcggcatccccttggcagctgccgtcagccaggccagccccagggagcttaaaacagacattccacagggcctgggcccctgggaggtgaggtgtggtgtgcggcttcacccagggcagaacaaggcagaatcgcaggaaacccgcttccccttcctgacagctcctgccaagccaaatgtgcttcctgcagctcacgcccaccagctactgaagggacccaaggcaccccctgaagccagcgatagagggtccctctctgctccccagcagctcctgcccccaaggcctgactgtatatactgtaaatgaaactttgtttgggtcaagcttccttctttctaacccccagactttggcctctgagtgaaatgtctctctttgccctgtggggcttctctccttgatgcttctttctttttttaaagacaacctgccattaccacatgactcaataaaccattgctcttcatctcaggctttggggttggctggggaaggaggcatcccggggctgggctttctcccaagaacatcagagctgagtagccgacaaactcactttggggccgtgggctggaagggaccatctgatgccccagagctctggcttggccttctccctctgcctttaattcacgttgaacgctgggtacctcactcatcccaagttcttcaacactgagcaaatgcaaggatagcacagtactgagccaaccatagactccccacaaggagttgctgttgttattaacaggaagccagagaatcagcagggtgggttagtgagggatccgggaatagctgtgactggagcctgcataaacagctctgaagggagagagaagactgggctctcttgtgtgccaggcacagtatggaaggcttcatataagttaagctgaaattagccctgttttacatacagcttcattttacatatgaggaaactgaggctttgaaaaaaatgagatgtcttgtccaagatgaaaagtagtagattcaaccaagtcctcttactctaagcccaacgcttttacccaaaaccccagagtcctcatcagggatgccaaatggttctagacccagtggaggttctggagctgccactggggatttaatttcttttgatttgctaaagatttgacctgactgaatggagaggtagagtgtagtgtggccaggacaaggtgagggaggctgtagagacttagcactttaggccaaccacctccaggaaatctgggaaatgcaatgtgacagctcgggctctgcactccagggggctgtctggtgtccacatggaccttctccatgtgggacacagctggaacaagggggcaggggcctgcagctgggatgcccaggtgaatatgggcagctggacaaacaacactgggattgagtcagatagaaggggcccaaggactccagggctgggaggacagaggctgggagagagggctcttacctccttaggcctcccaaagagcggttagggatgctgccatggatggcatggcagggggaaccctcctggaagaaaatccatctcttctgaagggatctgagatgcggctggtttttcaatggcagaacttccctctgcagcgcgactccgaatccatgacatctgagagtcttcctgaccacaaacctctgggatcccgagggctccctacccaagaatcactttgagcacagcatcccaaggagcccatagagcgatcccttgcattcacagccacagcccctctggggacactctgtacccccggcagaccctttccaactcacaaccaataaaggggcttgggctgtgctttgactaaggtga

SEQ ID NO: 163373 - DNA, 4084 bp, Homo sapiens
  Payload ID: 12184
  Gene Symbol: PAX8
  Gene Name: paired box 8
  Uniprot ID: Q06710
  ENST ID: ENST00000429538
  CDS Start-End: 196-1548
ataaaaccggtcggtgatgccgggtggatgggaacaaacttcagaaggaggagagacaccgggcccagggcaccctcgcgggcggacccaagcagtgagggcctgcagccggccggccagggcagcggcaggcgcggcccggacctacgggaggaagccccgagccctcggcgggctgcgagcgactccccggcgatgcctcacaactccatcagatctggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaatagaatcatccggaccaaagtgcagcaaccattcaacctccctatggacagctgcgtggccaccaagtccctgagtcccggacacacgctgatccccagctcagctgtaactcccccggagtcaccccagtcggattccctgggctccacctactccatcaatgggctcctgggcatcgctcagcctggcagcgacaagaggaaaatggatgacagtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcagggcctctacccgctgcccttgctcaacagcaccctggacgacgggaaggccaccctgaccccttccaacacgccactggggcgcaacctctcgactcaccagacctaccccgtggtggcagatcctcactcacccttcgccataaagcaggaaacccccgaggtgtccagttctagctccaccccttcctctttatctagctccgcctttttggatctgcagcaagtcggctccggggtcccgcccttcaatgcctttccccatgctgcctccgtgtacgggcagttcacgggccaggccctcctctcagggcgagagatggtggggcccacgctgcccggatacccaccccacatccccaccagcggacagggcagctatgcctcctctgccatcgcaggcatggtggcaggaagtgaatactctggcaatgcctatggccacaccccctactcctcctacagcgaggcctggcgcttccccaactccagcttgctgagttccccatattattacagttccacatcaaggccgagtgcaccgcccaccactgccacggcctttgaccatctgtagttgccatggggacagtgggagcgactgagcaacaggaggactcagcctgggacaggccccagagagtcacacaaaggaatctttatttattacatgaaaaataaccacaagtccagcattgcggcacactccctgtgtggttaatttaatgaaccatgaaagacaggatgaccttggacaaggccaaactgtcctccaagactccttaatgaggggcaggagtcccagggaaagagaaccatgccatgctgaaaaagacaaaattgaagaagaaatgtagcccccagccggtacccaccaaaggagagaagaagcaatagccgaggaacttggggggatggcgaatggttcctgcccgggcccaaggggtgcacagggcacctccatggctccattattaacacaactctagcaattatggaccataagcacttccctccagcccacaagtcacagcctggtgccgaggctctcctcaccagccacccagggagtcacctccctcagcctcccgcctgccccacacggaggctctggctgtcctctttctccactccatttgcttggctctttctacacctccctcttgggcatgggctgagggctggagcgagtccctcagaaattccaccaggctgtcagctgacctcttttgcctgctgctgtgaaggtatagcaccaccccaggtcctcctgcagtgcggcatccccttggcagctgccgtcagccaggccagccccagggagcttaaaacagacattccacagggcctgggcccctgggaggtgaggtgtggtgtgcggcttcacccagggcagaacaaggcagaatcgcaggaaacccgcttccccttcctgacagctcctgccaagccaaatgtgcttcctgcagctcacgcccaccagctactgaagggacccaaggcaccccctgaagccagcgatagagggtccctctctgctccccagcagctcctgcccccaaggcctgactgtatatactgtaaatgaaactttgtttgggtcaagcttccttctttctaacccccagactttggcctctgagtgaaatgtctctctttgccctgtggggcttctctccttgatgcttctttctttttttaaagacaacctgccattaccacatgactcaataaaccattgctcttcatctcaggctttggggttggctggggaaggaggcatcccggggctgggctttctcccaagaacatcagagctgagtagccgacaaactcactttggggccgtgggctggaagggaccatctgatgccccagagctctggcttggccttctccctctgcctttaattcacgttgaacgctgggtacctcactcatcccaagttcttcaacactgagcaaatgcaaggatagcacagtactgagccaaccatagactccccacaaggagttgctgttgttattaacaggaagccagagaatcagcagggtgggttagtgagggatccgggaatagctgtgactggagcctgcataaacagctctgaagggagagagaagactgggctctcttgtgtgccaggcacagtatggaaggcttcatataagttaagctgaaattagccctgttttacatacagcttcattttacatatgaggaaactgaggctttgaaaaaaatgagatgtcttgtccaagatgaaaagtagtagattcaaccaagtcctcttactctaagcccaacgcttttacccaaaaccccagagtcctcatcagggatgccaaatggttctagacccagtggaggttctggagctgccactggggatttaatttcttttgatttgctaaagatttgacctgactgaatggagaggtagagtgtagtgtggccaggacaaggtgagggaggctgtagagacttagcactttaggccaaccacctccaggaaatctgggaaatgcaatgtgacagctcgggctctgcactccagggggctgtctggtgtccacatggaccttctccatgtgggacacagctggaacaagggggcaggggcctgcagctgggatgcccaggtgaatatgggcagctggacaaacaacactgggattgagtcagatagaaggggcccaaggactccagggctgggaggacagaggctgggagagagggctcttacctccttaggcctcccaaagagcggttagggatgctgccatggatggcatggcagggggaaccctcctggaagaaaatccatctcttctgaagggatctgagatgcggctggtttttcaatggcagaacttccctctgcagcgcgactccgaatccatgacatctgagagtcttcctgaccacaaacctctgggatcccgagggctccctacccaagaatcactttgagcacagcatcccaaggagcccatagagcgatcccttgcattcacagccacagcccctctggggacactctgtacccccggcagaccctttccaactcacaaccaataaaggggcttgggctgtgctttgactaaggtga

SEQ ID NO: 163374 - DNA, 556 bp, Homo sapiens
  Payload ID: 12184
  Gene Symbol: PAX8
  Gene Name: paired box 8
  ENST ID: ENST00000554830
  CDS Start-End: 209-556
gagacaccgggcccagggcaccctcgcgggcggacccaagcagtgagggcctgcagccggccggccagggcagcggcaggcgcggcccggacctacgggaggaagccccgagccctcggcgggctgcgagcgactccccggcgatgcctcacaactccatcagatctgaatcatccggaccaaagtgcagcaaccattcaacctccctatggacagctgcgtggccaccaagtccctgagtcccggacacacgctgatccccagctcagctgtaactcccccggagtcaccccagtcggattccctgggctccacctactccatcaatgggctcctgggcatcgctcagcctggcagcgacaagaggaaaatggatgacagtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcag

SEQ ID NO: 163375 - DNA, 525 bp, Homo sapiens
  Payload ID: 12184
  Gene Symbol: PAX8
  Gene Name: paired box 8
  ENST ID: ENST00000468980
  CDS Start-End: 1-520
cagcagcggaccccgaaagcaccttcgcacggatgccttcagccagcaccacctcgagccgctcgagtgcccatttgagcggcagcactacccagaggcctatgcctcccccagccacaccaaaggcgagcagggcctctacccgctgcccttgctcaacagcaccctggacgacgggaaggccaccctgaccccttccaacacgccactggggcgcaacctctcgactcaccagacctaccccgtggtggcagggcgagagatggtggggcccacgctgcccggatacccaccccacatccccaccagcggacagggcagctatgcctcctctgccatcgcaggcatggtggcaggaagtgaatactctggcaatgcctatggccacaccccctactcctcctacagcgaggcctggcgcttccccaactccagcttgctgagttccccatattattacagttccacatcaaggccgagtgcaccgcccaccactgccacggcctttgaccatctgtagttgcc

SEQ ID NO: 163376 - DNA, 816 bp, Homo sapiens
  Payload ID: 12184
  Gene Symbol: PAX8
  Gene Name: paired box 8
  ENST ID: ENST00000497038
  CDS Start-End: 548-805
agcatgaatagataggtcccctaaaagctttcttccttcccggggggtaccaggtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcagggcctctacccgctgcccttgctcaacagcaccctggacgacgggaaggccaccctgaccccttccaacacgccactggggcgcaacctctcgactcaccagacctaccccgtggtggcagatcctcactcacccttcgccataaagcaggaaacccccgaggtgtccagttctagctccaccccttcctctttatctagctccgcctttttggatctgcagcaagtcggctccggggtcccgcccttcaatgcctttccccatgctgcctccgtgtacgggcagttcacgggccaggccctcctctcagggcgagagatggtggggcccacgctgcccggatacccaccccacatccccaccagcggacagggcagctatgcctcctctgccatcgcaggcatggtggcaggaagtgaatactctggcaatgcctatggccacaccccctactcctcctacagcgaggcctggcgcttccccaactccagcttgctgagttccccatattattacagttccacatcaaggccgagtgcaccgcccaccactgccacggcctttgaccatctgtagttgccatgggg

SEQ ID NO: 163377 - DNA, 656 bp, Homo sapiens
  Payload ID: 12184
  Gene Symbol: PAX8
  Gene Name: paired box 8
  ENST ID: ENST00000465084
  CDS Start-End: 1-295
ccatgctgcctccgtgtacgggcagttcacgggccaggccctcctctcagggcgagagatggtggggcccacgctgcccggatacccaccccacatccccaccagcggacagggcagctatgcctcctctgccatcgcaggcatggtggcaggtaaggagagggccggcaggaaggggagcactgcaaagaggaagtattggagcaaggaagtgaatactctggcaatgcctatggccacaccccctactcctcctacagcgaggcctggcgcttccccaactccagcttgctgagttccccatattattacagttccacatcaaggccgagtgcaccgcccaccactgccacggcctttgaccatctgtagttgccatggggacagtgggagcgactgagcaacaggaggactcagcctgggacaggccccagagagtcacacaaaggaatctttatttattacatgaaaaataaccacaagtccagcattgcggcacactccctgtgtggttaatttaatgaaccatgaaagacaggatgaccttggacaaggccaaactgtcctccaagactccttaatgaggggcaggagtcccagggaaagagaaccatgccatgctgaaaaagacaaaattgaagaagaaatgtagcccc

SEQ ID NO: 163378 - DNA, 4514 bp, Homo sapiens
  Payload ID: 12185
  Gene Symbol: PAX9
  Gene Name: paired box 9
  Uniprot ID: P55771
  ENST ID: ENST00000361487
  CDS Start-End: 226-1251
agcccacgttgctgcttagattgaaatgcagaactcaagcctctttcatcggggcacagacttccttttacttcttccttttgccctctcgcctcctcctcctgggaagaagcggaggcgccggcggtcggccgggatagcaacaggccgggccactgaggcggtgcggaaagtttctgtctgggagtgcggaactggggccgggttggtgtactgctcggagcaatggagccagccttcggggaggtgaaccagctgggaggagtgttcgtgaacgggaggccgctgcccaacgccatccggcttcgcatcgtggaactggcccaactgggcatccgaccgtgtgacatcagccgccagctacgggtctcgcacggctgcgtcagcaagatcctggcgcgatacaacgagacgggctcgatcttgccaggagccatcgggggcagcaagccccgggtcactacccccaccgtggtgaaacacatccggacctacaagcagagagaccccggcatcttcgcctgggagatccgggaccgcctgctggcggacggcgtgtgcgacaagtacaatgtgccctccgtgagctccatcagccgcattctgcgcaacaagatcggcaacttggcccagcagggtcattacgactcatacaagcagcaccagccgacgccgcagccagcgctgccctacaaccacatctactcgtaccccagccctatcacggcggcggccgccaaggtgcccacgccacccggggtgcctgccatccccggttcggtggccatgccgcgcacctggccctcctcgcactccgtcaccgacatcctgggcatccgctccatcaccgaccaagtgagcgacagctccccctaccacagccccaaggtggaggagtggagcagcctgggccgcaacaacttccccgccgccgccccgcacgcggtgaacgggttggagaagggagccctggagcaggaagccaagtacggtcaggcaccaaatggtctcccagctgtgggcagttttgtgtcagcatccagcatggctccttaccctaccccagcccaagtgtcgccttacatgacctacagtgctgctccttctggttatgttgctggacatgggtggcaacatgctgggggcacctcattgtctccccacaactgtgacattccggcatcgctggcgttcaagggaatgcaggcagccagagaaggtagtcattctgtcacggcttccgcgctctgatgggaaattccgtctccagcagcttcacccgggtctccctgtctcagcacctcctcccccaattcccaggtctcacatcccacccctcctgccctccaacccttctgccttgaaagctggctgtacggactcacatcctttgtgctaatgacacttacatatttcttgccataacttttctcttgcagaaaaactgacatgactttaggatttaaaaacaagagcaacaataagcattgaatgagacatttgtgttgcccacatactgtcttaacataacaaagaaacctacacccctcaaagggtttaaggaactttacaaactagtctttggtaaaaccacatgtgtatatttattctaaatcaacctgaacttttgaaatgtgcaattgttgagattttgcaaaatcaataaaggaaaatacttatagaaaaaattatgctacaccctctaatcaaatatggtaaccaagtaagctttaattcatcattaggaaacaaatcaataagtgacttgtttgagtgatcctttgtttaagacatgacctattttgttgaaaaatatatgtagaacccaagcaatatctgaatctagctctccctggtgttttgacttggttccaaatacaataatgtttatattttctattagtttgtaaatacggactctggatggtgcatttgtgtcttcattccataagatattcccctcccctcagccccaccccctctctatttttttctttcttttttgcaaaggtgactttctggcaacgtctttgtctctgtttggtggtgggctgctcgggctcctggacctggacttgcccccaaattttgtgtatgcagtgaaggcttcaacatctcatgaaggacactttatttctacagcagaggacacgaaaaacagataaaacaagccagtctcccattttgtacctaatcaaacaacacacatgctaagcatataaagacaagagggtggaaaatatctgaacaagaaggctctaaaggaagtcacttagaaacttaagtttaatgtgaaatgttttgcaaagatgcttaaaatgaactttgtgttaagaaaaccactgtgaaactaaattgtcctattattgttggcttacctgtgtgttcagcaatctcagccccaaataatgttgtaatttaaagaaaatggaaaattctgctctaatgaatgtaacaatggcttgctgtgaagtttacattgttgtacagaagcatgtttcgcatgtaggtaaactggtggtggtactagaaatacaatgttatttaattttaacaaattccctttattcatttctgaaattacaggacacagtttaactcataaacctttctagaccaatttatttttcactttaatgttaataacagttgtggagtatatgtgtgtgtgagcatgtgagtatgtgttgtattttaaaacaattgattttctggggcaaaattctacagtttttaatcccttctgtttaggaagttcttcctgtttggcaatataggcttaaaaatatgtttttaggacattggtacaattcagctgttggaaaattaatatattgagggttttttggtactaattctgtgcaataactaaaagagcacctcactggatatggatgttgaagatggattccctaggtgattttaatttcttccggtctgtgctgtgcacagtctacatggcaatgcggttccaccacatcggtttcgtggcttcgtttaaaactcagatggctagattagttaggttttcaaatcactaggatgtaaacagtaagcagatttctgacacacaaattatgttagagtgactgcttttttcagacagcagatatcttatagagagctttgaactgcatttatttctaaagcaaccgaaattcagtgctacaaatagaggattataacttcaggagaagaataagcagaaggagcagatgaactctcagggccatagtcttcctttgatcttgtaaaacttccattgacatctggagttcccagtctggtgagaaaatagactataaactgaatggaacaaagatccaatccaatattttggtggagacttctttaaaaccataccatacagggactctcctgtcatctgaaaaactgatgtaaggtacagaactattctttatcaaatgtttttaggtggctgttagggggctttaaaaaatattacttgcttgtgtggaaatgcaaataatgttattttctttatctaaattaagaaatctcttgttattgtgctatttataatttttttctggttcttgtattttaaaaaatctaatattaatggtattgaagtttccttttctccctctaggtcttaacagtgaattcacatggagtaatttttaaaagatatcagatacaatttgctattcaaagaaaattatgatttaaagccactttttaaaatacgagaaggaaaataggatggattaaagggttaacttttaaagattattattggttaatgttgacatatttcctctatctcatagatggtaaaagtgttgcttttaaactggcaaatgcactcttcagaaatccttttctatctgatccacatggagaggttaaaggttcaatttcatgacctctatgcaggcagcgctctcattggatgtaagaatattacctgcaaggatagaatgcagttgtgcaacagagacacattcttatttcttttttttcacaattttgttttgtttttaatgacccttttattgaatattggactgaaatataaattttaaaaaacacgttggaaaggatgtacaacagaaggctatgtatgtatatacagtatgtcaaaagccttttatttttatacttcaaatgctctaaattaataaaaagtaataattaccatgttatcttttactttttattttcaaaatgctttagtgaaatagccccgtagtagaaatagcccacggtagtaacttaggacaggtgtcatatggactttcagttattcttgttgactttactgaatcagcatcatctctggatgcagatataaaatcaagtttggttacatcaagaccaaggagatatttttgttgatacatgttagtatagtaatccttagaaatgctaagtgtatttctttttcagaacatttccccttcatcatacatattttaatactgcagacagctgacttcccacctgaagttgtcgtttaaaactaataacctgaaaatgcagttctgttc

SEQ ID NO: 163379 - DNA, 3104 bp, Homo sapiens
  Payload ID: 12185
  Gene Symbol: PAX9
  Gene Name: paired box 9
  Uniprot ID: P55771
  ENST ID: ENST00000402703
  CDS Start-End: 727-1752
ccctcccctgctctcgcaaggagaaagcgggcgacgagcgctcgcagcccgtggggctgatcccacctcccgcagggctccggtcgtgtcgctgtcggaccgcagaacgccgggacgcatttccgagctcgggcccgacccaacccgctgccattctagctacctagtggagccgcggagagactcttgaaccgtgaggctccttgatgagaaggtggagaggctgccgggctattctccgagcatcttccggccgagctctgctcctctccgtgcgcttgcggcttctccttgggctagcgcgtccgcagtccctccaagtccaggccgcagtcacccaggtggggagctagcctgaaagagacagcggaaggagtttcctggactgcgctgtcgctcaccgacccgcaccaatcaccatgcagcttgccctcggacccgccccttttagggcgtgtccccagtgagtgatagacggagccgccctgccctgctcagcccagcccacgttgctgcttagattgaaatgcagaactcaagcctctttcatcggggcacagacttccttttacttcttccttttgccctctcgcctcctcctcctgggaagaagcggaggcgccggcggtcggccgggatagcaacaggccgggccactgaggcggtgcggaaagtttctgtctgggagtgcggaactggggccgggttggtgtactgctcggagcaatggagccagccttcggggaggtgaaccagctgggaggagtgttcgtgaacgggaggccgctgcccaacgccatccggcttcgcatcgtggaactggcccaactgggcatccgaccgtgtgacatcagccgccagctacgggtctcgcacggctgcgtcagcaagatcctggcgcgatacaacgagacgggctcgatcttgccaggagccatcgggggcagcaagccccgggtcactacccccaccgtggtgaaacacatccggacctacaagcagagagaccccggcatcttcgcctgggagatccgggaccgcctgctggcggacggcgtgtgcgacaagtacaatgtgccctccgtgagctccatcagccgcattctgcgcaacaagatcggcaacttggcccagcagggtcattacgactcatacaagcagcaccagccgacgccgcagccagcgctgccctacaaccacatctactcgtaccccagccctatcacggcggcggccgccaaggtgcccacgccacccggggtgcctgccatccccggttcggtggccatgccgcgcacctggccctcctcgcactccgtcaccgacatcctgggcatccgctccatcaccgaccaagtgagcgacagctccccctaccacagccccaaggtggaggagtggagcagcctgggccgcaacaacttccccgccgccgccccgcacgcggtgaacgggttggagaagggagccctggagcaggaagccaagtacggtcaggcaccaaatggtctcccagctgtgggcagttttgtgtcagcatccagcatggctccttaccctaccccagcccaagtgtcgccttacatgacctacagtgctgctccttctggttatgttgctggacatgggtggcaacatgctgggggcacctcattgtctccccacaactgtgacattccggcatcgctggcgttcaagggaatgcaggcagccagagaaggtagtcattctgtcacggcttccgcgctctgatgggaaattccgtctccagcagcttcacccgggtctccctgtctcagcacctcctcccccaattcccaggtctcacatcccacccctcctgccctccaacccttctgccttgaaagctggctgtacggactcacatcctttgtgctaatgacacttacatatttcttgccataacttttctcttgcagaaaaactgacatgactttaggatttaaaaacaagagcaacaataagcattgaatgagacatttgtgttgcccacatactgtcttaacataacaaagaaacctacacccctcaaagggtttaaggaactttacaaactagtctttggtaaaaccacatgtgtatatttattctaaatcaacctgaacttttgaaatgtgcaattgttgagattttgcaaaatcaataaaggaaaatacttatagaaaaaattatgctacaccctctaatcaaatatggtaaccaagtaagctttaattcatcattaggaaacaaatcaataagtgacttgtttgagtgatcctttgtttaagacatgacctattttgttgaaaaatatatgtagaacccaagcaatatctgaatctagctctccctggtgttttgacttggttccaaatacaataatgtttatattttctattagtttgtaaatacggactctggatggtgcatttgtgtcttcattccataagatattcccctcccctcagccccaccccctctctatttttttctttcttttttgcaaaggtgactttctggcaacgtctttgtctctgtttggtggtgggctgctcgggctcctggacctggacttgcccccaaattttgtgtatgcagtgaaggcttcaacatctcatgaaggacactttatttctacagcagaggacacgaaaaacagataaaacaagccagtctcccattttgtacctaatcaaacaacacacatgctaagcatataaagacaagagggtggaaaatatctgaacaagaaggctctaaaggaagtcacttagaaacttaagtttaatgtgaaatgttttgcaaagatgcttaaaatgaactttgtgttaagaaaaccactgtgaaactaaattgtcctattattgttggcttacctgtgtgttcagcaatctcagccccaaataatgttgtaatttaaagaaaatggaaaattctgctctaatgaatgtaacaatggcttgctgtgaagtttacattgttgtacagaagcatgtttcgcatgtaggtaaactggtggtggtactagaaatacaatgttatttaattttaacaaattccctttattcatttctgaaattacaggacacagtttaactcat

SEQ ID NO: 163380 - DNA, 1289 bp, Homo sapiens
  Payload ID: 12185
  Gene Symbol: PAX9
  Gene Name: paired box 9
  ENST ID: ENST00000554201
  CDS Start-End: 881-1171
aggagcacgttcaggcgtcaagaccgatttctccccctgcttcgggagacttttgaacgctcggagaggcccggcatctcaccactttacttggccgtaggggcctccggcacggcaggaatgagggagggggtccgattggacagtgacggtttggggccgttcggctatgttcagggaccatatggtttggggacagccccagtagttagtaggggacgggtgcgttcgcccagtccccggatgcgtagggaggcccagtggcaggcagctgtcccaagcagcgggtgcgcgtccctgcgcgctgtgtgttcattttgcagagccagccttcggggaggtgaaccagctgggaggagtgttcgtgaacgggaggccgctgcccaacgccatccggcttcgcatcgtggaactggcccaactgggcatccgaccgtgtgacatcagccgccagctacgggtctcgcacggctgcgtcagcaagatcctggcgcgatacaacgagacgggctcgatcttgccaggagccatcgggggcagcaagccccgggtcactacccccaccgtggtgaaacacatccggacctacaagcagagagaccccggcatcttcgcctgggagatccgggaccgcctgctggcggacggcgtgtgcgacaagtacaatgtgccctccgtgagctccatcagccgcattctgcgcaacaagatcggcaacttggcccagcagggtcattacgactcatacaagcagcaccagccgacgccgcagccagcgctgccctacaaccacatctactcgtaccccagccctatcacggcggcggccgccaaggtgcccacgccacccggggtgcctgccatccccggttcggtggccatgccgcgcacctggccctcctcgcactccgtcaccgacatcctgggcatccgctccatcaccgaccaagtgagcgacagctccccctaccacagccccaaggtggaggagtggagcagcctgggccgcaacaacttccccgccgccgccccgcacgcggtgaacgggttggagaagggagccctggagcaggaagccaagcaccaaatggtctcccagctgtgggcagttttgtgtcagcatccagcatggctccttaccctaccccagcccaagtgtcgccttacatgacctacagtgctgctccttctggttatgttgctggacatgggtggcaacatgctgggggcacctcattgtctccccacaactgtgacattccggcatcgctggcgttcaagggaatgca

SEQ ID NO: 163381 - DNA, 1316 bp, Homo sapiens
  Payload ID: 12186
  Gene Symbol: PILRA
  Gene Name: paired immunoglobin-like type 2 receptor alpha
  Uniprot ID: Q9UKJ1
  ENST ID: ENST00000198536
  CDS Start-End: 213-1124
aataggggaaaataagccagatggataaaggaagtgctggtcaccctggaggtgcactggtttggggaaggctcctggcccccacagccctcttcggagcctgagcccggctctcctcactcacctcaacccccaggcggcccctccacagggcccctctcctgcctggacggctctgctggtctccccgtcccctggagaagaacaaggccatgggtcggcccctgctgctgcccctactgcccttgctgctgccgccagcatttctgcagcctagtggctccacaggatctggtccaagctacctttatggggtcactcaaccaaaacacctctcagcctccatgggtggctctgtggaaatccccttctccttctattacccctgggagttagccacagctcccgacgtgagaatatcctggagacggggccacttccacaggcagtccttctacagcacaaggccgccttccattcacaaggattatgtgaaccggctctttctgaactggacagagggtcagaagagcggcttcctcaggatctccaacctgcagaagcaggaccagtctgtgtatttctgccgagttgagctggacacacggagctcagggaggcagcagtggcagtccatcgaggggaccaaactctccatcacccaggctgtcacgaccaccacccagaggcccagcagcatgactaccacctggaggctcagtagcacaaccaccacaaccggcctcagggtcacacagggcaaacgacgctcagactcttggcacataagtctggagactgctgtgggggtggcagtggctgtcactgtgctcggaatcatgattttgggactgatctgcctcctcaggtggaggagaaggaaaggtcagcagcggactaaagccacaaccccagccagggaacccttccaaaacacagaggagccatatgagaatatcaggaatgaaggacaaaatacagatcccaagctaaatcccaaggatgacggcatcgtctatgcttcccttgccctctccagctccacctcacccagagcacctcccagccaccgtcccctcaagagcccccagaacgagaccctgtactctgtcttaaaggcctaaccaatggacagccctctcaagactgaatggtgaggccaggtacagtggcgcacacctgtaatcccagctactctgaagcctgaggcagaatcaagtgagcccaggagttcagggccagctttgataatggagcgagatgccatctctagttaaaaatatatattaacaataaagtaacaaatttaaaaagat

SEQ ID NO: 163382 - DNA, 1011 bp, Homo sapiens
  Payload ID: 12186
  Gene Symbol: PILRA
  Gene Name: paired immunoglobin-like type 2 receptor alpha
  Uniprot ID: Q9UKJ1
  ENST ID: ENST00000350573
  CDS Start-End: 130-822
acagccctcttcggagcctgagcccggctctcctcactcacctcaacccccaggcggcccctccacagggcccctctcctgcctggacggctctgctggtctccccgtcccctggagaagaacaaggccatgggtcggcccctgctgctgcccctactgcccttgctgctgccgccagcatttctgcagcctagtggctccacaggatctggtccaagctacctttatggggtcactcaaccaaaacacctctcagcctccatgggtggctctgtggaaatccccttctccttctattacccctgggagttagccacagctcccgacgtgagaatatcctggagacggggccacttccacaggcagtccttctacagcacaaggccgccttccattcacaaggattatgtgaaccggctctttctgaactggacagagggtcagaagagcggcttcctcaggatctccaacctgcagaagcaggaccagtctgtgtatttctgccgagttgagctggacacacggagctcagggaggcagcagtggcagtccatcgaggggaccaaactctccatcacccagggtcagcagcggactaaagccacaaccccagccagggaacccttccaaaacacagaggagccatatgagaatatcaggaatgaaggacaaaatacagatcccaagctaaatcccaaggatgacggcatcgtctatgcttcccttgccctctccagctccacctcacccagagcacctcccagccaccgtcccctcaagagcccccagaacgagaccctgtactctgtcttaaaggcctaaccaatggacagccctctcaagactgaatggtgaggccaggtacagtggcgcacacctgtaatcccagctactctgaagcctgaggcagaatcaagtgagcccaggagttcagggccagctttgataatggagcgagatgccatctctagttaaaaatatatattaacaataaagtaacaaatttaaaaa

SEQ ID NO: 163383 - DNA, 909 bp, Homo sapiens
  Payload ID: 12186
  Gene Symbol: PILRA
  Gene Name: paired immunoglobin-like type 2 receptor alpha
  Uniprot ID: Q9UKJ1
  ENST ID: ENST00000394000
  CDS Start-End: 130-657
acagccctcttcggagcctgagcccggctctcctcactcacctcaacccccaggcggcccctccacagggcccctctcctgcctggacggctctgctggtctccccgtcccctggagaagaacaaggccatgggtcggcccctgctgctgcccctactgcccttgctgctgccgccagcatttctgcagcctagtggctccacaggatctggtccaagctacctttatggggtcactcaaccaaaacacctctcagcctccatgggtggctctgtggaaatccccttctccttctattacccctgggagttagccacagctcccgacgtgagaatatcctggagacggggccacttccacaggcagtccttctacagcacaaggccgccttccattcacaaggattatgtgaaccggctctttctgaactggacagagggtcagaagagcggcttcctcaggatctccaacctgcagaagcaggaccagtctgtgtatttctgccgagttgagctggacacacggagctcagggaggcagcagtggcagtccatcgaggggaccaaactctccatcacccaggggaacccttccaaaacacagaggagccatatgagaatatcaggaatgaaggacaaaatacagatcccaagctaaatcccaaggatgacggcatcgtctatgcttcccttgccctctccagctccacctcacccagagcacctcccagccaccgtcccctcaagagcccccagaacgagaccctgtactctgtcttaaaggcctaaccaatggacagccctctcaagactgaatggtgaggccaggtacagtggcgcacacctgtaatcccagctactctgaagcctgaggcagaatcaagtgagcccaggagttcagggccagctt

SEQ ID NO: 163384 - DNA, 1043 bp, Homo sapiens
  Payload ID: 12186
  Gene Symbol: PILRA
  Gene Name: paired immunoglobin-like type 2 receptor alpha
  ENST ID: ENST00000453419
  CDS Start-End: 200-880
aagccagatggataaaggaagtgctggtcaccctggaggtgcactggtttggggaaggctcctggcccccacagccctcttcggagcctgagcccggctctcctcactcacctcaacccccaggcggcccctccacagggcccctctcctgcctggacggctctgctggtctccccgtcccctggagaagaacaaggccatgggtcggcccctgctgctgcccctactgcccttgctgctgccgccagcatttctgcagcctagtggctccacaggatctggtccaagctacctttatggggtcactcaaccaaaacacctctcagcctccatgggtggctctgtggaaatccccttctccttctattacccctgggagttagccacagctcccgacgtgagaatatcctggagacggggccacttccacaggcagtccttctacagcacaaggccgccttccattcacaaggattatgtgaaccggctctttctgaactggacagagggtcagaagagcggcttcctcaggatctccaacctgcagaagcaggaccagtctgtgtatttctgccgagttgagctggacacacggagctcagggaggcagcagtggcagtccatcgaggggaccaaactctccatcacccagggtcagcagcggactaaagccacaaccccagccagggaacccttccaaaacacagaggagccatatgagaatatcaggaatgaaggacaaaatacagatcccaagctaaatcccaagctccacctcacccagagcacctcccagccaccgtcccctcaagagcccccagaacgagaccctgtactctgtcttaaaggcctaaccaatggacagccctctcaagactgaatggtgaggccaggtacagtggcgcacacctgtaatcccagctactctgaagcctgaggcagaatcaagtgagcccaggagttcagggccagctttgataatggagcgagatgccatctctagttaaaaatatatattaacaataaagtaacaaatttaaaaa

SEQ ID NO: 163385 - DNA, 664 bp, Homo sapiens
  Payload ID: 12186
  Gene Symbol: PILRA
  Gene Name: paired immunoglobin-like type 2 receptor alpha
  ENST ID: ENST00000432297
  CDS Start-End: 165-664
gctgggtccctgaatcaccgactggaggagagttacctacaagagccttcatccaggagcatccacactgcaatgatataggaatgaggcggcccctccacagggcccctctcctgcctggacggctctgctggtctccccgtcccctggagaagaacaaggccatgggtcggcccctgctgctgcccctactgcccttgctgctgccgccagcatttctgcagcctagtggctccacaggatctggtccaagctacctttatggggtcactcaaccaaaacacctctcagcctccatgggtggctctgtggaaatccccttctccttctattacccctgggagttagccacagctcccgacgtgagaatatcctggagacggggccacttccacaggcagtccttctacagcacaaggccgccttccattcacaaggattatgtgaaccggctctttctgaactggacagagggtcagaagagcggcttcctcaggatctccaacctgcagaagcaggaccagtctgtgtatttctgccgagttgagctggacacacggagctcagggaggcagcagtggcagtccatcgaggggaccaaactctccatcacccagggtcagcagcggactaaagccacaaccccagccagggaacccttcca

SEQ ID NO: 163386 - DNA, 1599 bp, Homo sapiens
  Payload ID: 12187
  Gene Symbol: PILRB
  Gene Name: paired immunoglobin-like type 2 receptor beta
  ENST ID: ENST00000422808
  CDS Start-End: 1217-1599
tgaagacttcctgcgatgagaacagaggcacaggtgccggccctgcagcccccagaacccggactggagggggccatggggcgccggaccctggccctgccctgggtgctgctgaccctgcgtgtcactgcagggaccccggaggtgtgagtacaagttcggatggaggccaccgagctctcgtccttcaccatccgttgtgggttcctggagtctggctccatctccctggtgactgtgagcagggggggccccgatggtgctggggggaccacgctggctgtgttgcacccggaacttggcatccagcaatgggcccctgctcgccaggcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccagggctctctgtcccgccgactcctgcccccattctgcgggcagacctggccgggatcttgggggtctcaggagtccttctctttgactgtggctacctccttcatctgctgtgccgacagaagcaccgccctgcccctaggctccagccatcccacaccagctcctaggcactgagagcacgagcatgggcacccagccaggcctcccaggctgctctccacgtcccttatgccactatcaacaccagctgctgcccagctactttggacacagctcacccccgacagggggccgtcctgtcgtttcctgctgtgactaagtcagcaacacagttcctctgacatgggccttggctgtgcttctttgggggtgaagagattggggaggaagtctccacccctgggaggcagaagccaggcatagcgcgctggctaggactccagtaccgtgaagggaggcagtgagagcagacatctgtgcctcattcctgatctcaaggggaaagcaagaacaagggaggcttcctcaggatctcgaacctgcggaaggaggaccagtctgtgtacttctgccaagtccagctggacatacagatcagggaggctgtcgtggcagtccatcaaggggacccacctcaccatcacccaggccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctggtggctccacaggatctggtccaagctacctttatggggtcactcaaccaaaacacctctcagcctccatgggtggctctgtggaaatccccttctccttctattacccctgggagttagccatagttcccaacgtgagaatatcctggagacggggccacttccacgggcagtccttctacagcacaaggccgccttccattcacaaggattatgtgaaccggctctttctgaactggacagagggtcaggagagcggcttcctcaggatctcaaacctgcggaaggaggaccagtctgtgtatttctgccgagtcga

SEQ ID NO: 163387 - DNA, 2099 bp, Homo sapiens
  Payload ID: 12187
  Gene Symbol: PILRB
  Gene Name: paired immunoglobin-like type 2 receptor beta
  Uniprot ID: Q9UKJ0
  ENST ID: ENST00000452089
  CDS Start-End: 1060-1743
tgagttctcacccacctgtgccgccctgccttgttacctggaagcacagccttggggactgagcaggccctcactgtcactttaagaagggaatcagccactttgtgctcaccacctctggggaaggtgtgagaggagagaaggaagtggctgtttggctgctgacaacatgaagacttcctgcgatgagaacagaggcacaggtgccggccctgcagcccccagaacccggactggagggggccatggggcgccggaccctggccctgccctgggtgctgctgaccctgcgtgtcactgcagggaccccggaggtgtgagtacaagttcggatggaggccaccgagctctcgtccttcaccatccgttgtgggttcctggagtctggctccatctccctggtgactgtgagcagggggggccccgatggtgctggggggaccacgctggctgtgttgcacccggaacttggcatccagcaatgggcccctgctcgccaggcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccagggctctctgtcccgccgactcctgcccccattctgcgggcagacctggccgggatcttgggggtctcaggagtccttctctttgactgtggctacctccttcatctgctgtgccgacagaagcaccgccctgcccctaggctccagccatcccacaccagctcctaggcactgagagcacgagcatggggaggcttcctcaggatctcgaacctgcggaaggaggaccagtctgtgtacttctgccaagtccagctggacatacagatcagggaggctgtcgtggcagtccatcaaggggacccacctcaccatcacccaggccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctggtggctccacaggatctggtccaagctacctttatggggtcactcaaccaaaacacctctcagcctccatgggtggctctgtggaaatccccttctccttctattacccctgggagttagccatagttcccaacgtgagaatatcctggagacggggccacttccacgggcagtccttctacagcacaaggccgccttccattcacaaggattatgtgaaccggctctttctgaactggacagagggtcaggagagcggcttcctcaggatctcaaacctgcggaaggaggaccagtctgtgtatttctgccgagtcgagctggacacccggagatcagggaggcagcagttgcagtccatcaaggggaccaaactcaccatcacccaggctgtcacaaccaccaccacctggaggcccagcagcacaaccaccatagccggcctcagggtcacagaaagcaaagggcactcagaatcatggcacctaagtctggacactgccatcagggttgcattggctgtcgctgtgctcaaaactgtcattttgggactgctgtgcctcctcctcctgtggtggaggagaaggaaaggtagcagggcgccaagcagtgacttctgaccaacagagtgtggggagaagggatgtgtattagccccggaggacgtgatgtgagacccgcttgtgagtcctccacactcgttccccattggcaagatacatggagagcaccctgaggacctttaaaaggcaaagccgcaaggcagaaggaggctgggtccctgaatcaccgactggaggagagttacctacaagagccttcatccaggagcatccacactgcaatgatataggaatgaggtctgaactccactgaattaaaccactggcatttgggggctgtttattatagcagtgcaaagagttcctttatcctccccaaggatggaaaaatacaatttattttgcttaccata

SEQ ID NO: 163388 - DNA, 902 bp, Homo sapiens
  Payload ID: 12187
  Gene Symbol: PILRB
  Gene Name: paired immunoglobin-like type 2 receptor beta
  ENST ID: ENST00000455145
  CDS Start-End: 580-902
ctgcgggcagacctggccgggatcttgggggtctcaggagtccttctctttgactgtggctacctccttcatctgctgtgccgacagaagcaccgccctgcccctaggctccagccatcccacaccagctcctaggcactgagagcacgagcatggtcgtttcctgctgtgactaagtcagcaacacagttcctctgacatgggccttggctgtgcttctttgggggtgaagagattggggaggaagtctccacccctgggaggcagaagccaggcatagcgcgctggctaggactccagtaccgtgaagggaggcagtgagagcagacatctgtgcctcattcctgatctcaaggggaaagcaagaacaagacctgtgaagggaaggagggtggatcggcctgactggccctgggaagcacagaggagcctactgggaccagggaagagactgacaagagaagggaggcctgtccctgcctgcttctgtctcaagaagattgttatcacttcctctggtgaaatcctgccttcctgtccccacggcccctcagctgatgccaccttactctggagaggatgggcagagcctcctatggagggagccctgtgggtcaccaaagctccagtgaccacccccgggcaaagacctgcagatcccctgttagagacgggcccaggactttgtgcggggtgcccactgttgctctgagccttcacttcctcagggaggcttcctcaggatctcgaacctgcggaaggaggaccagtctgtgtacttctgccaagtccagctggacatacagatcagggaggctgtcgtggcagtccatcaaggggacccacctcaccatcacccaggccctcaggcagcccctccacagggcccctctcctgcctgg

SEQ ID NO: 163389 - DNA, 1364 bp, Homo sapiens
  Payload ID: 12187
  Gene Symbol: PILRB
  Gene Name: paired immunoglobin-like type 2 receptor beta
  ENST ID: ENST00000443526
  CDS Start-End: 982-1364
tgaagacttcctgcgatgagaacagaggcacaggtgccggccctgcagcccccagaacccggactggagggggccatggggcgccggaccctggccctgccctgggtgctgctgaccctgcgtgtcactgcagggaccccggaggtgtgagtacaagttcggatggaggccaccgagctctcgtccttcaccatccgttgtgggttcctggagtctggctccatctccctggtgactgtgagcagggggggccccgatggtgctggggggaccacgctggctgtgttgcacccggaacttggcatccagcaatgggcccctgctcgccaggcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccagggctctctgtcccgccgactcctgcccccattctgcgggcagacctggccgggatcttgggggtctcaggagtccttctctttgactgtggctacctccttcatctgctgtgccgacagaagcaccggcatagcgcgctggctaggactccagtaccgtgaagggaggcagtgagagcagacatctgtgcctcattcctgatctcaaggggaaagcaagaacaagggaggcttcctcaggatctcgaacctgcggaaggaggaccagtctgtgtacttctgccaagtccagctggacatacagatcagggaggctgtcgtggcagtccatcaaggggacccacctcaccatcacccagggtgagtccagctgccctggcaccaaggaaccttcctggttcagccataggctcagccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctggtggctccacaggatctggtccaagctacctttatggggtcactcaaccaaaacacctctcagcctccatgggtggctctgtggaaatccccttctccttctattacccctgggagttagccatagttcccaacgtgagaatatcctggagacggggccacttccacgggcagtccttctacagcacaaggccgccttccattcacaaggattatgtgaaccggctctttctgaactggacagagggtcaggagagcggcttcctcaggatctcaaacctgcggaaggaggaccagtctgtgtatttctgccgagtcga

SEQ ID NO: 163390 - DNA, 1506 bp, Homo sapiens
  Payload ID: 12187
  Gene Symbol: PILRB
  Gene Name: paired immunoglobin-like type 2 receptor beta
  ENST ID: ENST00000419749
  CDS Start-End: 1124-1506
tgaagacttcctgcgatgagaacagaggcacaggtgccggccctgcagcccccagaacccggactggagggggccatggggcgccggaccctggccctgccctgggtgctgctgaccctgcgtgtcactgcagggaccccggaggtgtgagtacaagttcggatggaggccaccgagctctcgtccttcaccatccgttgtgggttcctggagtctggctccatctccctggtgactgcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccagggctctctgtcccgccgactcctgcccccattctgcgggcagacctggccgggatcttgggggtctcaggagtccttctctttgactgtggctacctccttcatctgctgtgccgacagaagcaccgccctgcccctaggctccagccatcccacaccagctcctaggcactgagagcacgagcatgggcacccagccaggcctcccaggctgctctccacgtcccttatgccactatcaacaccagctgctgcccagctactttggacacagctcacccccgacagggggccgtcctgtcgtttcctgctgtgactaagtcagcaacacagttcctctgacatgggccttggctgtgcttctttgggggtgaagagattggggaggaagtctccacccctgggaggcagaagccaggcatagcgcgctggctaggactccagtaccgtgaagggaggcagtgagagcagacatctgtgcctcattcctgatctcaaggggaaagcaagaacaagggaggcttcctcaggatctcgaacctgcggaaggaggaccagtctgtgtacttctgccaagtccagctggacatacagatcagggaggctgtcgtggcagtccatcaaggggacccacctcaccatcacccaggccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctggtggctccacaggatctggtccaagctacctttatggggtcactcaaccaaaacacctctcagcctccatgggtggctctgtggaaatccccttctccttctattacccctgggagttagccatagttcccaacgtgagaatatcctggagacggggccacttccacgggcagtccttctacagcacaaggccgccttccattcacaaggattatgtgaaccggctctttctgaactggacagagggtcaggagagcggcttcctcaggatctcaaacctgcggaaggaggaccagtctgtgtatttctgccgagtcga

SEQ ID NO: 163391 - DNA, 603 bp, Homo sapiens
  Payload ID: 12187
  Gene Symbol: PILRB
  Gene Name: paired immunoglobin-like type 2 receptor beta
  ENST ID: ENST00000438231
  CDS Start-End: 240-603
gcttgggctgggggctgagcgcctgtgacctccactggcttcctccttctcctctctgaggactgaatctggggtgcagcagagcacagactcaggcccgcctttcctctccctgaaagagcctgcgctggccttggacagagaaagggatgagaaccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctggtggctccacaggatctggtccaagctacctttatggggtcactcaaccaaaacacctctcagcctccatgggtggctctgtggaaatccccttctccttctattacccctgggagttagccatagttcccaacgtgagaatatcctggagacggggccacttccacgggcagtccttctacagcacaaggccgccttccattcacaaggattatgtgaaccggctctttctgaactggacagagggtcaggagagcggcttcctcaggatctcaaacctgcggaaggaggaccagtctg

SEQ ID NO: 163392 - DNA, 1822 bp, Homo sapiens
  Payload ID: 12187
  Gene Symbol: PILRB
  Gene Name: paired immunoglobin-like type 2 receptor beta
  ENST ID: ENST00000438028
  CDS Start-End: 1683-1822
tgaagacttcctgcgatgagaacagaggcacaggtgccggccctgcagcccccagaacccggactggagggggccatggggcgccggaccctggccctgccctgggtgctgctgaccctgcgtgtcactgcagggaccccggaggtgtgagtacaagttcggatggaggccaccgagctctcgtccttcaccatccgttgtgggttcctggagtctggctccatctccctggtgactgtgagcagggggggccccgatggtgctggggggaccacgctggctgtgttgcacccggaacttggcatccagcaatgggcccctgctcgccaggcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccagggctctctgtcccgccgactcctgcccccattctgcgggcagacctggccgggatcttgggggtctcaggagtccttctctttgactgtggctacctccttcatctgctgtgccgacagaagcaccgccctgcccctaggctccagccatcccacaccagctcctaggcactgagagcacgagcatgggcacccagccaggcctcccaggctgctctccacgtcccttatgccactatcaacaccagctgctgcccagctactttggacacagctcacccccgacagggggccgtcctggtgggcatcactccccacccacaccgcacactggccccagggccctgctgcctgggcctccacatccatccctgcacatggcagctttgtctctgttgagaatggactctacgcttaggctgggcagaggcctccctgcactggtcctggcctcactcttttccctgacccttggggcccagggccatggagggacccttaggagttcaatgagagagaccatgaggccactgggctttccccttcccaggcctcctgggtgccacccccttacgttattcttgggcctctaataagtgtcccacaggtgcctggccaggcccacctgctgcagatgtggtctgtgtgtgtgcatgtgtgggtgtgtgtgggcacaggtgtgagtgtgtgagcaacagtaccccattccagtcgtttcctgctgtgactaagtcagcaacacagttcctctgacatgggccttggctgtgcttctttgggggtgaagagattggggaggaagtctccacccctgggaggcagaagccaggcatagcgcgctggctaggactccagtaccgtgaagggaggcagtgagagcagacatctgtgcctcattcctgatctcaaggggaaagcaagaacaagggaggcttcctcaggatctcgaacctgcggaaggaggaccagtctgtgtacttctgccaagtccagctggacatacagatcagggaggctgtcgtggcagtccatcaaggggacccacctcaccatcacccagggtgagtccagctgccctggcaccaaggaaccttcctggttcagccataggctcagccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctgagggtcaggagagcggcttcctcaggatctcaaacctgcggaaggaggaccagtctgtgtatttctgccgagtcga

SEQ ID NO: 163393 - DNA, 2074 bp, Homo sapiens
  Payload ID: 12187
  Gene Symbol: PILRB
  Gene Name: paired immunoglobin-like type 2 receptor beta
  ENST ID: ENST00000457519
  CDS Start-End: 1692-2074
gctcaccacctctggggaaggtgtgagaggagagaaggaagtggctgtttggctgctgacaacatgaagacttcctgcgatgagaacagaggcacaggtgccggccctgcagcccccagaacccggactggagggggccatggggcgccggaccctggccctgccctgggtgctgctgaccctgcgtgtcactgcagggaccccggaggtgtgagtacaagttcggatggaggccaccgagctctcgtccttcaccatccgttgtgggttcctggagtctggctccatctccctggtgactgtgagcagggggggccccgatggtgctggggggaccacgctggctgtgttgcacccggaacttggcatccagcaatgggcccctgctcgccaggcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccagggctctctgtcccgccgactcctgcccccattctgcgggcagacctggccgggatcttgggggtctcaggagtccttctctttgactgtggctacctccttcatctgctgtgccgacagaagcaccgccctgcccctaggctccagccatcccacaccagctcctaggcactgagagcacgagcatgggcacccagccaggcctcccaggctgctctccacgtcccttatgccactatcaacaccagctgctgcccagctactttggacacagctcacccccgacagggggccgtcctggtgggcatcactccccacccacaccgcacactggccccagggccctgctgcctgggcctccacatccatccctgcacatggcagctttgtctctgttgagaatggactctacgcttaggctgggcagaggcctccctgcactggtcctggcctcactcttttccctgacccttggggcccagggccatggagggacccttaggagttcaatgagagagaccatgaggccactgggctttccccttcccaggcctcctgggtgccacccccttacgttattcttgggcctctaataagtgtcccacaggtgcctggccaggcccacctgctgcagatgtggtctgtgtgtgtgcatgtgtgggtgtgtgtgggcacaggtgtgagtgtgtgagcaacagtaccccattccagtcgtttcctgctgtgactaagtcagcaacacagttcctctgacatgggccttggctgtgcttctttgggggtgaagagattggggaggaagtctccacccctgggaggcagaagccaggcatagcgcgctggctaggactccagtaccgtgaagggaggcagtgagagcagacatctgtgcctcattcctgatctcaaggggaaagcaagaacaagggaggcttcctcaggatctcgaacctgcggaaggaggaccagtctgtgtacttctgccaagtccagctggacatacagatcagggaggctgtcgtggcagtccatcaaggggacccacctcaccatcacccaggccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctggtggctccacaggatctggtccaagctacctttatggggtcactcaaccaaaacacctctcagcctccatgggtggctctgtggaaatccccttctccttctattacccctgggagttagccatagttcccaacgtgagaatatcctggagacggggccacttccacgggcagtccttctacagcacaaggccgccttccattcacaaggattatgtgaaccggctctttctgaactggacagagggtcaggagagcggcttcctcaggatctcaaacctgcggaaggaggaccagtctgtgtatttctgccgagtcga

SEQ ID NO: 163394 - DNA, 2314 bp, Homo sapiens
  Payload ID: 12187
  Gene Symbol: PILRB
  Gene Name: paired immunoglobin-like type 2 receptor beta
  Uniprot ID: Q9UKJ0
  ENST ID: ENST00000448382
  CDS Start-End: 1118-1933
cacctctggggaaggtgtgagaggagagaaggaagtggctgtttggctgctgacaacatgaagacttcctgcgatgagaacagaggcacaggtgccggccctgcagcccccagaacccggactggagggggccatggggcgccggaccctggccctgccctgggtgctgctgaccctgcgtgtcactgcagggaccccggaggtgtgagtacaagttcggatggaggccaccgagctctcgtccttcaccatccgttgtgggttcctggagtctggctccatctccctggtgactgtgagcagggggggccccgatggtgctggggggaccacgctggctgtgttgcacccggaacttggcatccagcaatgggcccctgctcgccaggcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccaggtggggccggggtgaggggtccaggagggcagggaggggctcgggaactggccatccatctgattcttgcctctgtgcccagggctctctgtcccgccgactcctgcccccattctgcgggcagacctggccgggatcttgggggtctcaggagtccttctctttgactgtggctacctccttcatctgctgtgccgacagaagcaccgccctgcccctaggctccagccatcccacaccagctcctaggcactgagagcacgagcatgggcatagcgcgctggctaggactccagtaccgtgaagggaggcagtgagagcagacatctgtgcctcattcctgatctcaaggggaaagcaagaacaagacctgtgaagggaaggagggtggatcggcctgactggccctgggaagcacagaggagcctactgggaccagggaagagactgacaagagaagggaggcctgtccctgcctgcttctgtctcaagaagattgttatcacttcctctggtgaaatcctgccttcctgtccccacggcccctcagctgatgccaccttactctggagaggatgggcagagcctcctatggagggagccctgtgggtcaccaaagctccagtgaccacccccgggcaaagacctgcagatcccctgttagagacgggcccaggactttgtgcggggtgcccactgttgctctgagccttcacttcctcagggaggcttcctcaggatctcgaacctgcggaaggaggaccagtctgtgtacttctgccaagtccagctggacatacagatcagggaggctgtcgtggcagtccatcaaggggacccacctcaccatcacccaggccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctggattatgtgaaccggctctttctgaactggacagagggtcaggagagcggcttcctcaggatctcaaacctgcggaaggaggaccagtctgtgtatttctgccgagtcgagctggacacccggagatcagggaggcagcagttgcagtccatcaaggggaccaaactcaccatcacccaggctgtcacaaccaccaccacctggaggcccagcagcacaaccaccatagccggcctcagggtcacagaaagcaaagggcactcagaatcatggcacctaagtctggacactgccatcagggttgcattggctgtcgctgtgctcaaaactgtcattttgggactgctgtgcctcctcctcctgtggtggaggagaaggaaaggtagcagggcgccaagcagtgacttctgaccaacagagtgtggggagaagggatgtgtattagccccggaggacgtgatgtgagacccgcttgtgagtcctccacactcgttccccattggcaagatacatggagagcaccctgaggacctttaaaaggcaaagccgcaaggcagaaggaggctgggtccctgaatcaccgactggaggagagttacctacaagagccttcatccaggagcatccacactgcaatgatataggaatgaggtctgaactccactgaattaaaccactggcatttgggggctgtttattatagcagtgcaaagagttcctttatcctccccaaggatggaaaaatacaatttattttgcttaccata

SEQ ID NO: 163395 - DNA, 772 bp, Homo sapiens
  Payload ID: 12187
  Gene Symbol: PILRB
  Gene Name: paired immunoglobin-like type 2 receptor beta
  ENST ID: ENST00000431140
  CDS Start-End: 593-772
ctcctgggtgccacccccttacgttattcttgggcctctaataagtgtcccacaggtgcctggccaggcccacctgctgcagatgtggtctgtgtgtgtgcatgtgtgggtgtgtgtgggcacaggtgtgagtgtgtgagcaacagtaccccattccagtcgtttcctgctgtgactaagtcagcaacacagttcctctgacatgggccttggctgtgcttctttgggggtgaagagattggggaggaagtctccacccctgggaggcagaagccaggcatagcgcgctggctaggactccagtaccgtgaagggaggcagtgagagcagacatctgtgcctcattcctgatctcaaggggaaagcaagaacaagggaggcttcctcaggatctcgaacctgcggaaggaggaccagtctgtgtacttctgccaagtccagctggacatacagatcagggaggctgtcgtggcagtccatcaaggggacccacctcaccatcacccaggccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctggattatgtgaaccggctctttctgaactggacagagggtcaggagagcggcttcctcaggatctcaaacctgcggaaggaggaccagtctgtgtatttctgccgagtcgagctgga

SEQ ID NO: 163396 - DNA, 587 bp, Homo sapiens
  Payload ID: 12187
  Gene Symbol: PILRB
  Gene Name: paired immunoglobin-like type 2 receptor beta
  ENST ID: ENST00000608825
  CDS Start-End: 174-587
ggaggcttcctcaggatctcgaacctgcggaaggaggaccagtctgtgtacttctgccaagtccagctggacatacagatcagggaggctgtcgtggcagtccatcaaggggacccacctcaccatcacccaggctctgctggtctccccgtcccctggagaagaacaaggccatgggtcggcccctgctgctgcccctgctgctcctgctgcagccgccagcatttctgcagcctggtggctccacaggatctggtccaagctacctttatggggtcactcaaccaaaacacctctcagcctccatgggtggctctgtggaaatccccttctccttctattacccctgggagttagccatagttcccaacgtgagaatatcctggagacggggccacttccacgggcagtccttctacagcacaaggccgccttccattcacaaggattatgtgaaccggctctttctgaactggacagagggtcaggagagcggcttcctcaggatctcaaacctgcggaaggaggaccagtctgtgtatttctgccgagtcgagctggacacccggagatcagggaggcagcag

SEQ ID NO: 163397 - DNA, 993 bp, Homo sapiens
  Payload ID: 12187
  Gene Symbol: PILRB
  Gene Name: paired immunoglobin-like type 2 receptor beta
  Uniprot ID: Q9UKJ0
  ENST ID: ENST00000609309
  CDS Start-End: 289-972
taaaaaaaaaaaaaaaaaaaggatttgaagtcctggccggagcaattaggcaagggataaaaaggcacctaaggcccttttgcaataagaagccagatggataaaggaagtgctggtcaccctggaggtgtactggtttggggaaggtccccggcccccacagccctctggggagcctcaccctggctctccccactcacctcagccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctggtggctccacaggatctggtccaagctacctttatggggtcactcaaccaaaacacctctcagcctccatgggtggctctgtggaaatccccttctccttctattacccctgggagttagccatagttcccaacgtgagaatatcctggagacggggccacttccacgggcagtccttctacagcacaaggccgccttccattcacaaggattatgtgaaccggctctttctgaactggacagagggtcaggagagcggcttcctcaggatctcaaacctgcggaaggaggaccagtctgtgtatttctgccgagtcgagctggacacccggagatcagggaggcagcagttgcagtccatcaaggggaccaaactcaccatcacccaggctgtcacaaccaccaccacctggaggcccagcagcacaaccaccatagccggcctcagggtcacagaaagcaaagggcactcagaatcatggcacctaagtctggacactgccatcagggttgcattggctgtcgctgtgctcaaaactgtcattttgggactgctgtgcctcctcctcctgtggtggaggagaaggaaaggtagcagggcgccaagcagtgacttctgaccaacagagtgtggggagaag

SEQ ID NO: 163398 - DNA, 4284 bp, Homo sapiens
  Payload ID: 12188
  Gene Symbol: PRRX1
  Gene Name: paired related homeobox 1
  Uniprot ID: P54821
  ENST ID: ENST00000239461
  CDS Start-End: 314-1051
tttttaatattgtattttactgtggattatctctttggaccgcgccggacttggcctcaggaaatcaaccaatgctgcggaaggcggctggtgcacaacgctctgctctacagaagggggtcccccaccctcttttccaattttttttttttggccttcctctccttccctccctcttcctccctctctctctctctctctccactacccccctctttcttccccactcggctcctctcccccctcgcgcccacagcgtttggtgttgattcgagcgggaagaggggggtgggtgggatcggtgggggagaccatgacctccagctacgggcacgttctggagcggcaaccggcgctgggcggccgcttggacagcccgggcaacctcgacaccctgcaggcgaaaaagaacttctccgtcagtcacctgctagacctggaggaagccggggacatggtggcggcacaggcggatgagaacgtgggcgaggctggccggagcctgctggagtcgccgggactcaccagcggcagcgacaccccgcagcaggacaatgaccagctgaactcagaagaaaaaaagaagagaaagcagcgaaggaataggacaaccttcaatagcagccagctgcaggctttggagcgtgtctttgagcggacacactatcctgatgcttttgtgcgagaagaccttgcccgccgggtgaacctcaccgaggcgagagtgcaggtgtggtttcagaaccgaagagccaagttccgcaggaatgagagagccatgctagccaataaaaacgcttccctcctcaaatcctactcaggagacgtgactgctgtggagcagcccatcgtacctcgtcctgctccgagacccaccgattatctctcctgggggacagcgtctccgtacagcgccatggctacttattctgccacatgtgccaacaatagccctgcacagggcatcaacatggccaacagcattgccaacctgagactgaaggccaaggaatatagtttacagaggaaccaggtgccaacagtcaactgaggaaaaaaaataattaaacaggcctaagaagaaatcaaaaaccataagacacctatcctgctctgttatttcttcatctgctggggggaaaaagtaaattacaaacaaacaaacaaagcagaactaaaatattgggaccatggcagagaaaagcaggagaggagcaaaatgaaaattagttaacaaatgttcctcctccctctgggataccaccaccacttgtttctgtgtgtgtttattttgtttttctttcattcatgctttgcttaatgtactccaggcttcttcagctaggttcagcccacccacccccatgattgtatgaagttttaaaaaaaactacagcagccaaagaaactatatatatatatatatatatatatatccagaatgattgcctctactgtcctcattgacttgtttgaaccttagtgccttaccctgtcctcttcccagttctctttatagaagctctaggagctttcgaaaagccaaagtctttctgaagaatctgtgctggacagacataattccctttctcattgtctccatctttgttggtcatggtaaggtttttccatcagcctctgaaaaaatagttgtgcacaacatctgctcactggactgtctgatccaatgtaattggctgcgtctggctaattctaagcactaaagtctacatctaagctatagatttaagcttgaagctacagattatatcactatcaccaccacccctcaccctatgcaatcaatcaatcaatcatcttaagttaaagatatttgttgtctttgaatgatttgctgtcacagactatttggtagaagaaatatttttcacctgagagaggaagagaaatttctctagtaacacaaagagtgagttctaaaaggcatgcccacatctctttcgtgccttaaggatagtgagatgcacacttatatatatactgtatatatttatatatttatatatatatttcatatatatatataatattgcaagcttaagtttgcaatttcccaaacaatacaaaaagcaaattacacaccctcaccactgttcttatctctatagtgatgaaacattaattagggatcttgctgcttttctttttctacacgaagttttcattaaagccacagaataattgatagggcagctgtttgagaacaggtcccattttcacattagggctttaaatgaattagaaactatttgaggctataaaaatgtccttgagtttggagcctgagctctggtgaaatgctgatacatctgatctatcatgggaattgcagttagagagagtaaggaataccatttagtcatctatccgttcttcacttagcaggaatatgaaagaaaggcacatgtttaagaggaatacctaaaggtttttctaaattccaacatttaaaaggcaattgtgggctatttttattttttaatattttgaaataaagtttagtgtctagggctgggagccaggactgatcttccatttctttttctttgttcccagccatgcttttgtaacttgccaggtggacttgaccaactacattaccatgctgtgcctcagtttacccatttgtaaaatgggattaataatacttacctacctcacaggggtgttgtgaggctctattcatttgctcctttattctttcctgtattctctgtatgtccagcactttgtagccatgggaggaaagggactataaaagtgtacaatgttaatggaatgatacggtacctgaaagccttgttttctagtaagaaaatgctaccttgctgtacatacttataaccttgtatttggaaatgagaaataggtttatattttcagatctctcaaaaatcacatcatttgaccaaagaataatttaagacacatagaacagatttttttaatttatattttcatcctgaccagcttagttctaataatttttagttgtgagtgattaaaaaactttggatcaattttggtcaaacatgccaactttgtagtctgagtgacaggcaaggatttttgggtttaagatgcacttttagcacacatttgtatttcccttggcatatcagattgagctaatggtgatgttatttcaatctaacagccaccaatctgaaattgtatttcaaatgttgattctgtagttctttaaataataatgaagctcatcttatacattttgctttcaccaattgattccttcttcttttagcccactattaaaacatttcttactgaatggttcatgtaggcttgctgaacagcacgcattacttgcttcctgaagagttcccccattcatccatttgtcccattagttgctgtggattatcaagttttgaaggaactgtacatcccaacagactgaaacattctaagtgaaatgagtataatccaagtaactggtgaactttggaggtttggagcttgaagagaatggctaagaagatttgaattatagggagggaacagaaatcatacatgaaaaggttttactgagaaggggaaaaccttagatagagggacatgtgaaacaaaatcatttgaaattttgattcagacatccatttccagtggcaaacagcaaagcctgaacccataaacccaaatgataggtgaagttgggtggttttatccaatgtctcaagcaagcaatgtctgggaatatcatagagtaacaagtgctggtcagccaaagaaacattcactgctggtgaaccaataccataagcatgtattatctaagcacttgatcaagaaatatacatgttgtacaagctctcaattttgttcatttattatcaaatttttaaaatacaagtttggtatgtgatttggaaaagatgccttctggatcttaagccagttgtcagtggaggtcctcagggctgcaaatgtcaagacataaccctgttcctcaccatcatgataccagatacaggtgaatacataggaactatctgcctgtgtcctcaatctcccttcaaacaagatgctgatttgtagggtacttggcaggttaaattaaaccagaagaggtgacttaataaaaaagggaatgacatttagggtataaagatctcataagaaatgtaatatgtaaattatatcttgctttatgttgtaaaatatacattgtttgcgctagaatagaaatgatttcttttcaataaaaagaaagaaggactctaccatgtcttttgttatata

SEQ ID NO: 163399 - DNA, 2217 bp, Homo sapiens
  Payload ID: 12188
  Gene Symbol: PRRX1
  Gene Name: paired related homeobox 1
  Uniprot ID: P54821
  ENST ID: ENST00000367760
  CDS Start-End: 1086-1739
gatgttggcaaagggggttttcttaatcagactgttttttggtcccagggaaaggaggaagaaggagattgtgatggagaaagggggtctgtgaaacgtcaggcacagcacaaaggctttgccacgtaattacaggctcctattaagtcgagatctgccctcccaggggtctccaattttcttgtattccctacaaagcctcctctgcatgccagtttgtgccttttgaagtgccagagagcttcttgatccaactgagaaggaaaaaggagcccagcaagaagagggggagagagagaaggggaaaggggggaacccaccagcaccctccgtcggactcttgaagccttttttttttaattcttaatttttttttttactctttacaaaaagtaaagtgagaatcctgctctctaatacatctgcaagacatcaccctctcctcctgaaactttagtcactcctgagaatccacaggagtgcagagaggggggaacacgttttcttgaagatgttttaaagctggaacaagccttcttctgttggtgcttgaactcttgcctgggaataacttttttaacctttaaaaaaaccattcactttgattcttctctcccaccccttcttctctcttcttctgtttgcctaactcccccgccctgctggcctccgctttcctctctcccccttgttattatttttagtctgtgcgtgtggacacttttggagagttggaagggatttttttctcctgacttgaacatagggtgactttttaatattgtattttactgtggattatctctttggaccgcgccggacttggcctcaggaaatcaaccaatgctgcggaaggcggctggtgcacaacgctctgctctacagaagggggtcccccaccctcttttccaattttttttttttggccttcctctccttccctccctcttcctccctctctctctctctctctccactacccccctctttcttccccactcggctcctctcccccctcgcgcccacagcgtttggtgttgattcgagcgggaagaggggggtgggtgggatcggtgggggagaccatgacctccagctacgggcacgttctggagcggcaaccggcgctgggcggccgcttggacagcccgggcaacctcgacaccctgcaggcgaaaaagaacttctccgtcagtcacctgctagacctggaggaagccggggacatggtggcggcacaggcggatgagaacgtgggcgaggctggccggagcctgctggagtcgccgggactcaccagcggcagcgacaccccgcagcaggacaatgaccagctgaactcagaagaaaaaaagaagagaaagcagcgaaggaataggacaaccttcaatagcagccagctgcaggctttggagcgtgtctttgagcggacacactatcctgatgcttttgtgcgagaagaccttgcccgccgggtgaacctcaccgaggcgagagtgcaggtgtggtttcagaaccgaagagccaagttccgcaggaatgagagagccatgctagccaataaaaacgcttccctcctcaaatcctactcaggagacgtgactgctgtggagcagcccatcgtacctcgtcctgctccgagacccaccgattatctctcctgggggacagcgtctccgtacagatcctcgtccctcccaagatgttgtttacacgaggggcttcataacggattctaacggaagacactgaaaagcgccatggctacttattctgccacatgtgccaacaatagccctgcacagggcatcaacatggccaacagcattgccaacctgagactgaaggccaaggaatatagtttacagaggaaccaggtgccaacagtcaactgaggaaaaaaaataattaaacaggcctaagaagaaatcaaaaaccataagacacctatcctgctctgttatttcttcatctgctggggggaaaaagtaaattacaaacaaacaaacaaagcagaactaaaatattgggaccatggcagagaaaagcaggagaggagcaaaatgaaaattagttaacaaatgttcctcctccctctgggataccaccaccacttgtttctgtgtgtgtttattttgtttttctttcattcatgctttgcttaatgtactccaggcttcttcagctaggttcagcccacccacccccatgattgta

SEQ ID NO: 163400 - DNA, 3501 bp, Homo sapiens
  Payload ID: 12188
  Gene Symbol: PRRX1
  Gene Name: paired related homeobox 1
  ENST ID: ENST00000497230
  CDS Start-End: 283-885
tctttggaccgcgccggacttggcctcaggaaatcaaccaatgctgcggaaggcggctggtgcacaacgctctgctctacagaagggggtcccccaccctcttttccaattttttttttttggccttcctctccttccctccctcttcctccctctctctctctctctctccactacccccctctttcttccccactcggctcctctcccccctcgcgcccacagcgtttggtgttgattcgagcgggaagaggggggtgggtgggatcggtgggggagaccatgacctccagctacgggcacgttctggagcggcaaccggcgctgggcggccgcttggacagcccgggcaacctcgacaccctgcaggcgaaaaagaacttctccgtcagtcacctgctagacctggaggaagccggggacatggtggcggcacaggcggatgagaacgtgggcgaggctggccggagcctgctggagtcgccgggactcaccagcggcagcgacaccccgcagcaggacaatgaccagctgaactcagaagaaaaaaagaagagaaagcagcgaaggaataggacaaccttcaatagcagccagctgcaggctttggagcgtgtctttgagcggacacactatcctgatgcttttgtgcgagaagaccttgcccgccgggtgaacctcaccgaggcgagagtgcaggtgtggtttcagaaccgaagagccaagttccgcaggaatgagagagccatgctagccaataaaaacgcttccctcctcaaatcctactcaggagacgtgactgctgtggagcagcccatcgtacctcgtcctgctccgagacccaccgattatctctcctgggggacagcgtctccgtacaggtgaatgactggcccactctcccttgctccacttccacatgtttctcagcggtcggtcatgtttcaagctgcttgtgcagctcaccgacatttcttactgggttaatctcttcagagacattcaacttgctgacatccccacattttcccaggagattataagctgccccagcagcagggtttggggcagaagtgagaggggcaggctatctcaccaatctcctcttggactcaggaactcttgcaaaggtttcaaagatgaggaagaatctaaaagaaaagatcattaagctgtgcccagtgttcctcttgcaacaattctggaacaaaactttaccctgtttccaaatttaagctaaattcgttgtattatgcaaatgtagggacgtaacttgtaaaactccaagtatagggccaaaggcaaactttgcagtaaaactggctttgaattaaaaaaaggaagaaggaaggaaggaagaaagaaaggaaagaaggaaggaaggagagagacgagagggactatgacagagagaggaggaaagaaaagccaagttcattctgatcactttcatggccaaggttctttgttagtaggtgtgaatttcttataatgccaaatgccttcctaatctattgctaattcttgtctacttgtctgaagttttctctggggatcagtttgtgtgtatttgtgtgtgtgcgtgtgtgtgtgtgtctgtgtgtgtttcttttaaataaaaaaggaatgtataatttacactaaacttttatattaaaaagttgaacatttttaaagaaacaaatatcagagtactatttcaatctcataaagaggcttttaacctcccattattatgctgttcagaaaatataggctgccagaagggaagctgagacacaaattcctaacccattggattagtctagagtgactttctttgaaaatatacctgagtactctgagaaaccaggccaagcctacgtgttctccctggctgatttcagtggaggaagaactattcaaaaattcatttattatgcttttgtttacctttttattgtcaaggttaattattggtttaaggagaggttttaaatgaaatataggagattatgtctcagatgaagttgaatttctgacatgaaatgctacatttttgaaatgcaagtgtttttcaaaggttcttagctttaatcaaagcaaaaagcctcatctaaaagtttctttctgttccaaatcagttcctttagagaaacatggtaaatgcacttggaaatttgttttaatcccctgttataaaattagcctgaattctttttgtcttagcacatagagaccctacatctaggaaagtcttattctgggccctattgcactcagatgtggtgtgccttactgatcttgaaacattagttatatctgtgtgccctattttaaatttaaactcctctcctataagatttactacaaatacattttttgaagaccactgtaaaatcacatattctctaatattttaaataaatgaaaggctgctttatttctcttataaacattggtataagagaaatttggtgtgttcatgaacacgctaaatggcttggaaaatgggtgtggttcaaagcctgatgcttcaagatctctggtttgaatttggtcacaaccaggaagtattgcccctttttctgtctgggtcctccataggaacttttcataccagccataaacaatccagatggctgccacgtggtccttaccagtgagaggcgtcacacagcacacactgcatgaatggggatgaaatcattcctgaattaatatagggttatattacttggacctcagccatttgagcctcagtgtctgcatcatatgtgtttagtatatggacatctaactgaaattattaacgtggcaatttatgcgtgccttttttggaaatattctattttaatggaaagaattatgtagaaatactggatacatttttaaaaacatccataattcaccatcttgacataactagtatattcatttttgtgattagagttcaatgttttatatagatgtagctttagtgtatatattattttgtattctgctcttttcacttaaagtcatatgacctagtacattttactcatttcttggtatgcttttatatcatttctctcttagaaattggatttgtaaaaattaatttagaaaatcataaaatctgttcatattctgtatgaagaataaattaatcttcagatataagcagaaaagtgatgttaaaacaataatttaatcaataataatgttttttgatccaatgttgactgaagtgtttatattttggttgatttctaaaagtagcaaaaagctattctgttatttggagaattttctgctatgtttagaaccaaactatgttatgatttcacactttgaagcttgataggaaatattgttaaggaaataaaaaagaaaaacaagtgatccaaagcaaaggaaatgatagacttttgtgttatgaaaaattaactcactgttcttgttggtactattatgtcaagttagttatctcacatgtgacactcattaaaaggcatttctcttggttaattcttggaa

SEQ ID NO: 163401 - DNA, 1311 bp, Homo sapiens
  Payload ID: 12189
  Gene Symbol: PRRX2
  Gene Name: paired related homeobox 2
  Uniprot ID: Q99811
  ENST ID: ENST00000372469
  CDS Start-End: 228-989
cgcagcgcgtgcaccagcggctccggagcgagcggccgtggctgagaaggggagggcggaaagtttgtttccccgacgtcagcgccgggcgggccgcgaggctaggaggcggcgggagctgggcagagcgcggggcggccggggctctcgctccgacccgcgcccgcgacccttcctgggacccgagcccgagacccccgccggcccccccggggccgctcgcgggcatggacagcgcggccgccgccttcgccctggacaagccggcgctgggcccggggccgccgccgcctccacccgcgctggggcccggcgactgcgcccaggcgcgcaagaacttctcggtgagccacctcctggacctggaagaggtggcggcggccgggcggctggcggcgcgccccggggccagggccgaggcgcgggagggcgcagcacgggagccgtccgggggcagcagcggcagcgaggcggcgccgcaggatggtgagtgtcccagcccggggcgcggtagcgccgccaagcggaagaagaagcagcggcggaaccgcaccacgttcaacagcagccaactgcaggcgctggagcgcgtgttcgagcgcacgcactaccccgacgcctttgtgcgcgaggagcttgcccggcgcgtcaacctcagcgaggcgcgcgttcaggtctggtttcagaaccgccgcgccaagttccgcaggaatgaaagggccatgctggccagccgctctgcctcgctgctcaagtcctacagccaggaggccgccatcgagcagcccgtggctccccggcccaccgccctgagtccagattatctctcctggacagcctcgtccccctacagcacagtgccaccctacagccctgggagctcaggccccgcaaccccaggggtcaacatggccaacagcatcgccagcctccgtctcaaggccaaggagttcagcctgcaccacagccaggtgcctacggtgaactgaagtccagtcccaccaggacccagacgcctccctgggtggacagcaatagaaaagggggcagacgcccaggaagtgaccttctcctggatgagctctcctggcccgtctgtccagcctggactcccgagcccacgaggctgttgaggcccctgcagccgggcccagctcttctgtccttggccaccagagactgcagcccacaacccttggaggggttgggccggaaggtggaagagcctgccaaggacctcatttagtttgtgtattaaaaccaaaaagcttttgtctttaagaaataaaaccatttttttaagccccaaaa

SEQ ID NO: 163402 - DNA, 1699 bp, Homo sapiens
  Payload ID: 12190
  Gene Symbol: PHOX2A
  Gene Name: paired-like homeobox 2a
  Uniprot ID: O14813
  ENST ID: ENST00000298231
  CDS Start-End: 173-1027
acttgcgttgcacccgggctgagtgcggccgcgacggggcgggcggactctcgggcgctcagagctggcctcgggtcctcggagcctggcgctcgaacctcccttccgacctccacccggaccccgaccccgacccggcctggcccggcccccgcccccgccccccgggccgatggactactcctacctcaattcgtacgactcgtgcgtggcggccatggaggcgtccgcctacggcgactttggcgcctgcagccagcccggcggcttccaatacagccccctgcggcccgctttccccgcggcagggccgccctgccccgcgctcggctcctccaactgcgcacttggcgccctacgcgaccaccagcccgcgccctactcggcagtgccctacaagttcttcccagagccatccggcctgcacgagaagcgcaagcagcggcgcatccgcaccacgttcaccagcgcgcagctcaaggagctggagcgcgttttcgctgagacccactaccccgacatttacacgcgtgaggagctggcgctcaagatcgacctcactgaggctcgcgtgcaggtctggttccagaaccgccgggccaagttccgcaaacaggagcgcgcggccagcgccaagggcgcggcgggcgcggcgggcgccaaaaagggcgaggcgcgctgctcctccgaggacgacgattccaaggagtccacgtgcagccccacgcccgatagcaccgcctcgctgccgccgccgcctgcgcccggcctggccagcccgcgcctgagccccagcccgctgcccgtcgcactgggctccgggccgggacctgggccggggccacagccgctcaagggcgcactgtgggccggtgtggcgggcggtgggggcggcgggcctggcgcgggagcggccgaactacttaaggcttggcagccggcggagtccggccccgggcccttctccggggttctgtcctcctttcaccggaagcccggccccgccctgaagaccaatctcttctagctgccggcctctggaggctccgagcctgcccccagagacgtccctgcccctccaggacctgacagcccctcccatcctggccacccgcctggaagtccccatccgtctccactccctactgtctcacccctcggtgtgtcctccccaactttggagaccaagtcagggccactctcgtcctcacccaccctctaccagcagagcggagttctttataccgggacctcctccaggagaaccccggagctccttctagcttggccttctttggatgcggtatcacatgaggcctgtccctaacagtgccctcaaagtgaaggtcctcaaggaggatcggcacagcccccttccctggctctgcagcggctgggtcaccccttacgctggtgatcaggaaagcccgctgccccacccctcgggcccacccgtacagaggctggtggtcgccgggataattaatgaccaccgccaattcatccctcacgtgtctcctctcttccctagcccgtctggcacagagggtggacctgttagaggagtggaggggctgcctggggaatgggacagagggattctctttccctaatttttttggttgtcctttttctttgaaaaacttgtaatttattgaagttttactcaatccaaataaaacttaatttattgaagaca

SEQ ID NO: 163403 - DNA, 928 bp, Homo sapiens
  Payload ID: 12190
  Gene Symbol: PHOX2A
  Gene Name: paired-like homeobox 2a
  ENST ID: ENST00000546310
  CDS Start-End: 1-256
ggagcgcgttttcgctgagacccactaccccgacatttacacgcgtgaggagctggcgctcaagatcgacctcactgaggctcgcggcgcactgtgggccggtgtggcgggcggtgggggcggcgggcctggcgcgggagcggccgaactacttaaggcttggcagccggcggagtccggccccgggcccttctccggggttctgtcctcctttcaccggaagcccggccccgccctgaagaccaatctcttctagctgccggcctctggaggctccgagcctgcccccagagacgtccctgcccctccaggacctgacagcccctcccatcctggccacccgcctggaagtccccatccgtctccactccctactgtctcacccctcggtgtgtcctccccaactttggagaccaagtcagggccactctcgtcctcacccaccctctaccagcagagcggagttctttataccgggacctcctccaggagaaccccggagctccttctagcttggccttctttggatgcggtatcacatgaggcctgtccctaacagtgccctcaaagtgaaggtcctcaaggaggatcggcacagcccccttccctggctctgcagcggctgggtcaccccttacgctggtgatcaggaaagcccgctgccccacccctcgggcccacccgtacagaggctggtggtcgccgggataattaatgaccaccgccaattcatccctcacgtgtctcctctcttccctagcccgtctggcacagagggtggacctgttagaggagtggaggggctgcctggggaatgggacagagggattctctttccctaatttttttggttgtcctttttctttgaaaaacttgtaatttattgaagttttactcaatccaaataaaacttaatttattgaagaca

SEQ ID NO: 163404 - DNA, 3030 bp, Homo sapiens
  Payload ID: 12191
  Gene Symbol: PHOX2B
  Gene Name: paired-like homeobox 2b
  Uniprot ID: Q99453
  ENST ID: ENST00000226382
  CDS Start-End: 361-1305
ttaaattctaattagagatgcaggaatcaatgatagggaggttggacagctcagttccccagtgccagcccaatagacggatgagttattgtcatgtaaaaagcgccagcaataagaccaaccgctttgctattgtccaagtggaaagagccaagtttattatgaggactatatgctctagagacctcagacaaggcatctcataggaggctttttcataaaactaggctctgctggtagtaaggaggccagtttggaggcaggcgttgagctgtgcacatctccccactccagccaccttctccatatccatcttttatttcatttttccacttggctgagccatccagaaccttttcaatgtataaaatggaatattcttacctcaattcctctgcctacgagtcctgtatggctgggatggacacctcgagcctggcttcagcctatgctgacttcagttcctgcagccaggccagtggcttccagtataacccgataaggaccacttttggggccacgtccggctgcccttccctcacgccgggatcctgcagcctgggcaccctcagggaccaccagagcagtccgtacgccgcagttccttacaaactcttcacggaccacggcggcctcaacgagaagcgcaagcagcggcgcatccgcaccactttcaccagtgcccagctcaaagagctggaaagggtcttcgcggagactcactaccccgacatctacactcgggaggagctggccctgaagatcgacctcacagaggcgcgagtccaggtgtggttccagaaccgccgcgccaagtttcgcaagcaggagcgcgcagcggcagccgcagcggccgcggccaagaacggctcctcgggcaaaaagtctgactcttccagggacgacgagagcaaagaggccaagagcactgacccggacagcactgggggcccaggtcccaatcccaaccccacccccagctgcggggcgaatggaggcggcggcggcgggcccagcccggctggagctccgggggcggcggggcccgggggcccgggaggcgaacccggcaagggcggcgcagcagcagcggcggcggccgcggcagcggcggcggcggcagcggcagcggcggcagctggaggcctggctgcggctgggggccctggacaaggctgggctcccggccccggccccatcacctccatcccggattcgcttgggggtcccttcgccagcgtcctatcttcgctccaaagacccaacggtgccaaagccgccttagtgaagagcagtatgttctgatctggaatcctgcggcggcggcggcggcggcgacagcgggcgagccagggcccgggcgggcgagtgggcgagcgggtaggcccaaggctattgtcgtcgctgctgccatggctttttcattgagggcctaaagtaatcgcgctaagaataaagggaaaacggcgtcgccctcatttcaaccccactcctacccccttcctcaacccccaaacaaaacaaacaaacttccctggcttcgcacctgcctggggcctcgcagcggggccagggctccgcctgctgatcgggggttgtgagcagcgcggcctggacgcggggcactctcagggggctgtgtctgcgtgtcagtttgtgtctgtctcggggaatgtgtgtctgtggcccaagcaggtgacaggaagagatggggggcctcaaccaacttagtgacttgtttagaaaaaaaagacaaaaaagtaaaaataaaaacaaaaaagttggaaggcagaaaccattaaaaaacaaaaagccaacaacccagaaaggtttaaaaaacataaggaaaaaaaagacaaattaaaggaggggctaggggagaagctgcagctggagctgaaggctcgatcttgtgaacccctaaatccgctccctcctaacagcacggattctcttggggctcttcttcagggaagagtagggacgccgttccagccccccttcctatcgtgtccttgggttcgggtcactgcggcgacgacttgctcagactgtcccggcggccggagtgactttctcgcacccccttgcctgtcccacctcgctgaacaccatcccgccattagcgcatcggaaccccacacagttgcaactcccaaccccgaatctttgcagccgttcggccctgaaagatgccctatccatgagatgccttttcatctgcaaactctgcaaaatgtgtctcatgtttcgcaactctttttttccccctcgctcccgcctaccccgtcggcattttcttcttccaccagcttttactgaactttttggcactgctttggattggggtcaattgcagtccacgtaactggctgcagagaaatctaccgagcaaggaaaaggcacacacacacgtttgcaggggtgtctcggtttgcatttctgttggaatgatccgaactggactcacatcctgtatggtggatggactgtatattgagggttccattcttcgcgcagtttagacatctctgttttgattctttgttgttgtttttattttaaaaggcacaaactctagatattagttgaatgttgaggctttaactttttcggtgtctttctacaactgtgttctgtgactcaattgtatcgtgttaatatcagtgcagactgtctcctctacgtgaccgtataatgtttttctcttcttgtagtctctatggcgtgtctttatggtgtaataaggttctcacgggttcaatcttttgtgtttagagaggccacggttcagacaatggtatatatttttgttatcaggtgcatgtctgtctgatttctttttttttcctgttggactatgtttgtgaacataattgtcataagttatgtttcagatttttgaatttatttatatgtgttataatgaatgcttctatttaaaagggaaatatttctacatgtgcatatagttttccaagagtgtaccattaacttgattgttgataataaaaacaaaaagcaagtcta

SEQ ID NO: 163405 - DNA, 2406 bp, Homo sapiens
  Payload ID: 12192
  Gene Symbol: PITX1
  Gene Name: paired-like homeodomain 1
  Uniprot ID: P78337
  ENST ID: ENST00000265340
  CDS Start-End: 418-1362
cccaggcccaccccacccagcacccctggcgcagggactgctggaacctggctgtgcgcgctgtcgctttaagacagactctgccggcgccgtccggagccttagaaaccggccccggatcgcgagccggagccggagccggagccggggccggccgggctgctgaggcccgagcggcaggagcgcagcgcggagcgctgagccaggcgcccagtcgcgagaagctgccgccgcctctgcccgcccggcgccgcagccccgggcggtccatggggcgggcacggcgtcgctgcaggcgccggcagccctggagggcagccgcttaggcgctgcgctcttgtccccgcaggtcgcagccagggcggcggggcgcgcccagccccggcccctggagcgcccgccgcggtccccacctccatggacgccttcaaggggggcatgagcctggagcggctgccggaggggctccggccgccgccgccgccaccccatgacatggggcccgccttccacctggcccggcccgccgacccccgcgagccgctcgagaactccgccagcgagtcgtctgacacggagctgccagagaaggagcgcggcggggaacccaaggggcccgaggacagtggtgcgggaggcacgggctgcggcggcgcagacgacccagccaagaagaagaagcagcggcggcaacgtacgcacttcacaagccagcagttgcaagagctagaggccacgttccagaggaaccgctaccccgacatgagcatgagggaggagatcgccgtgtggaccaacctcaccgagccgcgcgtgcgggtctggttcaagaaccggcgagccaagtggcgtaagcgcgagcgtaaccagcagctggacctgtgcaagggtggctacgtgccgcagttcagcggcctagtgcagccctacgaggacgtgtacgccgccggctactcctacaacaactgggccgccaagagcctggcgccagcgccgctctccaccaagagcttcaccttcttcaactccatgagcccgctgtcgtcgcagtccatgttctcagcacccagctccatctcctccatgaccatgccgtccagcatgggcccaggcgccgtgcctggcatgcccaactcgggcctcaacaacatcaacaacctcaccggctcctcgctcaactcggccatgtcgccgggcgcttgcccgtacggcactcccgcctcgccctacagcgtctaccgggacacgtgcaactcgagcctagccagcctgcggctcaagtccaaacagcactcgtcgtttggctacggcggcctgcagggcccggcctcgggcctcaacgcgtgccagtacaacagctgaccgccccgccgcaccacgcgggccggcggccggagcggggaagggcgcgggcgcgggcgcggaggacgcacgcggggccccggctcgcaagccccagctcaccgcgccgcggacctcacacctgcgcagccccctcctcccacttcccactccgggttggttttgtgtttgcttttccggaccccactctgccctccaaaaagacaaaaaaaaaaaaaaaaaaaaaaaagcaaaaagacgtcggagaaaagtgccgcgaaaaaatggatgagttgcaatttctctcgggatggcgcgggtggtgtgtgtgttcccacgggccccggaggcccactccgcggagggcacgcggcgcggtaggcgagcgccgaggcccagcggccgggggaggacgacctcgtatcccgcgtccccgccgcgctggatccggactgagtggccgggcctgcggactggatgtgcggggcctggacttgcctaggatttcccgaccccgtacaaaccaagttgccctctccgagctaggcccggccgagagcgccttagctcgagtcggatccgtgttggggcgggcgttgggtttggggggacggtgcccccagcccaggatcgggcactcagtggagccgcacacggccccggcgcgcctggtagagcctcgctggccccgcgccccggagccctatattaaggccacggagcgacagcgggcagtgcgggcctggcgggaggtgggggaggtccatctcagaacaccccagccttgagcttagctgcaggcccaggccctctgctctgctcccgggctaggaggtggccctctgtctgggcgaacagccccctcctcaccgcccgccgtgcaagagtcgagccggcagagcaaggggcgcggccccagggccctgcgcccactttgcacacccgctctccggcccgcgcccctgtttacagcgtccctgtgtatgttggactgactgtaataaatctgtctatatcgacttgtccatgtacgtctattaaaaccatagtccgagcgtgctaagc

SEQ ID NO: 163406 - DNA, 587 bp, Homo sapiens
  Payload ID: 12192
  Gene Symbol: PITX1
  Gene Name: paired-like homeodomain 1
  ENST ID: ENST00000507253
  CDS Start-End: 196-587
agttcccgggagaagaggctggagaaggaggggcaggcggcccctcgacgaggacaccgctgggagctgccggaacgggccccgggctctgcccccgccccggcgctggctcgaaggcgcccgctcggtcgcagccagggcggcggggcgcgcccagccccggcccctggagcgcccgccgcggtccccacctccatggacgccttcaaggggggcatgagcctggagcggctgccggaggggctccggccgccgccgccgccaccccatgacatggggcccgccttccacctggcccggcccgccgacccccgcgagccgctcgagaactccgccagcgagtcgtctgacacggagctgccagagaaggagcgcggcggggaacccaaggggcccgaggacagtggtgcgggaggcacgggctgcggcggcgcagacgacccagccaagaagaagaagcagcggcggcaacgtacgcacttcacaagccagcagttgcaagagctagaggccacgttccagaggaaccgctaccccgacatgagcatgagggaggagatcgccgtgtggaccaacctcaccgagcc

SEQ ID NO: 163407 - DNA, 666 bp, Homo sapiens
  Payload ID: 12192
  Gene Symbol: PITX1
  Gene Name: paired-like homeodomain 1
  ENST ID: ENST00000502676
  CDS Start-End: 325-666
ccgctgggagctgccggaacgggccccgggctctgcccccgccccggcgctggctcgaaggcgcccgctcggtgcgatcctgttcggcaaacattcactcatcctgggctgttctcgccagggctggggacttcgaggcggccgagacgggagttgattctaggcgaaacaagtcatttgaggcctgaggtgtgcacgagccgcccgggactcgcaggccagatgcgtttcttttgtgaggccgagggagaactcggtcgcagccagggcggcggggcgcgcccagccccggcccctggagcgcccgccgcggtccccacctccatggacgccttcaaggggggcatgagcctggagcggctgccggaggggctccggccgccgccgccgccaccccatgacatggggcccgccttccacctggcccggcccgccgacccccgcgagccgctcgagaactccgccagcgagtcgtctgacacggagctgccagagaaggagcgcggcggggaacccaaggggcccgaggacagtggtgcgggaggcacgggctgcggcggcgcagacgacccagccaagaagaagaagcagcggcggcaacgtacgcacttcacaagccagcagttgcaagagctagaggccacgttccagaggaaccgctacccc

SEQ ID NO: 163408 - DNA, 1305 bp, Homo sapiens
  Payload ID: 12192
  Gene Symbol: PITX1
  Gene Name: paired-like homeodomain 1
  Uniprot ID: P78337
  ENST ID: ENST00000506438
  CDS Start-End: 135-1079
ctggggacttcgaggcggccgagacgggagttgattctaggcgaaacaagtcatttgaggcctgaggtcgcagccagggcggcggggcgcgcccagccccggcccctggagcgcccgccgcggtccccacctccatggacgccttcaaggggggcatgagcctggagcggctgccggaggggctccggccgccgccgccgccaccccatgacatggggcccgccttccacctggcccggcccgccgacccccgcgagccgctcgagaactccgccagcgagtcgtctgacacggagctgccagagaaggagcgcggcggggaacccaaggggcccgaggacagtggtgcgggaggcacgggctgcggcggcgcagacgacccagccaagaagaagaagcagcggcggcaacgtacgcacttcacaagccagcagttgcaagagctagaggccacgttccagaggaaccgctaccccgacatgagcatgagggaggagatcgccgtgtggaccaacctcaccgagccgcgcgtgcgggtctggttcaagaaccggcgagccaagtggcgtaagcgcgagcgtaaccagcagctggacctgtgcaagggtggctacgtgccgcagttcagcggcctagtgcagccctacgaggacgtgtacgccgccggctactcctacaacaactgggccgccaagagcctggcgccagcgccgctctccaccaagagcttcaccttcttcaactccatgagcccgctgtcgtcgcagtccatgttctcagcacccagctccatctcctccatgaccatgccgtccagcatgggcccaggcgccgtgcctggcatgcccaactcgggcctcaacaacatcaacaacctcaccggctcctcgctcaactcggccatgtcgccgggcgcttgcccgtacggcactcccgcctcgccctacagcgtctaccgggacacgtgcaactcgagcctagccagcctgcggctcaagtccaaacagcactcgtcgtttggctacggcggcctgcagggcccggcctcgggcctcaacgcgtgccagtacaacagctgaccgccccgccgcaccacgcgggccggcggccggagcggggaagggcgcgggcgcgggcgcggaggacgcacgcggggccccggctcgcaagccccagctcaccgcgccgcggacctcacacctgcgcagccccctcctcccacttcccactccgggttggttttgtgtttgcttttccggaccccactctgccctccaaaaagacaaaaaaaaaaaaaaaaaaaaa

SEQ ID NO: 163409 - DNA, 624 bp, Homo sapiens
  Payload ID: 12192
  Gene Symbol: PITX1
  Gene Name: paired-like homeodomain 1
  ENST ID: ENST00000503586
  CDS Start-End: 1-624
gccgatcaagggatccggcccacgtgcgcggccgaagcccggagcagcccggctctggcccccgccccggctcctgcgcgtctccctccgcgctgcctttttttgtccgagctggagcttttttccagcagcgaactgggcccgcgggtggccggcgcgggcagtggggcagcgaatccgctgcccagcgcagccggccgggttccggaggggctccgagctccccggtgtgggcgcctcttctgcgttcatttcttaatacacagctgaatgtttctctccactttcttaagaaggagcgcggcggggaacccaaggggcccgaggacagtggtgcgggaggcacgggctgcggcggcgcagacgacccagccaagaagaagaagcagcggcggcaacgtacgcacttcacaagccagcagttgcaagagctagaggccacgttccagaggaaccgctaccccgacatgagcatgagggaggagatcgccgtgtggaccaacctcaccgagccgcgcgtgcgggtctggttcaagaaccggcgagccaagtggcgtaagcgcgagcgtaaccagcagctggacctgtgcaagggtggctacgtgccgcagttcagcggcctag

SEQ ID NO: 163410 - DNA, 2320 bp, Homo sapiens
  Payload ID: 12193
  Gene Symbol: PITX2
  Gene Name: paired-like homeodomain 2
  Uniprot ID: Q99697
  ENST ID: ENST00000306732
  CDS Start-End: 644-1618
aagatgttaggccaacagggaagcgcggagccgcagatctggtccgtcgctcgcctgggtgcctggagctgagctgcggcaaggcccggctcctgttcgaccgcccgaggggtgtgcgtgtgcgcgttgcggagggtgcgctcagagggccgcgtcgtggctgcagcggctgctgccgccgcaggggatctaatatcacctacctgtccctgtcactcttgacacttctctgtcagggctgccgcgtggggggggggcgggcagagcgcggtcggcgttagctttccttattggaggggttcttgggggagggagggagagaagaagggggtctttgcccactcttgtttcgctttggagcttggaagcctgctccctaaagacgctctgagtggtgcccttctgcccacatcccatgtcttcgtttgcccgctgactttccgtctccggactttttcgcttgagccttccggaggagacgggggcagcttggcttgagaactcggcgggggttgcgtcccctggctctccccgcagcggggaaactccgcgcctagagcgcgacccggagcgggcagcggcggctacgggggctcggcggggcagtagccaaggactagtagagcgtcgcgctccctcgtccatgaactgcatgaaaggcccgcttcacttggagcaccgagcagcggggaccaagctgtcggccgtctcctcatcttcctgtcaccatccccagccgttagccatggcttcggttctggctcccggtcagccccggtcgctggactcctccaagcacaggctggaggtgcacaccatctccgacacctccagcccggaggccgcagagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtttggttcaagaatcgtcgggccaaatggagaaagagggagcgcaaccagcaggccgagctatgcaagaatggcttcgggccgcagttcaatgggctcatgcagccctacgacgacatgtacccaggctattcctacaacaactgggccgccaagggccttacatccgcctccctatccaccaagagcttccccttcttcaactctatgaacgtcaaccccctgtcatcacagagcatgttttccccacccaactctatctcgtccatgagcatgtcgtccagcatggtgccctcagcagtgacaggcgtcccgggctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcagcactccagcttcggctacgccagcgtgcagaacccggcctccaacctgagtgcttgccagtatgcagtggaccggcccgtgtgagccgcacccacagcgccgggatcctaggaccttgccggatggggcaactccgcccttgaaagactgggaattatgctagaaggtcgtgggcactaaagaaagggagagaaagagaagctatatagagaaaaggaaaccactgaatcaaagagagagctcctttgatttcaaagggatgtcctcagtgtctgacatctttcactacaagtatttctaacagttgcaaggacacatacacaaacaaatgtttgactggatatgacattttaacattactataagcttgttattttttaagtttagcattgttaacatttaaatgactgaaaggatgtatatatatcgaaatgtcaaattaattttataaaagcagttgttagtaatatcacaacagtgtttttaaaggttaggctttaaaataaagcatgttatacagaagcgattaggatttttcgcttgcgagcaagggagtgtatatactaaatgccacactgtatgtttctaacatattattattattataaaaaatgtgtgaatatcagttttagaatagtttctctggtggatgcaatgatgtttctgaaactgctatgtacaacctaccctgtgtataacatttcgtacaatattattgttttacttttcagcaaatatgaaacaaatgtgttttatttcatgggagtaaaatatactgcatacaaa

SEQ ID NO: 163411 - DNA, 3359 bp, Homo sapiens
  Payload ID: 12193
  Gene Symbol: PITX2
  Gene Name: paired-like homeodomain 2
  Uniprot ID: Q99697
  ENST ID: ENST00000354925
  CDS Start-End: 1707-2660
tcagagggatcaatatacaggccctaccacggaaaggcggggaaaaggttcgaatagaaaactgctgcagaagggaagccactgagaggagcaaatgtggacttgagggaaactctctcccccacccccacttctatcccgtgcaatttaataccatcctcgccaggaaccttaacctcgtcattttaaaaaatgagatatccgtgacccagggtgaacttgttgaatgtaggtacagcagaggaaattctagactctatgagcgtctgagccttgtccagtgcaaacccttcgtgaacactgggtcagtgcgtggccgtgcccacctgtgcgccgacactctcagcatgcctggtccacccgccttgacctcgggcgcggtgtcccagctaagctgggcccagcgtcccggccttccccagctgacaagcctagctcgttcgctcccggctgtggccctcccaccctctcccactagctcactccattcttctagatttctcttcactcatcctctcccatccccaccgcgcccacctccactcccgccctctaccggtctctcactttcctccctccgcagtccctctttgctgtgacctctttcctcaactctgcaggcctgaaagaaggtcacacacgcacgctcacacccacactccacacgcctcgtcccaaacaaccccatgaacattgtcctttgttccgtctcttgggccactttccctgtcgcttcctcccagcccgtcctgatttgctccccaaaagtacgtttctgtctccccgctgccctggcgctccccctttgatttattagggctgccgggttggcgcagattgctttttcttctcttccatcccatcctcccttctggtcctcctttccacagtgggagtccgtgctcctgctcctcggttggctcctaagtgccccgccaggtcccctctcctttcgctctcccggctccggctcccgactcttcggcccgctggcatctgcttccctcccctgcctcgtttctcgtcgcccctgctcgctccccccggcgctcgcccgggcgctgtgctcgctcctggatcgccagccgcgcagccgggctcggccggccgcccgcgcgccactgtgcagtggagtttggtggaatctctgctgacgtcacgtcactccccacacggagtaggagcagagggaagagagagggatgagagggagggagaggagagagagtgcgagaccgagcgagaaagctggagaggagcagaaagaaactgccagtggcggctagatttcggaggccccagtgcacccgtggactccttcggaacttggcaccctcaggagccctgcagtcctctcaggcccggctttcgggcgcttgccgtgcagccggaggctcggctcgctggaaatcgccccgggaagcagtgggacgcggagacagcagctctctcccggtagccgaatcactaaatctggagccgccaaactgctacttctgggcccacgggcccacaaggatcgaatcggcagagtccccgcccgcgttctcgctagcgggtgggggaaccgcctggccgtccccaccctggatccccacgccacagcgccgggcagcccctcctgtaggcagcgaccttggccagaggctccccagggcccagctcccttcaggagaggccgagacgcagggaaacgataacggggaatggagaccaactgccgcaaactggtgtcggcgtgtgtgcaattaggcgtgcagccggcggccgttgaatgtctcttctccaaagactccgaaatcaaaaaggtcgagttcacggactctcctgagagccgaaaagaggcagccagcagcaagttcttcccgcggcagcatcctggcgccaatgagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtttggttcaagaatcgtcgggccaaatggagaaagagggagcgcaaccagcaggccgagctatgcaagaatggcttcgggccgcagttcaatgggctcatgcagccctacgacgacatgtacccaggctattcctacaacaactgggccgccaagggccttacatccgcctccctatccaccaagagcttccccttcttcaactctatgaacgtcaaccccctgtcatcacagagcatgttttccccacccaactctatctcgtccatgagcatgtcgtccagcatggtgccctcagcagtgacaggcgtcccgggctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcagcactccagcttcggctacgccagcgtgcagaacccggcctccaacctgagtgcttgccagtatgcagtggaccggcccgtgtgagccgcacccacagcgccgggatcctaggaccttgccggatggggcaactccgcccttgaaagactgggaattatgctagaaggtcgtgggcactaaagaaagggagagaaagagaagctatatagagaaaaggaaaccactgaatcaaagagagagctcctttgatttcaaagggatgtcctcagtgtctgacatctttcactacaagtatttctaacagttgcaaggacacatacacaaacaaatgtttgactggatatgacattttaacattactataagcttgttattttttaagtttagcattgttaacatttaaatgactgaaaggatgtatatatatcgaaatgtcaaattaattttataaaagcagttgttagtaatatcacaacagtgtttttaaaggttaggctttaaaataaagcatgttatacagaagcgattaggatttttcgcttgcgagcaagggagtgtatatactaaatgccacactgtatgtttctaacatattattattattataaaaaatgtgtgaatatcagttttagaatagtttctctggtggatgcaatgatgtttctgaaactgctatgtacaacctaccctgtgtataacatttcgtacaatattattgttttacttttcagcaaatatgaaacaaatgtgttttatttcatgggagtaaaatatactgcatac

SEQ ID NO: 163412 - DNA, 2100 bp, Homo sapiens
  Payload ID: 12193
  Gene Symbol: PITX2
  Gene Name: paired-like homeodomain 2
  Uniprot ID: Q99697
  ENST ID: ENST00000355080
  CDS Start-End: 583-1398
tgggagtccgtgctcctgctcctcggttggctcctaagtgccccgccaggtcccctctcctttcgctctcccggctccggctcccgactcttcggcccgctggcatctgcttccctcccctgcctcgtttctcgtcgcccctgctcgctccccccggcgctcgcccgggcgctgtgctcgctcctggatcgccagccgcgcagccgggctcggccggccgcccgcgcgccactgtgcagtggagtttggtggaatctctgctgacgtcacgtcactccccacacggagtaggagcagagggaagagagagggatgagagggagggagaggagagagagtgcgagaccgagcgagaaagctggagaggagcagaaagaaactgccagtggcggctagatttcggaggccccagtgcacccgtggactccttcggaacttggcaccctcaggagccctgcagtcctctcaggcccggctttcgggcgcttgccgtgcagccggaggctcggctcgctggaaatcgccccgggaagcagtgggacgcggagacagcagctctctcccggtagccgataacggggaatggagaccaactgccgcaaactggtgtcggcgtgtgtgcaattagagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtttggttcaagaatcgtcgggccaaatggagaaagagggagcgcaaccagcaggccgagctatgcaagaatggcttcgggccgcagttcaatgggctcatgcagccctacgacgacatgtacccaggctattcctacaacaactgggccgccaagggccttacatccgcctccctatccaccaagagcttccccttcttcaactctatgaacgtcaaccccctgtcatcacagagcatgttttccccacccaactctatctcgtccatgagcatgtcgtccagcatggtgccctcagcagtgacaggcgtcccgggctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcagcactccagcttcggctacgccagcgtgcagaacccggcctccaacctgagtgcttgccagtatgcagtggaccggcccgtgtgagccgcacccacagcgccgggatcctaggaccttgccggatggggcaactccgcccttgaaagactgggaattatgctagaaggtcgtgggcactaaagaaagggagagaaagagaagctatatagagaaaaggaaaccactgaatcaaagagagagctcctttgatttcaaagggatgtcctcagtgtctgacatctttcactacaagtatttctaacagttgcaaggacacatacacaaacaaatgtttgactggatatgacattttaacattactataagcttgttattttttaagtttagcattgttaacatttaaatgactgaaaggatgtatatatatcgaaatgtcaaattaattttataaaagcagttgttagtaatatcacaacagtgtttttaaaggttaggctttaaaataaagcatgttatacagaagcgattaggatttttcgcttgcgagcaagggagtgtatatactaaatgccacactgtatgtttctaacatattattattattataaaaaatgtgtgaatatcagttttagaatagtttctctggtggatgcaatgatgtttctgaaactgctatgtacaacctaccctgtgtataacatttcgtacaatattattgttttacttttcagcaaatatgaaacaaatgtgttttatttcatgggagtaaaatatactgcatacaaa

SEQ ID NO: 163413 - DNA, 1693 bp, Homo sapiens
  Payload ID: 12193
  Gene Symbol: PITX2
  Gene Name: paired-like homeodomain 2
  ENST ID: ENST00000394595
  CDS Start-End: 257-781
gaggagagagagtgcgagaccgagcgagaaagctggagaggagcagaaagaaactgccagtggcggctagatttcggaggccccagtgcacccgtggactccttcggaacttggcaccctcaggagccctgcagtcctctcaggcccggctttcgggcgcttgccgtgcagccggaggctcggctcgctggaaatcgccccgggaagcagtgggacgcggagacagcagctctctcccggtagccgataacggggaatggagaccaactgccgcaaactggtgtcggcgtgtgtgcaattaggcgtgcagccggcggccgttgaatgtctcttctccaaagactccgaaatcaaaaaggtcgagttcacggactctcctgagagccgaaaagaggcagccagcagcaagttcttcccgcggcagcatcctggcgccaatggtttggttcaagaatcgtcgggccaaatggagaaagagggagcgcaaccagcaggccgagctatgcaagaatggcttcgggccgcagttcaatgggctcatgcagccctacgacgacatgtacccaggctattcctacaacaactgggccgccaagggccttacatccgcctccctatccaccaagagcttccccttcttcaactctatgaacgtcaaccccctgtcatcacagagcatgttttccccacccaactctatctcgtccatgagcatgtcgtccagcatggtgccctcagcagtgacaggcgtcccgggctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcagcactccagcttcggctacgccagcgtgcagaacccggcctccaacctgagtgcttgccagtatgcagtggaccggcccgtgtgagccgcacccacagcgccgggatcctaggaccttgccggatggggcaactccgcccttgaaagactgggaattatgctagaaggtcgtgggcactaaagaaagggagagaaagagaagctatatagagaaaaggaaaccactgaatcaaagagagagctcctttgatttcaaagggatgtcctcagtgtctgacatctttcactacaagtatttctaacagttgcaaggacacatacacaaacaaatgtttgactggatatgacattttaacattactataagcttgttattttttaagtttagcattgttaacatttaaatgactgaaaggatgtatatatatcgaaatgtcaaattaattttataaaagcagttgttagtaatatcacaacagtgtttttaaaggttaggctttaaaataaagcatgttatacagaagcgattaggatttttcgcttgcgagcaagggagtgtatatactaaatgccacactgtatgtttctaacatattattattattataaaaaatgtgtgaatatcagttttagaatagtttctctggtggatgcaatgatgtttctgaaactgctatgtacaacctaccctgtgtataacatttcgtacaatattattgttttacttttcagcaaatatgaaacaaatgtgttttatttcatgggagtaaaata

SEQ ID NO: 163414 - DNA, 1906 bp, Homo sapiens
  Payload ID: 12193
  Gene Symbol: PITX2
  Gene Name: paired-like homeodomain 2
  Uniprot ID: Q99697
  ENST ID: ENST00000394598
  CDS Start-End: 251-1204
agagagtgcgagaccgagcgagaaagctggagaggagcagaaagaaactgccagtggcggctagatttcggaggccccagtgcacccgtggactccttcggaacttggcaccctcaggagccctgcagtcctctcaggcccggctttcgggcgcttgccgtgcagccggaggctcggctcgctggaaatcgccccgggaagcagtgggacgcggagacagcagctctctcccggtagccgataacggggaatggagaccaactgccgcaaactggtgtcggcgtgtgtgcaattaggcgtgcagccggcggccgttgaatgtctcttctccaaagactccgaaatcaaaaaggtcgagttcacggactctcctgagagccgaaaagaggcagccagcagcaagttcttcccgcggcagcatcctggcgccaatgagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtttggttcaagaatcgtcgggccaaatggagaaagagggagcgcaaccagcaggccgagctatgcaagaatggcttcgggccgcagttcaatgggctcatgcagccctacgacgacatgtacccaggctattcctacaacaactgggccgccaagggccttacatccgcctccctatccaccaagagcttccccttcttcaactctatgaacgtcaaccccctgtcatcacagagcatgttttccccacccaactctatctcgtccatgagcatgtcgtccagcatggtgccctcagcagtgacaggcgtcccgggctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcagcactccagcttcggctacgccagcgtgcagaacccggcctccaacctgagtgcttgccagtatgcagtggaccggcccgtgtgagccgcacccacagcgccgggatcctaggaccttgccggatggggcaactccgcccttgaaagactgggaattatgctagaaggtcgtgggcactaaagaaagggagagaaagagaagctatatagagaaaaggaaaccactgaatcaaagagagagctcctttgatttcaaagggatgtcctcagtgtctgacatctttcactacaagtatttctaacagttgcaaggacacatacacaaacaaatgtttgactggatatgacattttaacattactataagcttgttattttttaagtttagcattgttaacatttaaatgactgaaaggatgtatatatatcgaaatgtcaaattaattttataaaagcagttgttagtaatatcacaacagtgtttttaaaggttaggctttaaaataaagcatgttatacagaagcgattaggatttttcgcttgcgagcaagggagtgtatatactaaatgccacactgtatgtttctaacatattattattattataaaaaatgtgtgaatatcagttttagaatagtttctctggtggatgcaatgatgtttctgaaactgctatgtacaacctaccctgtgtataacatttcgtacaatattattgttttacttttcagcaaatatgaaacaaatgtgttttatttcatgggagtaaaatatactgcatacaaa

SEQ ID NO: 163415 - DNA, 1085 bp, Homo sapiens
  Payload ID: 12193
  Gene Symbol: PITX2
  Gene Name: paired-like homeodomain 2
  ENST ID: ENST00000511837
  CDS Start-End: 216-1085
gcagtctgtgtaagttttcatatctctgagtgtgtgcacacagtggagagggtggagcctgccatcctcaaatctgaaaagattgagagatttcagagggcccagatgtgccaaaggtcagagggatcaatatacaggccctaccacggaaaggcggggaaaaggttcgaatagaaaactgctgcagaagggaagccactgagagataacggggaatggagaccaactgccgcaaactggtgtcggcgtgtgtgcaattaggcgtgcagccggcggccgttgaatgtctcttctccaaagactccgaaatcaaaaaggtcgagttcacggactctcctgagagccgaaaagaggcagccagcagcaagttcttcccgcggcagcatcctggcgccaatgagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtttggttcaagaatcgtcgggccaaatggagaaagagggagcgcaaccagcaggccgagctatgcaagaatggcttcgggccgcagttcaatgggctcatgcagccctacgacgacatgtacccaggctattcctacaacaactgggccgccaagggccttacatccgcctccctatccaccaagagcttccccttcttcaactctatgaacgtcaaccccctgtcatcacagagcatgttttccccacccaactctatctcgtccatgagcatgtcgtccagcatggtgccctcagcagtgacaggcgtcccgggctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcag

SEQ ID NO: 163416 - DNA, 463 bp, Homo sapiens
  Payload ID: 12193
  Gene Symbol: PITX2
  Gene Name: paired-like homeodomain 2
  ENST ID: ENST00000511990
  CDS Start-End: 109-463
gtgccaaaggtcagagggatcaatatacaggccctaccacggaaaggcggggaaaaggttcgaatagaaaactgctgcagaagggaagccactgagagataacggggaatggagaccaactgccgcaaactggtgtcggcgtgtgtgcaattagagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtttggttcaagaatcgtcgggccaaatggagaaagagggagcgcaaccagcaggccgagctatgcaagaatggcttcgggccgcagttcaatgggctcatgc

SEQ ID NO: 163417 - DNA, 1889 bp, Homo sapiens
  Payload ID: 12193
  Gene Symbol: PITX2
  Gene Name: paired-like homeodomain 2
  ENST ID: ENST00000557119
  CDS Start-End: 592-1386
gcctgggtgcctggagctgagctgcggcaaggcccggctcctgttcgaccgcccgaggggtgtgcgtgtgcgcgttgcggagggtgcgctcagagggccgcgtcgtggctgcagcggctgctgccgccgcaggggatctaatatcacctacctgtccctgtcactcttgacacttctctgtcagggctgccgcgtggggggggggcgggcagagcgcggtcggcgttagctttccttattggaggggttcttgggggagggagggagagaagaagggggtctttgcccactcttgtttcgctttggagcttggaagcctgctccctaaagacgctctgagtggtgcccttctgcccacatcccatgtcttcgtttgcccgctgactttccgtctccggactttttcgcttgagccttccggaggagacgggggcagcttggcttgagaactcggcgggggttgcgtcccctggctctccccgcagcggggaaactccgcgcctagagcgcgacccggagcgggcagcggcggctacgggggctcggcggggcagtagccaaggactagtagagcgtcgcgctccctcgtccatgaactgcatgaaaggcccgcttcacttggagcaccgagcagcggggaccaagctgtcggccgtctcctcatcttcctgtcaccatccccagccgttagccatggcttcggttctggctcccggtcagccccggtcgctggactcctccaagcacaggctggaggtgcacaccatctccgacacctccagcccggaggccgcagagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtaggagccagcacggagtctgggagggatggggggaggatgttgtggaggtacaggccaagtagaccaggagagaatgtggaaggcagcgccgcctgggagggcgccggtggggcgcagctttgcaaaggcagaaggcctcgcggcggcctggttgcgagattacagttccctctccgaggccgacaggactgccgccctggctcaggctcccagagcggcaccggctcactgccccgccatcccgcgatctcacgagctgggctgcatgggcaatcccctgcacaggacattgtgttcctggcttgcagttgccagagcagagctaataaaatccctaccaggccaagagccgcgaacaggctccaacctgtgagcctttaacaaggaaaacccgccagagacacggaagagttggccctccctgggaaacctttgtcccggccctggcccagctttttccctcctgggctcgcgcttcttacaccttctttacggttgtttcggccattcaggtctctcccacacaccctatttcctagttttgtgatctccgggagcaaagttttaatacacaactactagtcctcttagaaggagaaagaaaaaaagaagaaagacttttctgcttggtttatttatcttctctcaggagttgaactctggaaattgaaactcacaccccctcttctaaattataatcatagttttgtaaaaagggcttaccttaactttgtagcaaatctgtactttatggattggcaaaaatgagctcaaataaataacccaatagcaacgtcctggtttatgctggtcggtggaagattccaaatttgttaggattctggaagcagaaaacagaatcaagcaaatcaagcggcatccag

SEQ ID NO: 163418 - DNA, 1866 bp, Homo sapiens
  Payload ID: 12193
  Gene Symbol: PITX2
  Gene Name: paired-like homeodomain 2
  Uniprot ID: Q99697
  ENST ID: ENST00000614423
  CDS Start-End: 216-1169
gcagtctgtgtaagttttcatatctctgagtgtgtgcacacagtggagagggtggagcctgccatcctcaaatctgaaaagattgagagatttcagagggcccagatgtgccaaaggtcagagggatcaatatacaggccctaccacggaaaggcggggaaaaggttcgaatagaaaactgctgcagaagggaagccactgagagataacggggaatggagaccaactgccgcaaactggtgtcggcgtgtgtgcaattaggcgtgcagccggcggccgttgaatgtctcttctccaaagactccgaaatcaaaaaggtcgagttcacggactctcctgagagccgaaaagaggcagccagcagcaagttcttcccgcggcagcatcctggcgccaatgagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtttggttcaagaatcgtcgggccaaatggagaaagagggagcgcaaccagcaggccgagctatgcaagaatggcttcgggccgcagttcaatgggctcatgcagccctacgacgacatgtacccaggctattcctacaacaactgggccgccaagggccttacatccgcctccctatccaccaagagcttccccttcttcaactctatgaacgtcaaccccctgtcatcacagagcatgttttccccacccaactctatctcgtccatgagcatgtcgtccagcatggtgccctcagcagtgacaggcgtcccgggctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcagcactccagcttcggctacgccagcgtgcagaacccggcctccaacctgagtgcttgccagtatgcagtggaccggcccgtgtgagccgcacccacagcgccgggatcctaggaccttgccggatggggcaactccgcccttgaaagactgggaattatgctagaaggtcgtgggcactaaagaaagggagagaaagagaagctatatagagaaaaggaaaccactgaatcaaagagagagctcctttgatttcaaagggatgtcctcagtgtctgacatctttcactacaagtatttctaacagttgcaaggacacatacacaaacaaatgtttgactggatatgacattttaacattactataagcttgttattttttaagtttagcattgttaacatttaaatgactgaaaggatgtatatatatcgaaatgtcaaattaattttataaaagcagttgttagtaatatcacaacagtgtttttaaaggttaggctttaaaataaagcatgttatacagaagcgattaggatttttcgcttgcgagcaagggagtgtatatactaaatgccacactgtatgtttctaacatattattattattataaaaaatgtgtgaatatcagttttagaatagtttctctggtggatgcaatgatgtttctgaaactgctatgtacaacctaccctgtgtataacatttcgtacaatattattgttttacttttcagcaaatatgaaacaaatgtgttttatttcatgggagtaaaatatactgcat

SEQ ID NO: 163419 - DNA, 3240 bp, Homo sapiens
  Payload ID: 12193
  Gene Symbol: PITX2
  Gene Name: paired-like homeodomain 2
  Uniprot ID: Q99697
  ENST ID: ENST00000613094
  CDS Start-End: 1590-2543
gcagtctgtgtaagttttcatatctctgagtgtgtgcacacagtggagagggtggagcctgccatcctcaaatctgaaaagattgagagatttcagagggcccagatgtgccaaaggtcagagggatcaatatacaggccctaccacggaaaggcggggaaaaggttcgaatagaaaactgctgcagaagggaagccactgagaggagcaaatgtggacttgagggaaactctctcccccacccccacttctatcccgtgcaatttaataccatcctcgccaggaaccttaacctcgtcattttaaaaaatgagatatccgtgacccagggtgaacttgttgaatgtaggtacagcagaggaaattctagactctatgagcgtctgagccttgtccagtgcaaacccttcgtgaacactgggtcagtgcgtggccgtgcccacctgtgcgccgacactctcagcatgcctggtccacccgccttgacctcgggcgcggtgtcccagctaagctgggcccagcgtcccggccttccccagctgacaagcctagctcgttcgctcccggctgtggccctcccaccctctcccactagctcactccattcttctagatttctcttcactcatcctctcccatccccaccgcgcccacctccactcccgccctctaccggtctctcactttcctccctccgcagtccctctttgctgtgacctctttcctcaactctgcaggcctgaaagaaggtcacacacgcacgctcacacccacactccacacgcctcgtcccaaacaaccccatgaacattgtcctttgttccgtctcttgggccactttccctgtcgcttcctcccagcccgtcctgatttgctccccaaaagtacgtttctgtctccccgctgccctggcgctccccctttgatttattagggctgccgggttggcgcagattgctttttcttctcttccatcccatcctcccttctggtcctcctttccacagtgggagtccgtgctcctgctcctcggttggctcctaagtgccccgccaggtcccctctcctttcgctctcccggctccggctcccgactcttcggcccgctggcatctgcttccctcccctgcctcgtttctcgtcgcccctgctcgctccccccggcgctcgcccgggcgctgtgctcgctcctggatcgccagccgcgcagccgggctcggccggccgcccgcgcgccactgtgcagtggagtttggtggaatctctgctgacgtcacgtcactccccacacggagtaggagcagagggaagagagagggatgagagggagggagaggagagagagtgcgagaccgagcgagaaagctggagaggagcagaaagaaactgccagtggcggctagatttcggaggccccagtgcacccgtggactccttcggaacttggcaccctcaggagccctgcagtcctctcaggcccggctttcgggcgcttgccgtgcagccggaggctcggctcgctggaaatcgccccgggaagcagtgggacgcggagacagcagctctctcccggtagccgataacggggaatggagaccaactgccgcaaactggtgtcggcgtgtgtgcaattaggcgtgcagccggcggccgttgaatgtctcttctccaaagactccgaaatcaaaaaggtcgagttcacggactctcctgagagccgaaaagaggcagccagcagcaagttcttcccgcggcagcatcctggcgccaatgagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtttggttcaagaatcgtcgggccaaatggagaaagagggagcgcaaccagcaggccgagctatgcaagaatggcttcgggccgcagttcaatgggctcatgcagccctacgacgacatgtacccaggctattcctacaacaactgggccgccaagggccttacatccgcctccctatccaccaagagcttccccttcttcaactctatgaacgtcaaccccctgtcatcacagagcatgttttccccacccaactctatctcgtccatgagcatgtcgtccagcatggtgccctcagcagtgacaggcgtcccgggctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcagcactccagcttcggctacgccagcgtgcagaacccggcctccaacctgagtgcttgccagtatgcagtggaccggcccgtgtgagccgcacccacagcgccgggatcctaggaccttgccggatggggcaactccgcccttgaaagactgggaattatgctagaaggtcgtgggcactaaagaaagggagagaaagagaagctatatagagaaaaggaaaccactgaatcaaagagagagctcctttgatttcaaagggatgtcctcagtgtctgacatctttcactacaagtatttctaacagttgcaaggacacatacacaaacaaatgtttgactggatatgacattttaacattactataagcttgttattttttaagtttagcattgttaacatttaaatgactgaaaggatgtatatatatcgaaatgtcaaattaattttataaaagcagttgttagtaatatcacaacagtgtttttaaaggttaggctttaaaataaagcatgttatacagaagcgattaggatttttcgcttgcgagcaagggagtgtatatactaaatgccacactgtatgtttctaacatattattattattataaaaaatgtgtgaatatcagttttagaatagtttctctggtggatgcaatgatgtttctgaaactgctatgtacaacctaccctgtgtataacatttcgtacaatattattgttttacttttcagcaaatatgaaacaaatgtgttttatttcatgggagtaaaatatactgcat

SEQ ID NO: 163420 - DNA, 3102 bp, Homo sapiens
  Payload ID: 12193
  Gene Symbol: PITX2
  Gene Name: paired-like homeodomain 2
  Uniprot ID: Q99697
  ENST ID: ENST00000616641
  CDS Start-End: 1590-2405
gcagtctgtgtaagttttcatatctctgagtgtgtgcacacagtggagagggtggagcctgccatcctcaaatctgaaaagattgagagatttcagagggcccagatgtgccaaaggtcagagggatcaatatacaggccctaccacggaaaggcggggaaaaggttcgaatagaaaactgctgcagaagggaagccactgagaggagcaaatgtggacttgagggaaactctctcccccacccccacttctatcccgtgcaatttaataccatcctcgccaggaaccttaacctcgtcattttaaaaaatgagatatccgtgacccagggtgaacttgttgaatgtaggtacagcagaggaaattctagactctatgagcgtctgagccttgtccagtgcaaacccttcgtgaacactgggtcagtgcgtggccgtgcccacctgtgcgccgacactctcagcatgcctggtccacccgccttgacctcgggcgcggtgtcccagctaagctgggcccagcgtcccggccttccccagctgacaagcctagctcgttcgctcccggctgtggccctcccaccctctcccactagctcactccattcttctagatttctcttcactcatcctctcccatccccaccgcgcccacctccactcccgccctctaccggtctctcactttcctccctccgcagtccctctttgctgtgacctctttcctcaactctgcaggcctgaaagaaggtcacacacgcacgctcacacccacactccacacgcctcgtcccaaacaaccccatgaacattgtcctttgttccgtctcttgggccactttccctgtcgcttcctcccagcccgtcctgatttgctccccaaaagtacgtttctgtctccccgctgccctggcgctccccctttgatttattagggctgccgggttggcgcagattgctttttcttctcttccatcccatcctcccttctggtcctcctttccacagtgggagtccgtgctcctgctcctcggttggctcctaagtgccccgccaggtcccctctcctttcgctctcccggctccggctcccgactcttcggcccgctggcatctgcttccctcccctgcctcgtttctcgtcgcccctgctcgctccccccggcgctcgcccgggcgctgtgctcgctcctggatcgccagccgcgcagccgggctcggccggccgcccgcgcgccactgtgcagtggagtttggtggaatctctgctgacgtcacgtcactccccacacggagtaggagcagagggaagagagagggatgagagggagggagaggagagagagtgcgagaccgagcgagaaagctggagaggagcagaaagaaactgccagtggcggctagatttcggaggccccagtgcacccgtggactccttcggaacttggcaccctcaggagccctgcagtcctctcaggcccggctttcgggcgcttgccgtgcagccggaggctcggctcgctggaaatcgccccgggaagcagtgggacgcggagacagcagctctctcccggtagccgataacggggaatggagaccaactgccgcaaactggtgtcggcgtgtgtgcaattagagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtttggttcaagaatcgtcgggccaaatggagaaagagggagcgcaaccagcaggccgagctatgcaagaatggcttcgggccgcagttcaatgggctcatgcagccctacgacgacatgtacccaggctattcctacaacaactgggccgccaagggccttacatccgcctccctatccaccaagagcttccccttcttcaactctatgaacgtcaaccccctgtcatcacagagcatgttttccccacccaactctatctcgtccatgagcatgtcgtccagcatggtgccctcagcagtgacaggcgtcccgggctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcagcactccagcttcggctacgccagcgtgcagaacccggcctccaacctgagtgcttgccagtatgcagtggaccggcccgtgtgagccgcacccacagcgccgggatcctaggaccttgccggatggggcaactccgcccttgaaagactgggaattatgctagaaggtcgtgggcactaaagaaagggagagaaagagaagctatatagagaaaaggaaaccactgaatcaaagagagagctcctttgatttcaaagggatgtcctcagtgtctgacatctttcactacaagtatttctaacagttgcaaggacacatacacaaacaaatgtttgactggatatgacattttaacattactataagcttgttattttttaagtttagcattgttaacatttaaatgactgaaaggatgtatatatatcgaaatgtcaaattaattttataaaagcagttgttagtaatatcacaacagtgtttttaaaggttaggctttaaaataaagcatgttatacagaagcgattaggatttttcgcttgcgagcaagggagtgtatatactaaatgccacactgtatgtttctaacatattattattattataaaaaatgtgtgaatatcagttttagaatagtttctctggtggatgcaatgatgtttctgaaactgctatgtacaacctaccctgtgtataacatttcgtacaatattattgttttacttttcagcaaatatgaaacaaatgtgttttatttcatgggagtaaaatatactgcat

SEQ ID NO: 163421 - DNA, 1391 bp, Homo sapiens
  Payload ID: 12194
  Gene Symbol: PITX3
  Gene Name: paired-like homeodomain 3
  Uniprot ID: O75364
  ENST ID: ENST00000370002
  CDS Start-End: 155-1063
ggagcgcccgagcggagaggcggcccgggagcaggggggcggcccccactccggccgggtgcccggcccctggcccctgcctgccctctagatcgccgccgcagccgccgctactgggagtctgcctgttgcaggacgcactagccctccctccatggagttcggcctgctcagcgaggcagaggcccggagccctgccctgtcgctgtcagacgctggcactccgcacccccagctcccagagcacggctgcaagggccaggagcacagcgactcagaaaaggcctcggcttcgctgcccggcggctccccagaggacggttcgctgaaaaagaagcagcggcggcagcgcacgcacttcaccagccagcagctacaggagctagaggcgaccttccagaggaaccgctaccccgacatgagcacgcgcgaggagatcgccgtgtggaccaacctcaccgaggcccgcgtgcgggtgtggttcaagaaccggcgcgccaaatggcggaagcgcgagcgcagccagcaggccgagctatgcaaaggcagcttcgcggcgccgctcggggggctggtgccgccctacgaggaggtgtaccccggctactcgtacggcaactggccgcccaaggctcttgccccgccgctcgccgccaagacctttccattcgccttcaactcggtcaacgtggggcctctggcttcgcagcccgtcttctcgccacccagctccatcgccgcctccatggtgccctccgccgcggctgccccgggcaccgtgccagggcctggggccctgcagggcctgggcgggggcccccccgggctggctccggccgccgtgtcctccggggccgtgtcctgcccttatgcctcggccgccgccgccgccgcggctgccgcctcttccccctacgtctatcgggacccgtgtaactcgagcctggccagcctgcggctcaaagccaaacagcacgcctccttcagctaccccgctgtgcacgggccgcccccggcagccaaccttagtccgtgccagtacgccgtggaaaggcccgtatgagcggccccgcccgtagatcatccccgagggcgggggcaacgattcacagcctccgcggactggggtcattttgactggcttgctcccgccccagggtctgaaaggggtgtttgggcagctggggggcaccggctcaggagagggccttcccctcccagccctgaggggtggactaggccctacacacagaccgcgcccctgggactaaagccaggaacagggaccagctccccgggggccaactcacccttggcccatcccgccttctccaggcttcccctccctcgttttcaaagataaatgaaataaacgtgcgcggactgtcgaa

SEQ ID NO: 163422 - DNA, 1187 bp, Homo sapiens
  Payload ID: 12194
  Gene Symbol: PITX3
  Gene Name: paired-like homeodomain 3
  Uniprot ID: O75364
  ENST ID: ENST00000539804
  CDS Start-End: 4-912
tccatggagttcggcctgctcagcgaggcagaggcccggagccctgccctgtcgctgtcagacgctggcactccgcacccccagctcccagagcacggctgcaagggccaggagcacagcgactcagaaaaggcctcggcttcgctgcccggcggctccccagaggacggttcgctgaaaaagaagcagcggcggcagcgcacgcacttcaccagccagcagctacaggagctagaggcgaccttccagaggaaccgctaccccgacatgagcacgcgcgaggagatcgccgtgtggaccaacctcaccgaggcccgcgtgcgggtgtggttcaagaaccggcgcgccaaatggcggaagcgcgagcgcagccagcaggccgagctatgcaaaggcagcttcgcggcgccgctcggggggctggtgccgccctacgaggaggtgtaccccggctactcgtacggcaactggccgcccaaggctcttgccccgccgctcgccgccaagacctttccattcgccttcaactcggtcaacgtggggcctctggcttcgcagcccgtcttctcgccacccagctccatcgccgcctccatggtgccctccgccgcggctgccccgggcaccgtgccagggcctggggccctgcagggcctgggcgggggcccccccgggctggctccggccgccgtgtcctccggggccgtgtcctgcccttatgcctcggccgccgccgccgccgcggctgccgcctcttccccctacgtctatcgggacccgtgtaactcgagcctggccagcctgcggctcaaagccaaacagcacgcctccttcagctaccccgctgtgcacgggccgcccccggcagccaaccttagtccgtgccagtacgccgtggaaaggcccgtatgagcggccccgcccgtagatcatccccgagggcgggggcccagggtctgaaaggggtgtttgggcagctggggggcaccggctcaggagagggccttcccctcccagccctgaggggtggactaggccctacacacagaccgcgcccctgggactaaagccaggaacagggaccagctccccgggggccaactcacccttggcccatcccgccttctccaggcttcccctccctcgttttcaaagataaatgaaataaacgtgcgcggactgtcgaa

SEQ ID NO: 163423 - DNA, 1800 bp, Homo sapiens
  Payload ID: 12195
  Gene Symbol: PAK1IP1
  Gene Name: PAK1 interacting protein 1
  Uniprot ID: Q9NWT1
  ENST ID: ENST00000379568
  CDS Start-End: 292-1470
gctggcaccttcctgagatatgcctgcttgcccccgatttttttctccttgcagtgagaacctcctcatgtggcatctttacttattctcttcttggaaaatccatgtgacctccccgcgcttaaagtgtttccacgttacaggcgacttaaaggcagccctggagcctgacgtataattcgagcgccgatgcagaaaggagtcaggtgtttttttttttttttttttggtttccggttctgtcacctccaggctgagccgggctggcggaagaggcacgtgcgctgctgaatggagctggtcgctggttgctacgagcaggtcctctttgggttcgctgtacacccggagcccgaggcttgcggcgaccacgagcaatggactcttgtggctgacttcactcaccatgctcacactgcctccttgtcagcagtagctgtaaatagtcgttttgtggtcactgggagcaaagatgaaacaattcacatttatgacatgaaaaagaagattgagcatggggctctagtgcatcacagtggtacaataacttgcctgaaattctatggcaacaggcatttaatcagtggagcggaagatggactcatctgtatctgggatgcaaagaaatgggaatgcctgaagtcaattaaagctcacaaaggacaggtgaccttcctttctattcacccatctggcaagttggccctgtcggttggtacagataaaactttaagaacgtggaatcttgtagaaggaagatcagcattcataaaaaatataaaacaaaatgctcacatagtagaatggtccccaagaggagagcagtatgtagttatcatacagaataaaatagacatctatcagcttgacactgcatccattagtggcaccatcacaaatgaaaagagaatttcctctgttaaatttctttcagagtctgtccttgcagtggctggagatgaagaagttataaggttttttgactgtgattcactagtgtgcctctgcgaatttaaagctcatgaaaacagggtaaaggacatgttcagttttgaaattccagagcatcatgttattgtttcagcatcgagtgatggtttcatcaaaatgtggaagcttaagcaggataagaaagttcccccatctttactctgtgaaataaacactaatgccaggctgacgtgtcttggagtgtggctagacaaagtggcagacatgaaagaaagccttcctccagctgcagagccttctcctgtaagtaaagaacagtccaaaattggcaaaaaggagcctggtgacacagtgcacaaagaagaaaagcggtcaaaacctaacacaaagaaacgcggtttaacaggtgacagtaagaaagcaacaaaagaaagtggcctgatatcaaccaagaagaggaaaatggtagaaatgttggaaaagaagaggaaaaagaagaaaataaaaacaatgcagtgaatcacagatgtctcctgaaagaactcttttagatgaaatcattctactcaaatgtaccttaattttttttttttccctgagtaaaagcaagaaatttcttcctttggaaaaaatatatatattaaaaaaccacttttagatggttttttttaaaaaaaaaaaaaaaactggtaaaattacttttggcagacagtgttttatgaattatgtatcatgttgatatataatatgttaatgtgtcatgtaatttttactttgtacaaagcaaataaagatctttctcaaaatatactgtaaaataatataaaatattgaacacattctttatca

SEQ ID NO: 163424 - DNA, 5809 bp, Homo sapiens
  Payload ID: 12196
  Gene Symbol: PALLD
  Gene Name: palladin, cytoskeletal associated protein
  Uniprot ID: Q8WX93
  ENST ID: ENST00000261509
  CDS Start-End: 212-3532
gtgaccacggaccaggcagtctctaatgaataggcaaggccacaacctccattctcccagaaaagaagaaatgctcatctgaaattcatcacctctctggagtcttcaaactgaccaagcattgaaaagaacacagtttcagaaaacagtttccagtgcctctggccttcctactgaaagcagacacagagtgcatgaagaccgttcaaatatgtcagggacctcctcccatgagtccttctatgactccctctcagacatgcaggaagaaagcaagaatactgacttcttcccgggcctttctgctttcctcagccaggaagagataaacaagagtcttgacctggcccggagagccatagccgactccgaaacagaagattttgactcggaaaaggagatctcgcagattttcagtacttctcctgcaagcctctgtgaacatccttcccataaggagaccaaattgggtgaacacgcctcgaggagacctcaggataacaggtcaacacctgtccagcctctggcagagaaacaaactaagagtatctcttcacctgtttcaaagaggaaacctgccatgtcacccctgctcaccaggcccagctacatccggagcctccgaaaggctgaaaagcgtggtgcaaaaactcccagcacaaacgtaaagcccaaaacgccacatcaaagaaagggtggcccccagagccagctgtgtgacaaggcagctaatttaattgaggagctaacatccatatttaaagccgcaaagccaagaaacagaagcccaaatggggagtcctcgtcaccagacagtgggtacctgtctcctaaaaatcagccgtcagccctgctgagtgcctcagccagccagagccctatggaagaccaaggggagatggaaagagaggtcaagtcccctggggccaggcattgctaccaggacaaccaggacttggcagtgccacacaaccgcaagtctcacccacagccccacagcgccctccacttcccagctgcacctcgattcatccaaaagctgaggagccaagaagtagcagaagggagccgagtttatctggagtgtagagtcactggaaaccccactcctcgagtcagatggttctgtgaagggaaagaactgcacaacactcctgatattcaaatccactgtgagggaggggacctccataccctgatcatagcagaggcctttgaggacgacacaggtcgctacacctgtttggctacgaatcccagcggctcagacacaacatctgctgaggtgttcattgaaggtgccagttcaacagattctgacagtgaaagtttagctttcaaatcaagagctggagctatgccacaagctcaaaagaaaacaacttctgtttccttgacaataggatcatcatctccaaagacaggggtgaccacagctgtgattcaaccactgtctgtccctgtgcaacaggttcacagtccaacttcatatctctgccgacctgatggaaccactactgcctactttcctcctgtttttacaaaggaactgcaaaacacagccgtggcggaaggccaggtggtggttctggagtgccgggtccgtggggcaccccctctgcaggtccagtggtttcggcaagggagtgaaatccaagactctccagatttccgaattctacagaaaaaacctagatctacagctgaacctgaggagatttgcaccctagttatcgctgagactttccctgaagatgcagggatctttacatgttcagcaagaaatgattatggatcagcaaccagcactgcccagctggttgtcacctcagccaacactgaaaactgtagttacgagtcaatgggagaatccaacaatgaccacttccaacactttccacctccccctccaatcttggagacaagttccttggagttggcttcaaagaaaccatctgagatccagcaggtgaacaaccctgagttaggcctgagcagggcagcccttcaaatgcaattcaatgctgctgagagggaaacgaacggagtccatcccagccgtggagtaaatggactgattaacggcaaagctaacagtaataaatctcttccaacaccagctgtcctgctttcacccactaaggagccaccacctctgcttgccaaaccaaaactaggatttccaaagaaggccagtagaactgctagaatagcctccgatgaggaaattcaaggcacaaaggatgctgttattcaagacctggaacgaaaacttcgcttcaaggaggacctcctgaacaatggccagccgaggttaacatacgaagaaagaatggctcgtcgactgctaggtgctgacagtgcaactgtctttaatattcaggagccagaagaggaaacagctaatcaggaatacaaagtctccagctgtgaacagagactcatcagtgaaatagagtacaggctagaaaggtctcctgtggatgaatcaggtgatgaagttcagtatggagatgtgcctgtggaaaatggaatggcaccattctttgagatgaagctgaaacattacaagatctttgagggaatgccagtaactttcacatgtagagtggctggaaatccaaagccaaagatctattggtttaaagatgggaagcagatctctccaaagagtgatcactacaccattcaaagagatctcgatgggacctgctccctccataccacagcctccaccctagatgatgatgggaattatacaattatggctgcaaaccctcagggccgcatcagttgtactggacggctaatggtacaggctgtcaaccaaagaggtcgaagtccccggtctccctcaggccatcctcatgtcagaaggcctcgttctagatcaagggacagtggagacgaaaatgaaccaattcaggagcgattcttcagacctcacttcttgcaggctcctggagatctgactgttcaagaaggaaaactctgcagaatggactgcaaagtcagtgggttaccaaccccagatctaagctggcaactagatggaaagcccgtacgccctgacagtgctcacaagatgctggtgcgtgagaacggggtgcactctctgatcatagagccagtcacgtcacgtgatgccggcatctacacatgtatagctaccaaccgagcaggacagaactcattcagcctggagcttgtggttgctgctaaagaagcacacaaaccccctgtgtttattgagaagctccaaaacacaggagttgctgatgggtacccagtgcggctggaatgtcgtgtattgggagtgccaccacctcagatattttggaagaaagaaaatgaatcactcactcacagcactgaccgagtgagcatgcaccaggacaaccacggctacatctgcctgctcattcagggagccacaaaagaagatgctgggtggtatactgtgtcagccaagaatgaagcagggattgtgtcctgtactgccaggctggacgtttacatttctcgacattaatagtgaaccacaccaggagaacaaatacccaacccagtggcatcagcagtcacagagcaccaagccaaaaaaagtacggccctcagccagtcgctatgcagcactttcggaccagggactagacatcaaagcagcgttccaacctgaggccaacccatctcacctgacactgaatactgccttggtagaaagtgaggacctgtaatccagcattcttgttaaagctgaaacactgaaacagccattgccttgaccaacatattcctttgtcacattatgtaaaaggcagaaacatacctttgactataagaaattaaaaaaaaaacaccaaaataatatttttcttacttgatataccaaacttagtttaagtagataatgctaatacaaatatacacattgcacagaaaatacacatttactgtccaatttaaaactttggaattgctgtgattaaagtgatcaaaatgccaaaatactaaaggaaatcaattgttcacaggtaactacaatttgtattatctacaagtgcctttaaacacaagatataggtgctgtgtagcctgatagtgtgaaatgtttaatgagggagttgtaccacaaacagtactacaatgattctgaagcacagtgtattcagacagatacagtgaaccaagtgcaatatgtaaggatgaaagaagaagagatgacaaagaaatccaagtaaatgccttgtctttgcaaatgtttttatattaaatcataaggaaggaactacttgccttaaatgttaatatcaaaagagttttctaacaaggttaataccttagttcttaacattttttttctttatgtgtagtgttttcatgctaccttggtaggaaacttatttacaaaccatattaaaaggctaatttaaatataaataatataaagtgctctgaataaagcagaaatatattacagttcattccacagaaagcatccaaaccacccaaatgaccaaggcatatatagtatttggaggaatcaggggtttggaaggagtagggaggagaatgaaggaaaatgcaaccagcatgattatagtgtgttcatttagataaaagtagaaggcacaggagaggtagcaaaggccaggcttttctttggttttcttcaaacataggtgaaaaaaacactgccattcacaagtcaaggaacccagggccagctggaagtgtggagcacacatgctgtggagcacacatgctgtggagattgcagtgtgtctgaggtttgtgtagtagtggaagattttaggtatgtagagcaagttgaaaatggattgagactgcatggtggcataaatgagaaattgcctgtagcatctagtctacttgaaggaagtggagacataaggagagacaaaaacaggtttgtgccataaagtattttttcaaagacaccaagatgtggtaaatgaaaattattagttcacttccctgctgccatgaaactttgccttaagaaggtgctggattccaaggtttgtaaaggcatctcggtaaagactgctttttgaatgcatatgattttgcatcagctagactgagttgattctgaccagacttgatggttttaagtcggaaccgataaattttaaaaaggagaaaaaataatttgacctagtagtataaaacatgaggctttaatggtactttgctatgaaaagaaaacactgtattccttatgcaaaacacatgtatctttcattatttataagtggcctctcttagctcagttactcaattcatacgtagtattttttaaaataattttatatctgtgtaccaccccatatatttcatattactgtttcacatgtacagctttctacttctttgtaagaacaccaaccaaccaaggtttaagtgattaataggcttgagcaccgggtggcagatgttctatgcagtgtggttcaagtttctttgaccgcacttatatgcattgctaatatggaatttaagataccatacacagtctctcatggacctatctctattgtagaattatgacttatgtcttacttgccaaatttttctgaatgtgacctttttttgctgatttgctgggtttgggattaactagcattattttgccacctttatattgtatttataaaaaaaaaagtactatcaatcaatcatactactttggattgttgtgctggtgtaatgtggatttaacatcaataaatatttgacaaataatagttgcagttttgtgaagcaaaataaatattcagtttta

SEQ ID NO: 163425 - DNA, 817 bp, Homo sapiens
  Payload ID: 12196
  Gene Symbol: PALLD
  Gene Name: palladin, cytoskeletal associated protein
  ENST ID: ENST00000393726
  CDS Start-End: 325-817
ttattttgaagggcggcgggtgaaggctcggagcctcctgagtcacccggcgggcgaggtataaagcccgatacctgccccgcgcccggtccgcggagcccgctgcagctcccgctcgctccggacgcggaatcgggcagcagcgggaggcggcccggagagccgagaggatttccaaagaaggccagtagaactgctagaatagcctccgatgaggaaattcaaggcacaaaggatgctgttattcaagacctggaacgaaaacttcgcttcaaggaggacctcctgaacaatggccagccgaggttaacatacgaagaaagaatggctcgtcgactgctaggtgctgacagtgcaactgtctttaatattcaggagccagaagaggaaacagctaatcaggaatacaaagtctccagctgtgaacagagactcatcagtgaaatagagtacaggctagaaaggtctcctgtggatgaatcaggtgatgaagttcagtatggagatgtgcctgtggaaaatggaatggcaccattctttgagatgaagctgaaacattacaagatctttgagggaatgccagtaactttcacatgtagagtggctggaaatccaaagccaaagatctattggtttaaagatgggaagcagatctctccaaagagtgatcactacaccattcaaagagatctcgatgggacctgctccctccataccacagcctccaccctagatgatgatgggaattatacaattatggctgcaaaccctcagggccgcatcagttgtactggacggctaatggtacaggctgtca

SEQ ID NO: 163426 - DNA, 565 bp, Homo sapiens
  Payload ID: 12196
  Gene Symbol: PALLD
  Gene Name: palladin, cytoskeletal associated protein
  ENST ID: ENST00000513245
  CDS Start-End: 351-565
attttgttttcttcataacatttccctgtctgaaattattttattcatgtggtatcatttaagtgcttattatctctctcaccctgctcccatcaccactggagtaaaagctatggttctgtgaagggaaagaactgcacaacactcctgatattcaaatccactgtgagggaggggacctccataccctgatcatagcagaggcctttgaggacgacacaggtcgctacacctgtttggctacgaatcccagcggctcagacacaacatctgctgaggtgttcattgaaggtgccagttcaacagattctgacagtgaaagtttagctttcaaatcaagagctggagctatgccacaagctcaaaagaaaacaacttctgtttccttgacaataggatcatcatctccaaagacaggggtgaccacagctgtgattcaaccactgtctgtccctgtgcaacaggttcacagtccaacttcatatctctgccgacctgatggaaccactactgcctactttcctcctgtttttacaaaggaactgcaaaacacagccgtggcgga

SEQ ID NO: 163427 - DNA, 545 bp, Homo sapiens
  Payload ID: 12196
  Gene Symbol: PALLD
  Gene Name: palladin, cytoskeletal associated protein
  ENST ID: ENST00000510998
  CDS Start-End: 274-545
gaaaatatctgtgcccagtgtgggcttccaacatacagctaaggatgtagccactccctggaggccatggaaaagggggatctactttcagccctttattaaaagcatttcaaaaaaggatttccaaagaaggccagtagaactgctagaatagcctccgatgaggaaattcaaggcacaaaggatgctgttattcaagacctggaacgaaaacttcgcttcaaggaggacctcctgaacaatggccagccgaggttaacatacgaagaaagaatggctcgtcgactgctaggtgctgacagtgcaactgtctttaatattcaggagccagaagaggaaacagctaatcaggaatacaaagtctccagctgtgaacagagactcatcagtgaaatagagtacaggctagaaaggtctcctgtggatgaatcaggtgatgaagttcagtatggagatgtgcctgtggaaaatggaatggcaccattctttgagatgaagctgaaacattacaagatctttgagggaatgccagtaactttcacatg

SEQ ID NO: 163428 - DNA, 2320 bp, Homo sapiens
  Payload ID: 12196
  Gene Symbol: PALLD
  Gene Name: palladin, cytoskeletal associated protein
  ENST ID: ENST00000508898
  CDS Start-End: 1-1539
aagaatactgacttcttcccgggcctttctgctttcctcagccaggaagagataaacaagagtcttgacctggcccggagagccatagccgactccgaaacagaagattttgactcggaaaaggagatctcgcagattttcagtacttctcctgcaagcctctgtgaacatccttcccataaggagaccaaattgggtgaacacgcctcgaggagacctcaggataacaggtcaacacctgtccagcctctggcagagaaacaaactaagagtatctcttcacctgtttcaaagaggaaacctgccatgtcacccctgctcaccaggcccagctacatccggagcctccgaaaggctgaaaagcgtggtgcaaaaactcccagcacaaacgtaaagcccaaaacgccacatcaaagaaagggtggcccccagagccagctgtgtgacaaggcagctaatttaattgaggagctaacatccatatttaaagccgcaaagccaagaaacagaagcccaaatggggagtcctcgtcaccagacagtgggtacctgtctcctaaaaatcagccgtcagccctgctgagtgcctcagccagccagagccctatggaagaccaaggggagatggaaagagaggtcaagtcccctggggccaggcattgctaccaggacaaccaggacttggcagtgccacacaaccgcaagtctcacccacagccccacagcgccctccacttcccagctgcacctcgattcatccaaaagctgaggagccaagaagtagcagaagggagccgagtttatctggagtgtagagtcactggaaaccccactcctcgagtcagatggttctgtgaagggaaagaactgcacaacactcctgatattcaaatccactgtgagggaggggacctccataccctgatcatagcagaggcctttgaggacgacacaggtcgctacacctgtttggctacgaatcccagcggctcagacacaacatctgctgaggtgttcattgaaggtgccagttcaacagattctgacagtgaaagtttagctttcaaatcaagagctggagctatgccacaagctcaaaagaaaacaacttctgtttccttgacaataggatcatcatctccaaagacaggggtgaccacagctgtgattcaaccactgtctgtccctgtgcaacaggttcacagtccaacttcatatctctgccgacctgatggaaccactactgcctactttcctcctgtttttacaaaggaactgcaaaacacagccgtggcggaaggccaggtggtggttctggagtgccgggtccgtggggcaccccctctgcaggtccagtggtttcggcaagggagtgaaatccaagactctccagatttccgaattctacagaaaaaacctagatctacagctgaacctgatgtcttatacgtctttgttcgagtgagatgccaccagatgaaaattcagtattacaacctggctcatctcatttcctcatggctttcttcatttttataatgtcagaaccatacaagctatgatgcttctttctctcaacaaaatgtgagcctcttgtcactgttggatgaacttttctttgagaagaaaagctgaggaacctgtgggacattgtattcaaattttatctagttaaaaaaaaattatctagcaaaaattgctgtgacatttcaatgcatgaggatcactaaaagaacatcctagtgtttattttttatttttctatttttgttctttaattctgtaatttttctaaatgttccacgtgaactatatacaggcatataccttatttatgcatggaagtattcctataaaatcatacacaatgaattctgctcaatcaactttgaaacacacaaaggaagcttgtaggaaaattggtcttactgagaattcctttagaaaatagtctttttacaaagcaagtgtttttttccttcatctaaatttcatgcatgcatttatttaaacataattatagggagcctaccatgtgtgagatgctaagaatatggccatgaacaaaaattgtttctgcactcagaggttatatttcagcgaaccagaaactaacaaactaattacacaataaattatttagcagggtgaggtggcacatagtcccagctacccaggaggctgaggcaggaggattgcttgagcccaggagttcaaggctgcagtgagctatgatcatgccacttcactccagcctgggcaacagtgaaacccctgtttctaaaaaaaagattttaaaaataaaataaaacaaaattgc

SEQ ID NO: 163429 - DNA, 576 bp, Homo sapiens
  Payload ID: 12196
  Gene Symbol: PALLD
  Gene Name: palladin, cytoskeletal associated protein
  ENST ID: ENST00000511948
  CDS Start-End: 493-576
agaaaagaagaaatgctcatctgaaattcatcacctctctggagtcttcaaactgaccaagcattgaaaagctctcacttcagagtccaagaaggacacatctaatcgctgtctaggccaagtgccaagacttgtgcccagtctccaagcggctgggaaagaaaatacttggagatttcacatcccattacaagtgagttcagtttctcactgagcctcagaatatgaggaattctccaaaatgaagacgtccagatgacagcaacaccaaacgtgaaaccatgataaatgtgtgcaccccctggattactgcacaagccttctcacggaccgccctactgtcagtcttgtcttcctctttccctacctctgtcccggatccagactgcaatcagttatctctcaaaaataacacagtttcagaaaacagtttccagtgcctctggccttcctactgaaagcagacacagagtgcatgaagaccgttcaaatatgtcagggacctcctcccatgagtccttctatgactccctctcagacatgcaggaagaaagcaagaatactgacttcttcccg

SEQ ID NO: 163430 - DNA, 4379 bp, Homo sapiens
  Payload ID: 12196
  Gene Symbol: PALLD
  Gene Name: palladin, cytoskeletal associated protein
  Uniprot ID: Q8WX93
  ENST ID: ENST00000507735
  CDS Start-End: 301-2319
cctgagtcacccggcgggcgaggtataaagcccgatacctgccccgcgcccggtccgcggagcccgctgcagctcccgctcgctccggacgcggaatcgggcagcagcgggaggcggcccggagagccgagggaccctctgaagctccagcaactccagaaccaaatccgactggagcaggaggccggcgctcggcagcctccgccagccccgcgcagcgcgccgccctcgccccccttcccgccgccgcccgccttccccgagctcgcggcctgcacgccgcccgcgtccccggagcccatgagcgcgctggcctcccgctccgcccccgccatgcagtcctccggctccttcaactacgcgcgccccaagcagttcatcgccgcgcagaacctcgggcccgcgtcgggccacggcacgccggcctccagccccagctcgtccagcctcccgtcgcccatgtccccgacgccgaggcagttcggccgcgcccccgtgccgcccttcgcgcagcccttcggcgctgagcccgaggccccgtggggctcctcctcgccgtcgcccccgcccccgccacccccggtcttcagccccacggctgccttcccggtgcccgacgtgttcccactgccgccgccaccaccgccgctcccgagcccgggacaggcgtcccactgctcgtcgcctgccacccgcttcggccacagccagacgcccgcggccttcctcagcgctctgctgccctcgcagccgccgccggcggccgtcaacgccctggggctgcccaagggtgtcacccccgcaggatttccaaagaaggccagtagaactgctagaatagcctccgatgaggaaattcaaggcacaaaggatgctgttattcaagacctggaacgaaaacttcgcttcaaggaggacctcctgaacaatggccagccgaggttaacatacgaagaaagaatggctcgtcgactgctaggtgctgacagtgcaactgtctttaatattcaggagccagaagaggaaacagctaatcaggaatacaaagtctccagctgtgaacagagactcatcagtgaaatagagtacaggctagaaaggtctcctgtggatgaatcaggtgatgaagttcagtatggagatgtgcctgtggaaaatggaatggcaccattctttgagatgaagctgaaacattacaagatctttgagggaatgccagtaactttcacatgtagagtggctggaaatccaaagccaaagatctattggtttaaagatgggaagcagatctctccaaagagtgatcactacaccattcaaagagatctcgatgggacctgctccctccataccacagcctccaccctagatgatgatgggaattatacaattatggctgcaaaccctcagggccgcatcagttgtactggacggctaatggtacaggctgtcaaccaaagaggtcgaagtccccggtctccctcaggccatcctcatgtcagaaggcctcgttctagatcaagggacagtggagacgaaaatgaaccaattcaggagcgattcttcagacctcacttcttgcaggctcctggagatctgactgttcaagaaggaaaactctgcagaatggactgcaaagtcagtgggttaccaaccccagatctaagctggcaactagatggaaagcccgtacgccctgacagtgctcacaagatgctggtgcgtgagaacggggtgcactctctgatcatagagccagtcacgtcacgtgatgccggcatctacacatgtatagctaccaaccgagcaggacagaactcattcagcctggagcttgtggttgctgctaaagaagcacacaaaccccctgtgtttattgagaagctccaaaacacaggagttgctgatgggtacccagtgcggctggaatgtcgtgtattgggagtgccaccacctcagatattttggaagaaagaaaatgaatcactcactcacagcactgaccgagtgagcatgcaccaggacaaccacggctacatctgcctgctcattcagggagccacaaaagaagatgctgggtggtatactgtgtcagccaagaatgaagcagggattgtgtcctgtactgccaggctggacgtttacacccagtggcatcagcagtcacagagcaccaagccaaaaaaagtacggccctcagccagtcgctatgcagcactttcggaccagggactagacatcaaagcagcgttccaacctgaggccaacccatctcacctgacactgaatactgccttggtagaaagtgaggacctgtaatccagcattcttgttaaagctgaaacactgaaacagccattgccttgaccaacatattcctttgtcacattatgtaaaaggcagaaacatacctttgactataagaaattaaaaaaaaaacaccaaaataatatttttcttacttgatataccaaacttagtttaagtagataatgctaatacaaatatacacattgcacagaaaatacacatttactgtccaatttaaaactttggaattgctgtgattaaagtgatcaaaatgccaaaatactaaaggaaatcaattgttcacaggtaactacaatttgtattatctacaagtgcctttaaacacaagatataggtgctgtgtagcctgatagtgtgaaatgtttaatgagggagttgtaccacaaacagtactacaatgattctgaagcacagtgtattcagacagatacagtgaaccaagtgcaatatgtaaggatgaaagaagaagagatgacaaagaaatccaagtaaatgccttgtctttgcaaatgtttttatattaaatcataaggaaggaactacttgccttaaatgttaatatcaaaagagttttctaacaaggttaataccttagttcttaacattttttttctttatgtgtagtgttttcatgctaccttggtaggaaacttatttacaaaccatattaaaaggctaatttaaatataaataatataaagtgctctgaataaagcagaaatatattacagttcattccacagaaagcatccaaaccacccaaatgaccaaggcatatatagtatttggaggaatcaggggtttggaaggagtagggaggagaatgaaggaaaatgcaaccagcatgattatagtgtgttcatttagataaaagtagaaggcacaggagaggtagcaaaggccaggcttttctttggttttcttcaaacataggtgaaaaaaacactgccattcacaagtcaaggaacccagggccagctggaagtgtggagcacacatgctgtggagcacacatgctgtggagattgcagtgtgtctgaggtttgtgtagtagtggaagattttaggtatgtagagcaagttgaaaatggattgagactgcatggtggcataaatgagaaattgcctgtagcatctagtctacttgaaggaagtggagacataaggagagacaaaaacaggtttgtgccataaagtattttttcaaagacaccaagatgtggtaaatgaaaattattagttcacttccctgctgccatgaaactttgccttaagaaggtgctggattccaaggtttgtaaaggcatctcggtaaagactgctttttgaatgcatatgattttgcatcagctagactgagttgattctgaccagacttgatggttttaagtcggaaccgataaattttaaaaaggagaaaaaataatttgacctagtagtataaaacatgaggctttaatggtactttgctatgaaaagaaaacactgtattccttatgcaaaacacatgtatctttcattatttataagtggcctctcttagctcagttactcaattcatacgtagtattttttaaaataattttatatctgtgtaccaccccatatatttcatattactgtttcacatgtacagctttctacttctttgtaagaacaccaaccaaccaaggtttaagtgattaataggcttgagcaccgggtggcagatgttctatgcagtgtggttcaagtttctttgaccgcacttatatgcattgctaatatggaatttaagataccatacacagtctctcatggacctatctctattgtagaattatgacttatgtcttacttgccaaatttttctgaatgtgacctttttttgctgatttgctgggtttgggattaactagcattattttgccacctttatattgtatttataaaaaaaaaagtactatcaatcaatcatactactttggattgttgtgctggtgtaatgtggatttaacatcaataaatatttgacaaataatagttgcagttttgtgaagcaaaataaa

SEQ ID NO: 163431 - DNA, 570 bp, Homo sapiens
  Payload ID: 12196
  Gene Symbol: PALLD
  Gene Name: palladin, cytoskeletal associated protein
  ENST ID: ENST00000504519
  CDS Start-End: 321-570
gcattcgcgcgctggagaccggcggcctctcaccgagcctgagtcgtggccgctgcgccgccaggaggcttcccgggagccggcggggcccaggacctctcgagcgcagcagcgtcccagtcctgcctgtgtttcgagatttgcctcccgttactgcccccagcctgctgctcctctctccttgcacgatctgcgcctcgtccccagacaagctttaccacttcccagttctctttcttcattccagcagaagcctggaaggtgccagttcaacagattctgacagtgaaagtttagctttcaaatcaagagctggagctatgccacaagctcaaaagaaaacaacttctgtttccttgacaataggatcatcatctccaaagacaggggtgaccacagctgtgattcaaccactgtctgtccctgtgcaacaggttcacagtccaacttcatatctctgccgacctgatggaaccactactgcctactttcctcctgtttttacaaaggaactgcaaaacacagccgtggcggaaggccaggtggtggttctggagtgccgggtccgtg

SEQ ID NO: 163432 - DNA, 607 bp, Homo sapiens
  Payload ID: 12196
  Gene Symbol: PALLD
  Gene Name: palladin, cytoskeletal associated protein
  ENST ID: ENST00000503457
  CDS Start-End: 320-607
agctctgcataaccaggctctcaggggaagcagtggaggcagccttcttggacaacagctcacttgtctacacagtcaaaaatggttctgtgaagggaaagaactgcacaacactcctgatattcaaatccactgtgagggaggggacctccataccctgatcatagcagaggcctttgaggacgacacaggtcgctacacctgtttggctacgaatcccagcggctcagacacaacatctgctgaggtgttcattgaaggtgccagttcaacagattctgacagtgaaagtttagctttcaaatcaagagctggagctatgccacaagctcaaaagaaaacaacttctgtttccttgacaataggatcatcatctccaaagacaggggtgaccacagctgtgattcaaccactgtctgtccctgtgcaacaggttcacagtccaacttcatatctctgccgacctgatggaaccactactgcctactttcctcctgtttttacaaaggaactgcaaaacacagccgtggcggaaggccaggtggtggttctggagtgccgggtccgtggggcaccccctctgcaggtccagtggtttcggcaaggg

SEQ ID NO: 163433 - DNA, 3637 bp, Homo sapiens
  Payload ID: 12196
  Gene Symbol: PALLD
  Gene Name: palladin, cytoskeletal associated protein
  Uniprot ID: Q8WX93
  ENST ID: ENST00000505667
  CDS Start-End: 174-3545
gccacaacctccattctcccagaaaagaagaaatgctcatctgaaattcatcacctctctggagtcttcaaactgaccaagcattgaaaagaacacagtttcagaaaacagtttccagtgcctctggccttcctactgaaagcagacacagagtgcatgaagaccgttcaaatatgtcagggacctcctcccatgagtccttctatgactccctctcagacatgcaggaagaaagcaagaatactgacttcttcccgggcctttctgctttcctcagccaggaagagataaacaagagtcttgacctggcccggagagccatagccgactccgaaacagaagattttgactcggaaaaggagatctcgcagattttcagtacttctcctgcaagcctctgtgaacatccttcccataaggagaccaaattgggtgaacacgcctcgaggagacctcaggataacaggtcaacacctgtccagcctctggcagagaaacaaactaagagtatctcttcacctgtttcaaagaggaaacctgccatgtcacccctgctcaccaggcccagctacatccggagcctccgaaaggctgaaaagcgtggtgcaaaaactcccagcacaaacgtaaagcccaaaacgccacatcaaagaaagggtggcccccagagccagctgtgtgacaaggcagctaatttaattgaggagctaacatccatatttaaagccgcaaagccaagaaacagaagcccaaatggggagtcctcgtcaccagacagtgggtacctgtctcctaaaaatcagccgtcagccctgctgagtgcctcagccagccagagccctatggaagaccaaggggagatggaaagagaggtcaagtcccctggggccaggcattgctaccaggacaaccaggacttggcagtgccacacaaccgcaagtctcacccacagccccacagcgccctccacttcccagctgcacctcgattcatccaaaagctgaggagccaagaagtagcagaagggagccgagtttatctggagtgtagagtcactggaaaccccactcctcgagtcagatggttctgtgaagggaaagaactgcacaacactcctgatattcaaatccactgtgagggaggggacctccataccctgatcatagcagaggcctttgaggacgacacaggtcgctacacctgtttggctacgaatcccagcggctcagacacaacatctgctgaggtgttcattgaaggtgccagttcaacagattctgacagtgaaagtttagctttcaaatcaagagctggagctatgccacaagctcaaaagaaaacaacttctgtttccttgacaataggatcatcatctccaaagacaggggtgaccacagctgtgattcaaccactgtctgtccctgtgcaacaggttcacagtccaacttcatatctctgccgacctgatggaaccactactgcctactttcctcctgtttttacaaaggaactgcaaaacacagccgtggcggaaggccaggtggtggttctggagtgccgggtccgtggggcaccccctctgcaggtccagtggtttcggcaagggagtgaaatccaagactctccagatttccgaattctacagaaaaaacctagatctacagctgaacctgaggagatttgcaccctagttatcgctgagactttccctgaagatgcagggatctttacatgttcagcaagaaatgattatggatcagcaaccagcactgcccagctggttgtcacctcagccaacactgaaaactgtagttacgagtcaatgggagaatccaacaatgaccacttccaacactttccacctccccctccaatcttggagacaagttccttggagttggcttcaaagaaaccatctgagatccagcaggtgaacaaccctgagttaggcctgagcagggcagcccttcaaatgcaattcaatgctgctgagagggaaacgaacggagtccatcccagccgtggagtaaatggactgattaacggcaaagctaacagtaataaatctcttccaacaccagctgtcctgctttcacccactaaggagccaccacctctgcttgccaaaccaaaactaggatttccaaagaaggccagtagaactgctagaatagcctccgatgaggaaattcaaggcacaaaggatgctgttattcaagacctggaacgaaaacttcgcttcaaggaggacctcctgaacaatggccagccgaggttaacatacgaagaaagaatggctcgtcgactgctaggtgctgacagtgcaactgtctttaatattcaggagccagaagaggaaacagctaatcaggacattggttctcctcatgcttctgtagggagtcctctggatggtcaaaaggaatacaaagtctccagctgtgaacagagactcatcagtgaaatagagtacaggctagaaaggtctcctgtggatgaatcaggtgatgaagttcagtatggagatgtgcctgtggaaaatggaatggcaccattctttgagatgaagctgaaacattacaagatctttgagggaatgccagtaactttcacatgtagagtggctggaaatccaaagccaaagatctattggtttaaagatgggaagcagatctctccaaagagtgatcactacaccattcaaagagatctcgatgggacctgctccctccataccacagcctccaccctagatgatgatgggaattatacaattatggctgcaaaccctcagggccgcatcagttgtactggacggctaatggtacaggctgtcaaccaaagaggtcgaagtccccggtctccctcaggccatcctcatgtcagaaggcctcgttctagatcaagggacagtggagacgaaaatgaaccaattcaggagcgattcttcagacctcacttcttgcaggctcctggagatctgactgttcaagaaggaaaactctgcagaatggactgcaaagtcagtgggttaccaaccccagatctaagctggcaactagatggaaagcccgtacgccctgacagtgctcacaagatgctggtgcgtgagaacggggtgcactctctgatcatagagccagtcacgtcacgtgatgccggcatctacacatgtatagctaccaaccgagcaggacagaactcattcagcctggagcttgtggttgctgctaaagaagcacacaaaccccctgtgtttattgagaagctccaaaacacaggagttgctgatgggtacccagtgcggctggaatgtcgtgtattgggagtgccaccacctcagatattttggaagaaagaaaatgaatcactcactcacagcactgaccgagtgagcatgcaccaggacaaccacggctacatctgcctgctcattcagggagccacaaaagaagatgctgggtggtatactgtgtcagccaagaatgaagcagggattgtgtcctgtactgccaggctggacgtttacatttctcgacattaatagtgaaccacaccaggagaacaaatacccaacccagtggcatcagcagtcacagagcaccaagccaaaaaaagtacggccctcagccagtc

SEQ ID NO: 163434 - DNA, 628 bp, Homo sapiens
  Payload ID: 12196
  Gene Symbol: PALLD
  Gene Name: palladin, cytoskeletal associated protein
  ENST ID: ENST00000503290
  CDS Start-End: 1-481
tggaaagcccgtacgccctgacagtgctcacaagatgctggtgcgtgagaacggggtgcactctctgatcatagagccagtcacgtcacgtgatgccggcatctacacatgtatagctaccaaccgagcaggacagaactcattcagcctggagcttgtggttgctgctaaagaagcacacaaaccccctgtgtttattgagaagctccaaaacacaggagttgctgatgggtacccagtgcggctggaatgtcgtgtattgggagtgccaccacctcagatattttggaagaaagaaaatgaatcactcactcacagcactgaccgagtgagcatgcaccaggacaaccacggctacatctgcctgctcattcagggagccacaaaagaagatgctgggtggtatactgtgtcagccaagaatgaagcagggattgtgtcctgtactgccaggctggacgtttacatttctcgacattaatagtgaaccacaccaggagaacaaatacccaagtatcattcaggaactttgaattattagcaaaatatgcatgttgatttctcttacattggctagttagttgtggcttccttactcaagcatccttaggagttaacagtaggcaaa

SEQ ID NO: 163435 - DNA, 2958 bp, Homo sapiens
  Payload ID: 12196
  Gene Symbol: PALLD
  Gene Name: palladin, cytoskeletal associated protein
  Uniprot ID: Q8WX93
  ENST ID: ENST00000512127
  CDS Start-End: 523-2856
attcgcgcgctggagaccggcggcctctcaccgagcctgagtcgtggccgctgcgccgccaggaggcttcccgggagccggcggggcccaggacctctcgagcgcagcaggcaaggggccggccttttggcagcgcggctgccagttaattttctccgttgcattctgcaaacgagatcgcattcagagcccagaagttgcaagctgggaataagcgagatctgaaagacccccaagaggagcttgtttgggagtgggggcagacggcgttttgcgcccaactgatggttctgtgaagggaaagaactgcacaacactcctgatattcaaatccactgtgagggaggggacctccataccctgatcatagcagaggcctttgaggacgacacaggtcgctacacctgtttggctacgaatcccagcggctcagacacaacatctgctgaggtgttcattgaaggtgccagttcaacagattctgacagtgaaagtttagctttcaaatcaagagctggagctatgccacaagctcaaaagaaaacaacttctgtttccttgacaataggatcatcatctccaaagacaggggtgaccacagctgtgattcaaccactgtctgtccctgtgcaacaggttcacagtccaacttcatatctctgccgacctgatggaaccactactgcctactttcctcctgtttttacaaaggaactgcaaaacacagccgtggcggaaggccaggtggtggttctggagtgccgggtccgtggggcaccccctctgcaggtccagtggtttcggcaagggagtgaaatccaagactctccagatttccgaattctacagaaaaaacctagatctacagctgaacctgaggagatttgcaccctagttatcgctgagactttccctgaagatgcagggatctttacatgttcagcaagaaatgattatggatcagcaaccagcactgcccagctggttgtcacctcagccaacactgaaaactgtagttacgagtcaatgggagaatccaacaatgaccacttccaacactttccacctccccctccaatcttggagacaagttccttggagttggcttcaaagaaaccatctgagatccagcaggtgaacaaccctgagttaggcctgagcagggcagcccttcaaatgcaattcaatgctgctgagagggaaacgaacggagtccatcccagccgtggagtaaatggactgattaacggcaaagctaacagtaataaatctcttccaacaccagctgtcctgctttcacccactaaggagccaccacctctgcttgccaaaccaaaactaggatttccaaagaaggccagtagaactgctagaatagcctccgatgaggaaattcaaggcacaaaggatgctgttattcaagacctggaacgaaaacttcgcttcaaggaggacctcctgaacaatggccagccgaggttaacatacgaagaaagaatggctcgtcgactgctaggtgctgacagtgcaactgtctttaatattcaggagccagaagaggaaacagctaatcaggaatacaaagtctccagctgtgaacagagactcatcagtgaaatagagtacaggctagaaaggtctcctgtggatgaatcaggtgatgaagttcagtatggagatgtgcctgtggaaaatggaatggcaccattctttgagatgaagctgaaacattacaagatctttgagggaatgccagtaactttcacatgtagagtggctggaaatccaaagccaaagatctattggtttaaagatgggaagcagatctctccaaagagtgatcactacaccattcaaagagatctcgatgggacctgctccctccataccacagcctccaccctagatgatgatgggaattatacaattatggctgcaaaccctcagggccgcatcagttgtactggacggctaatggtacaggctgtcaaccaaagaggtcgaagtccccggtctccctcaggccatcctcatgtcagaaggcctcgttctagatcaagggacagtggagacgaaaatgaaccaattcaggagcgattcttcagacctcacttcttgcaggctcctggagatctgactgttcaagaaggaaaactctgcagaatggactgcaaagtcagtgggttaccaaccccagatctaagctggcaactagatggaaagcccgtacgccctgacagtgctcacaagatgctggtgcgtgagaacggggtgcactctctgatcatagagccagtcacgtcacgtgatgccggcatctacacatgtatagctaccaaccgagcaggacagaactcattcagcctggagcttgtggttgctgctaaagaagcacacaaaccccctgtgtttattgagaagctccaaaacacaggagttgctgatgggtacccagtgcggctggaatgtcgtgtattgggagtgccaccacctcagatattttggaagaaagaaaatgaatcactcactcacagcactgaccgagtgagcatgcaccaggacaaccacggctacatctgcctgctcattcagggagccacaaaagaagatgctgggtggtatactgtgtcagccaagaatgaagcagggattgtgtcctgtactgccaggctggacgtttacacccagtggcatcagcagtcacagagcaccaagccaaaaaaagtacggccctcagccagtcgctatgcagcactttcggaccagggactagacatcaaagcagcgttccaacctgaggccaacccatctcacctgacactgaatactgccttggtagaaagtgaggacctgtaatccagcattcttgttaaagctgaaacactgaaacagccattgccttgaccaacatattcctttgtcacattatgtaaaaggcagaaacatacctttgactat

SEQ ID NO: 163436 - DNA, 4718 bp, Homo sapiens
  Payload ID: 12197
  Gene Symbol: PALM2-AKAP2
  Gene Name: PALM2-AKAP2 readthrough
  ENST ID: ENST00000302798
  CDS Start-End: 34-3306
cctctttcccctgcctgtgtgcccttctccaggatggcagaggcggaattgcacaaggaaaggctgcaagccatagcagaaaaaagaaagaggcagactgaaatagaaggcaagcgacaacagcttgacgagcagatacttctgctgcagcattccaagtccaaagtgcttcgggagaaatggctgctgcagggcatacccgctggaactgccgaagaggaggaagccaggaggcggcagtctgaagaggatgagttcagagtcaagcaacttgaagataacattcagaggctggagcaagaaatacaaacgctagaaagtgaagagtcccagatatctgccaaagagcaaatcatcctagagaaactgaaggaaacagaaaaatccttcaaggactttcagaagggtttctccagtacggatggagatgcagtaaattacatttcctcccagcttcccgacctgccaatcctctgttcacgaacagcagaaccatcacctgggcaggacgggaccagcagagcggctggagtcgggtgggagaatgtgctgctaaaggaaggtgagtcagcctcgaacgccacagaaacatccggcccagacatgactatcaagaagcctccccagctttctgaggatgatatctggctaaaaagcgagggagacaactatagtgccaccctcctggagcctgctgccagctctctttccccagatcacaaaaacatggaaattgaggtgtctgttgcagaatgtaaaagtgttcctggaatcacctctaccccacatcccatggaccatccctccgctttctattcacccccgcataatggcctccttactgatcaccacgaatccctggataatgatgttgccagagagatccgctatctagatgaggtgctagaggccaactgctgtgattctgctgtggatggaacgtacaatggaacatcctccccagagcctggtgcagtggttctggtgggcggcctaagcccccctgtccacgaggcgacccagccagaacccactgaaagaacagctagccggcaggcacctcctcacatcgagctcagtaatagcagccctgaccccatggcagaggcagaaagaacaaatggccattcccccagccagcctagagatgcgctgggggacagcctgcaggtgcctgtcagccccagctccacaaccagctcacggtgttcttcccgagatggagagttcactctcaccacactgaaaaaggaggccaagtttgagctgcgtgccttccatgaggacaagaagccctccaagctctttgaggatgacgagcatgagaaagaacaatactgcattagaaaagtgaggccttcagaggagatgctggagctggaaaaggagaggagagagctcatccgcagccaggccgtcaagaagaatcctggcattgcagcaaaatggtggaatcccccgcaggaaaaaaccatcgaggagcagctggacgaggaacatctggagtcgcacaaaaagtacaaggagcgcaaagagagaagggcacagcaggaacagttgctgctgcagaagcagttacagcagcagcagcagcagcccccatcgcagctctgcacagcccctgcctcttctcatgaacgcgcaagcatgattgacaaagcaaaggaggacattgtcacagagcagatagatttctctgctgctcgcaaacaatttcagctgatggagaattccaggcaagcggtggccaagggccagagtacacccaggctgttctccatcaagcctttctacaggcctctggggtcagtcaactcagacaagccactgactaatccgagaccaccttctgtcgggggacctccagaagacagtggtgcctcagccgccaagggacagaaatcccccggtgccctggagaccccatcggcagcaggaagccagggcaacacagcctctcaggggaaggaagggccctacagcgagccttctaaacgtgggcccttatctaaactgtgggctgaggatggagaatttacgagcgcccgggctgtcctcactgtggtcaaggatgatgaccatgggattttggatcagttctcaagatctgtcaatgtctccttgacccaagaggagcttgactctggtctggacgaattgtcggtgaggtctcaggataccacagtcctggagaccctatccaatgatttcagcatggacaacatcagtgacagcggggcatccaatgagacaaccaatgccctccaggaaaattcactggctgatttttctctgccccagacaccacaaactgacaacccctcagagggccgaggagaaggcgtctccaagtcatttagtgatcatggtttctattccccttcctccacgctgggggactctccgttggttgatgaccccttggagtatcaggctggcctcctggtgcagaatgccattcaacaagccatagccgagcaggtggataaagctgtgtccaaaaccagcagggatggagcagagcaacagggacctgaagcgactgtagaggaagctgaagctgcggctttcggctcagaaaagcctcagagcatgtttgagccacctcaggtgtcttctcctgttcaagagaaaagggatgtattaccaaagattctgcctgctgaagacagggcgctcagggaaagggggcccccccagccactgccagctgtgcagcccagtggcccgattaacatggaggagaccaggcccgaaggaagctatttcagcaagtactcggaggcagctgagctgagaagcacagcctccctcctggccactcaagaatctgacgtgatggttgggcctttcaagctgaggtccaggaaacagcggactttgtccatgattgaggaagagatccgagcagctcaggaaagggaagaggagctgaagaggcagagacaagtcttgcagagtacgcagagccccaggacaaagaatgccccatcactgccctccagaacatgctacaaaactgctccagggaaaatagagaaagtcaaacctcctccatcccccaccactgaaggccccagcttgcagcctgacttagcccctgaagaggctgccggaacccagcggcccaagaatctgatgcagaccctcatggaagactatgagacacacaaatctaaaaggcgcgagagaatggatgatagtagtgtcctcgaggccacacgggttaatcgaagaaagagcgcactggctttgcgctgggaagcagggatctatgccaaccaggaggaagaagacaacgaataaacttccttcaacccaggaagcgtctttggtgcttgggagaccaagaaaccaagaaattaacaactgaaagcattttaatggactatttattaaagtgcaaacaaactcagcaatccttatgtagaccagaagctgcaatatacaatgatgaaaatgaaacgaaaaggaagtccccccatcagactctggacacccaggaatcaaaagagaaaggacttttttggtgactcaatcccagtgtctggtttggggccaatctacaatggatccaaaaggacaaaacatgttacaagcaaatcaacatagttgctgcaggcggaactgagaccagcctctctgggcgatgaaggacaatggtggtagggccacttagagagcagtagggcccaggctggtgcagcctacatggcacaggatatttccctgcaccagtttcccacctgtcacttgcagcatcagagggtgttgcattaactccattttctccagcagccataaaatgaatggcgtttctctccatatttgcccagaagaggcagttatgattccacttctcctacatttaattatttttaattgagaacaactcatgatcacaattcataaaatccatattttaagacaatagttcttcatgtcacaaacacaatctattctacatgaggaggctgagaaaggggaagagaaaaacaaaccaaatggatgatgttagctttaggatcgtgtctgcttataatattcactgatctgcagtttatgagaacacattttcacagttatgtttcttcataggaaaactatatttagtgggcaacaactatttttatgatgggatgggggagtatatacacgtatagaatctgtacgcgttgaacaacttggttcaagatggtgggggcatttttagagcggcaataattgaaaaaaaaggcgaactctgccttggagaggtagatgataagaaataaaaaggtgtttataactattttgtattataaagtgggccttagagataggaagaagaatgatggattccttttggatcaatcagaaaggaaacacgaaagaaaagtcaggaaggtagagagagaaaaagggagggaaggagaaagaatgggaataaaataaggaggtaagagatactatttttgctgagcaaccagtgtgtttcaggatgatacaaagaaaaatatagaatagaaataagtgcaggcttggaatcagctacaaatcctaaagatggggtgtgtgtggatgtgtgtgtgtgtgtgtgtacaccattgtgtgtttgtaaaatgtgtatgttcatgagtaagggtgtgtgtgtgtgtgtattaaaattccagagtgaccgtggcacttgggtgtacaggtaattcctccagagctgtttgctggcttcaggagtggag

SEQ ID NO: 163437 - DNA, 7507 bp, Homo sapiens
  Payload ID: 12197
  Gene Symbol: PALM2-AKAP2
  Gene Name: PALM2-AKAP2 readthrough
  ENST ID: ENST00000374530
  CDS Start-End: 181-3492
cccgggcgagcccgccgtgcgcacagctctgcccgccgcccctggagcggatccccagccgtccctgggcgttctcccgggttctagcaaagccccccggggtgcccatcagtttccttgggtgactacagcgtgtgttttttctttcctctttcccctgcctgtgtgcccttctccaggatggcagaggcggaattgcacaaggaaaggctgcaagccatagcagaaaaaagaaagaggcagactgaaatagaaggcaagcgacaacagcttgacgagcagatacttctgctgcagcattccaagtccaaagtgcttcgggagaaatggctgctgcagggcatacccgctggaactgccgaagaggaggaagccaggaggcggcagtctgaagaggatgagttcagagtcaagcaacttgaagataacattcagaggctggagcaagaaatacaaacgctagaaagtgaagagtcccagatatctgccaaagagcaaatcatcctagagaaactgaaggaaacagaaaaatccttcaaggactttcagaagggtttctccagtacggatggagatgcagtaaattacatttcctcccagcttcccgacctgccaatcctctgttcacgaacagcagaaccatcacctgggcaggacgggaccagcagagcggctggagtcgggtgggagaatgtgctgctaaaggaaggtgagtcagcctcgaacgccacagaaacatccggcccagacatgactatcaagaagcctccccagctttctgaggatgatatctggctaaaaagcgagggagacaactatagtgccaccctcctggagcctgctgccagctctctttccccagatcacaaaaacatggaaattgaggtgtctgttgcagaatgtaaaagtgttcctggaatcacctctaccccacatcccatggaccatccctccgctttctattcacccccgcataatggcctccttactgatcaccacgaatccctggataatgatgttgccagagagatccgctatctagatgaggtgctagaggccaactgctgtgattctgctgtggatggaacgtacaatggaacatcctccccagagcctggtgcagtggttctggtgggcggcctaagcccccctgtccacgaggcgacccagccagaacccactgaaagaacagctagccggcaggcacctcctcacatcgagctcagtaatagcagccctgaccccatggcagaggcagaaagaacaaatggccattcccccagccagcctagagatgcgctgggggacagcctgcaggtgcctgtcagccccagctccacaaccagctcacggtgttcttcccgagatggagagttcactctcaccacactgaaaaaggaggccaagtttgagctgcgtgccttccatgaggacaagaagccctccaagctctttgaggatgacgagcatgagaaagaacaatactgcattagaaaagtgaggccttcagaggagatgctggagctggaaaaggagaggagagagctcatccgcagccaggccgtcaagaagaatcctggcattgcagcaaaatggtggaatcccccgcaggaaaaaaccatcgaggagcagctggacgaggaacatctggagtcgcacaaaaagtacaaggagcgcaaagagagaagggcacagcaggaacagttgctgctgcagaagcagttacagcagcagcagcagcagcccccatcgcagctctgcacagcccctgcctcttctcatgaacgcgcaagcatgattgacaaagcaaaggaggacattgtcacagagcagatagatttctctgctgctcgcaaacaatttcagctgatggagaattccaggcaagcggtggccaagggccagagtacacccaggctgttctccatcaagcctttctacaggcctctggggtcagtcaactcagacaagccactgactaatccgagaccaccttctgtcgggggacctccagaagacagtggtgcctcagccgccaagggacagaaatcccccggtgccctggagaccccatcggcagcaggaagccagggcaacacagcctctcaggggaaggaagggccctacagcgagccttctaaacgtgggcccttatctaaactgtgggctgaggatggagaatttacgagcgcccgggctgtcctcactgtggtcaaggatgatgaccatgggattttggatcagttctcaagatctgtcaatgtctccttgacccaagaggagcttgactctggtctggacgaattgtcggtgaggtctcaggataccacagtcctggagaccctatccaatgatttcagcatggacaacatcagtgacagcggggcatccaatgagacaaccaatgccctccaggaaaattcactggctgatttttctctgccccagacaccacaaactgacaacccctcagagggccgaggagaaggcgtctccaagtcatttagtgatcatggtttctattccccttcctccacgctgggggactctccgttggttgatgaccccttggagtatcaggctggcctcctggtgcagaatgccattcaacaagccatagccgagcaggtggataaagctgtgtccaaaaccagcagggatggagcagagcaacagggacctgaagcgactgtagaggaagctgaagctgcggctttcggctcagaaaagcctcagagcatgtttgagccacctcaggtgtcttctcctgttcaagagaaaagggatgtattaccaaagattctgcctgctgaagacagggcgctcagggaaagggggcccccccagccactgccagctgtgcagcccagtggcccgattaacatggaggagaccaggcccgaaggaagctatttcagcaagtactcggaggcagctgagctgagaagcacagcctccctcctggccactcaagaatctgacgtgatggttgggcctttcaagctgaggtccaggaaacagcggactttgtccatgattgaggaagagatccgagcagctcaggaaagggaagaggagctgaagaggcagagacaagtcttgcagagtacgcagagccccaggacaaagaatgccccatcactgccctccagaacatgctacaaaactgctccagggaaaatagagaaagtcaaacctcctccatcccccaccactgaaggccccagcttgcagcctgacttagcccctgaagaggctgccggaacccagcggcccaagaatctgatgcagaccctcatggaagactatgagacacacaaatctaaaaggcgcgagagaatggatgatagtagttacacttctaagttactgtcttgcaaggtgacttccgaggtcctcgaggccacacgggttaatcgaagaaagagcgcactggctttgcgctgggaagcagggatctatgccaaccaggaggaagaagacaacgaataaacttccttcaacccaggaagcgtctttggtgcttgggagaccaagaaaccaagaaattaacaactgaaagcattttaatggactatttattaaagtgcaaacaaactcagcaatccttatgtagaccagaagctgcaatatacaatgatgaaaatgaaacgaaaaggaagtccccccatcagactctggacacccaggaatcaaaagagaaaggacttttttggtgactcaatcccagtgtctggtttggggccaatctacaatggatccaaaaggacaaaacatgttacaagcaaatcaacatagttgctgcaggcggaactgagaccagcctctctgggcgatgaaggacaatggtggtagggccacttagagagcagtagggcccaggctggtgcagcctacatggcacaggatatttccctgcaccagtttcccacctgtcacttgcagcatcagagggtgttgcattaactccattttctccagcagccataaaatgaatggcgtttctctccatatttgcccagaagaggcagttatgattccacttctcctacatttaattatttttaattgagaacaactcatgatcacaattcataaaatccatattttaagacaatagttcttcatgtcacaaacacaatctattctacatgaggaggctgagaaaggggaagagaaaaacaaaccaaatggatgatgttagctttaggatcgtgtctgcttataatattcactgatctgcagtttatgagaacacattttcacagttatgtttcttcataggaaaactatatttagtgggcaacaactatttttatgatgggatgggggagtatatacacgtatagaatctgtacgcgttgaacaacttggttcaagatggtgggggcatttttagagcggcaataattgaaaaaaaaggcgaactctgccttggagaggtagatgataagaaataaaaaggtgtttataactattttgtattataaagtgggccttagagataggaagaagaatgatggattccttttggatcaatcagaaaggaaacacgaaagaaaagtcaggaaggtagagagagaaaaagggagggaaggagaaagaatgggaataaaataaggaggtaagagatactatttttgctgagcaaccagtgtgtttcaggatgatacaaagaaaaatatagaatagaaataagtgcaggcttggaatcagctacaaatcctaaagatggggtgtgtgtggatgtgtgtgtgtgtgtgtgtacaccattgtgtgtttgtaaaatgtgtatgttcatgagtaagggtgtgtgtgtgtgtgtattaaaattccagagtgaccgtggcacttgggtgtacaggtaattcctccagagctgtttgctggcttcaggagtggagtgagaatttcttttttatgaaaagggatataaaggcaccgagctgatgcagtatttgtaatattaagttgacctaacaaggtatttgcatgagtcacaattacaaagttttgagcggttttgtaatttgacatttaggagagtctcctatttattctcatactttacattcatgcttagtatactatagaggatgccagctttaatctttctgtcatttaaagcaatatgataagggtattcaataattgggtgccctaaatttctggatgagaaaattttcaattctggccatgagaaagaaaaaaaaataaacagccttctttttttttcctttgttttaaaactgtggttttttaaaaaagcaataattaactcagacctcactaaaaatcatttttgtttttatattgttatgtcataagctctattatgttattctaacaagtagcaatttcacaaaatttgtatgtagatgttaacgcacatttcctttgcttcttttattagactagtgttgactttggggggggacatttattcacaaatgagaagtaggcacaaagtaaaaaatggaaccatctactaacaaggatcctttaaaactgccaagggagctctaacttgaagccacatcctacagatggcagcccaaatagcacatgggcaattggcaccatctttatatggttgagtctcctgaatattttgaatgaattctcaacaaaatgtgctagccactggggacgcaaaacaagtaagatccctgttgcaagaaattcattttatagtgagggaggttggcatggagactaaaattctcaggaaaatgagatccgtgttagattagaagtcctgatgtgaaatgggaggactcaggaaggaggatcgtctttacctgaggatttctagccagaggtcccagatgcctgggctgagaacccagcgataagggggcgttcccaaagcagacacagggataagaacagaggaggcagcagcattgcacagccccaggcacagtggcagttaggatggctggagagtaggatagttctatgggttgcccaaaaaatgtgatgcgcttcatgttttctctgactcatggatctggtagagaccatagacatgatatagactaacttccccatttttcacaagaggaaaccatccttatgacttaccttaaagttttttgttctgttttgaaggaaaccatgtgcttcatgaaacctacagttgacaagagaatgtacagctaagagaaaagcttaagaggccacactattcgcggaatggctttagaggcagatgaagtggtctttgaccacagttgattgaaccagagcacttattgcttaaagaataacagagttctagagctgggggttcttgggccatgctccgtgtgtggataaggaaagaaatactgtttctgggactctcccacagtcacaaagctgttttcactgtggcccctacatctcttaacttttgctattactcctatgctgccttccggattactgctgtctatcttcttgctccactcactgaagatcctattataatcccatgaaaatgtaaattacagtttacttgggagagccagattttctctgtgctcttgagttttttattcattcaagaaaccttgggccaccgctttgtacatagcaccgtgctaggctctgggatcccaaatggacccttttaactttctgaagatgggaccgtcccctggaggaaagtcattcctgcctaatccatcgagagaaagaggcttacgaaaaactttgcctctgatgctcagccccacccccaaatagcacacaagcttgttaaccccacctcttacaaaatgtttagattctgtaggtgttaaaagcctttctggaagtattgcattctgccgtgtttataggtgttcactttcctccagagctgattaactactgacatgacttggctttctcatccagaaattatggaaacagggtctgtcagtggcaggaggccgtgctgtgttttacttggatgacacaatgcagtttacttgcctcttcatacccatgcatgctgctcaccctagacaatgacatataagccgtatatagatcaatgtccacatatatatacacacacacatatatatatataaagtgtaacaaggaacactaaaacagtgttgattcttgtctctgaagacaaataattaaaccttttttttcccaactaaagaatggatttaattaaactatgtattgaaaaaaaagtagcctaagtgttagagatggtgaatatattccattttagttaaagaacaaatttcctgaattttaagcattcagtgagctgccaattttgattttgtgttgctctttacccaaattattttttctttgtttttctttttttgggggaggaggggaaaaaagcagcaatactgtgtttggaaattatactctgtatctggttttcctgtgtatgttaaccacttaaatgttattatcctgctttggttttagagtgattgtgaggcattcaatgcaagtatacagttattttctcattaaaatccaatgtgtgttgagtttttataaa

SEQ ID NO: 163438 - DNA, 1351 bp, Homo sapiens
  Payload ID: 12197
  Gene Symbol: PALM2-AKAP2
  Gene Name: PALM2-AKAP2 readthrough
  ENST ID: ENST00000413420
  CDS Start-End: 51-1351
gcgtgtgttttttctttcctctttcccctgcctgtgtgcccttctccaggatggcagaggcggaattgcacaaggaaaggctgcaagccatagcagaaaaaagaaagaggcagactgaaatagaaggcaagcgacaacagcttgacgagcagatacttctgctgcagcattccaagtccaaagtgcttcgggagaaatggctgctgcagggcatacccgctggaactgccgaagaggaggaagccaggaggcggcagtctgaagaggatgagttcagagtcaagcaacttgaagataacattcagaggctggagcaagaaatacaaacgctagaaagtgaagagtcccagatatctgccaaagagcaaatcatcctagagaaactgaaggaaacagaaaaatccttcaaggactttcagaagggtttctccagtacggatggagatgcagtaaattacatttcctcccagcttcccgacctgccaatcctctgttcacgaacagcagaaccatcacctgggcaggacgggaccagcagagcggctgctgtgtacgccatggaaattaatgtggagaaagacaaacaaacaggagagaccaagattctctctacatctaccattggcccagagggggtccatcagaaaggagtcaaagtctatgatgatggtaccaaagtagtgtatgaggtgcgctcaggaggcaccgtagtagaaaatggagtgcacaaattaagcacaaaggatgtagaagagcttattcagaaggctggacaatcaagcttaggaggagggcacgtgtctgaaaggactgtgattgcagatgggagcctcagccatcccaaggaacacatgctctgcaaagaagctaagttagaaatggtacataagtctaggaaagaccattcttccgggaacccagggcagcaggcccaagcccccagcgctgcagggccggaggcaaacttggatcagcccgtcaccatgatttttatgggctaccaaaatatcgaggatgaagaggagacgaaaaaggtgctaggctatgatgaaaccatcaaggctgaattggtcctcattgatgaagatgatgagaagtcattgagggagaagacagtgacggacgtgtccactattgacgggaacgcggctgagcttgtgtccgggaggccggtctcagacaccacagagccctcatccccagaagggaaggaagagagcctagctacagagccagccccaggagtcgggtgggagaatgtgctgctaaaggaaggtgagtcagcctcgaacgccacagaaacatccggcccagacatgactatcaagaagcctccccagctttctgagga

SEQ ID NO: 163439 - DNA, 2510 bp, Homo sapiens
  Payload ID: 12198
  Gene Symbol: PALMD
  Gene Name: palmdelphin
  Uniprot ID: Q9NP74
  ENST ID: ENST00000263174
  CDS Start-End: 376-2031
ataatgaattgggtaaggaacagttaataagaaaatgtgccttgctaactgtgcacattacaacaaagagctggcagctcctgaaggaaaagggcttgtgccgctgccgttcaaacttgtcagtcaactcatgccagcagcctcagcgtctgcctccccagcacaccctcattacatgtgtctgtctggcctgatctgtgcatctgctcggagacgctcctgacaagtcgggaatttctctatttctccactggtgcaaagagcggatttctccctgcttctcttctgtcacccccgctcctctcccccaggaggctccttgatttatggtagctttggacttgcttccccgtctgactgtccttgacttctagaatggaagaagctgagctggtgaagggaagactccaggccatcacagataaaagaaaaatacaggaagaaatctcacagaagcgtctgaaaatagaggaagacaaactaaagcaccagcatttgaagaaaaaggccttgagggagaaatggcttctagatggaatcagcagcggaaaagaacaggaagagatgaagaagcaaaatcaacaagaccagcaccagatccaggttctagaacaaagtatcctcaggcttgagaaagagatccaagatcttgaaaaagctgaactgcaaatctcaacgaaggaagaggccattttaaagaaactaaagtcaattgagcggacaacagaagacattataagatctgtgaaagtggaaagagaagaaagagcagaagagtcaattgaggacatctatgctaatatccctgaccttccaaagtcctacataccttctaggttaaggaaggagataaatgaagaaaaagaagatgatgaacaaaataggaaagctttatatgccatggaaattaaagttgaaaaagacttgaagactggagaaagtacagttctgtcttcaatacctctgccatcagatgactttaaaggtacaggaataaaagtttatgatgatgggcaaaagtcagtgtatgcagtaagttctaatcacagtgcagcatacaatggcaccgatggcctggcaccagttgaagtagaggaacttctaagacaagcctcagagagaaactctaaatccccaacagagtatcatgagcctgtatatgccaatcccttttacaggcctacaaccccacagagagaaacggtgacccctggaccaaactttcaagaaaggataaagattaaaactaatggactgggtattggtgtaaatgaatccatacacaatatgggcaatggtctttcagaggaaaggggaaacaacttcaatcacatcagtcccattccgccagtgcctcatccccgatcagtgattcaacaagcagaagagaagcttcacaccccgcaaaaaaggctaatgactccttgggaagaatcgaatgtcatgcaggacaaagatgcaccctctccaaagccaaggctgagccccagagagacaatatttgggaaatctgaacaccagaattcttcacccacttgtcaggaggacgaggaagatgtcagatataatatcgttcattccctgcctccagacataaatgatacagaaccggtgacaatgattttcatggggtatcagcaggcagaagacagtgaagaagataagaagtttctgacaggatatgatgggatcatccatgctgagctggttgtgattgatgatgaggaggaggaggatgaaggagaagcagagaaaccgtcctaccaccccatagctccccatagtcaggtgtaccagccagccaaaccaacaccacttcctagaaaaagatcagaagctagtcctcatgaaaacacaaatcataaatccccccacaaaaattccatatctctgaaagagcaagaagaaagcttaggcagccctgtccaccattccccatttgatgctcagacaactggagatgggactgaggatccatccttaacagctttaaggatgagaatggcaaagctgggaaaaaaggtgatctaagagttgtaccacctatataaacatcctttgaagaagaaactaagaagcatttgcaaatttctcttctggatattttgtttattttttctgaagtccaaaaaattatcattacagtgtaccatattaagccatgtgaataagtagtagtcattatttgtgaaaaattcccaaaaagctggggaaaacaaatgtgtaacttttccagttacttgacacgattcagtgggggaaaaccagcattttttattctattgataccaaagcatttctaataagagcttgttaaatttaagaataaagttatttaaaatattctgagtatagtatattaactggcattgtaattttgatgatacaaagattgaaagatcataggaaagcattgcccttcatcacagaagtattcaactctgacaaataaatatgtcatcctgaattaataatgccttaataaaagtacatcctcctgctaactatca

SEQ ID NO: 163440 - DNA, 1942 bp, Homo sapiens
  Payload ID: 12198
  Gene Symbol: PALMD
  Gene Name: palmdelphin
  ENST ID: ENST00000605497
  CDS Start-End: 126-1781
ctggtgcaaagagcggatttctccctgcttctcttctgtcacccccgctcctctcccccaggaggctccttgatttatggtagctttggacttgcttccccgtctgactgtccttgacttctagaatggaagaagctgagctggtgaagggaagactccaggccatcacagataaaagaaaaatacaggaagaaatctcacagaagcgtctgaaaatagaggaagacaaactaaagcaccagcatttgaagaaaaaggccttgagggagaaatggcttctagatggaatcagcagcggaaaagaacaggaagagatgaagaagcaaaatcaacaagaccagcaccagatccaggttctagaacaaagtatcctcaggcttgagaaagagatccaagatcttgaaaaagctgaactgcaaatctcaacgaaggaagaggccattttaaagaaactaaagtcaattgagcggacaacagaagacattataagatctgtgaaagtggaaagagaagaaagagcagaagagtcaattgaggacatctatgctaatatccctgaccttccaaagtcctacataccttctaggttaaggaaggagataaatgaagaaaaagaagatgatgaacaaaataggaaagctttatatgccatggaaattaaagttgaaaaagacttgaagactggagaaagtacagttctgtcttcaatacctctgccatcagatgactttaaaggtacaggaataaaagtttatgatgatgggcaaaagtcagtgtatgcagtaagttctaatcacagtgcagcatacaatggcaccgatggcctggcaccagttgaagtagaggaacttctaagacaagcctcagagagaaactctaaatccccaacagagtatcatgagcctgtatatgccaatcccttttacaggcctacaaccccacagagagaaacggtgacccctggaccaaactttcaagaaaggataaagattaaaactaatggactgggtattggtgtaaatgaatccatacacaatatgggcaatggtctttcagaggaaaggggaaacaacttcaatcacatcagtcccattccgccagtgcctcatccccgatcagtgattcaacaagcagaagagaagcttcacaccccgcaaaaaaggctaatgactccttgggaagaatcgaatgtcatgcaggacaaagatgcaccctctccaaagccaaggctgagccccagagagacaatatttgggaaatctgaacaccagaattcttcacccacttgtcaggaggacgaggaagatgtcagatataatatcgttcattccctgcctccagacataaatgatacagaaccggtgacaatgattttcatggggtatcagcaggcagaagacagtgaagaagataagaagtttctgacaggatatgatgggatcatccatgctgagctggttgtgattgatgatgaggaggaggaggatgaaggagaagcagagaaaccgtcctaccaccccatagctccccatagtcaggtgtaccagccagccaaaccaacaccacttcctagaaaaagatcagaagctagtcctcatgaaaacacaaatcataaatccccccacaaaaattccatatctctgaaagagcaagaagaaagcttaggcagccctgtccaccattccccatttgatgctcagacaactggagatgggactgaggatccatccttaacaggtaataaaaatgacaaggcatgccactgctgttcagtcatgtgaccagcttctcttgtgctaatgcagtcttgctttcaggcttctctgaccacctcataaactaatacgcactgagatttttttattaatgctgatagagattattatcaccacagtaaagtgattaagtcacttcaaaagataaagaaagtaaaaataaatca

SEQ ID NO: 163441 - DNA, 1844 bp, Homo sapiens
  Payload ID: 12198
  Gene Symbol: PALMD
  Gene Name: palmdelphin
  Uniprot ID: Q9NP74
  ENST ID: ENST00000615664
  CDS Start-End: 123-1538
ggaagactccaggccatcacagataaaagaaaaatacaggaagaaatctcacagaagcgtctgaaaatagaggaagacaaactaaagcaccagcatttgaagaaaaaggccttgagggagaaatggcttctagatggaatcagcagcggaaaagaacaggaagagatgaagaagcaaaatctacgaaggaagaggccattttaaagaaactaaagtcaattgagcggacaacagaagacattataagatctgtgaaagtggaaagagaagaaagagcagaagagtcaattgaggacatctatgctaatatccctgaccttccaaagtcctacataccttctaggttaaggaaggagataaatgaagaaaaagaagatgatgaacaaaataggaaagctttatatgccatggaaattaaagttgaaaaagacttgaagactggagaaagtacagttctgtcttcaatacctctgccatcagatgactttaaaggtacaggaataaaagtttatgatgatgggcaaaagtcagtgtatgcagtaagttctaatcacagtgcagcatacaatggcaccgatggcctggcaccagttgaagtagaggaacttctaagacaagcctcagagagaaactctaaatccccaacagagtatcatgagcctgtatatgccaatcccttttacaggcctacaaccccacagagagaaacggtgacccctggaccaaactttcaagaaaggataaagattaaaactaatggactgggtattggtgtaaatgaatccatacacaatatgggcaatggtctttcagaggaaaggggaaacaacttcaatcacatcagtcccattccgccagtgcctcatccccgatcagtgattcaacaagcagaagagaagcttcacaccccgcaaaaaaggctaatgactccttgggaagaatcgaatgtcatgcaggacaaagatgcaccctctccaaagccaaggctgagccccagagagacaatatttgggaaatctgaacaccagaattcttcacccacttgtcaggaggacgaggaagatgtcagatataatatcgttcattccctgcctccagacataaatgatacagaaccggtgacaatgattttcatggggtatcagcaggcagaagacagtgaagaagataagaagtttctgacaggatatgatgggatcatccatgctgagctggttgtgattgatgatgaggaggaggaggatgaaggagaagcagagaaaccgtcctaccaccccatagctccccatagtcaggtgtaccagccagccaaaccaacaccacttcctagaaaaagatcagaagctagtcctcatgaaaacacaaatcataaatccccccacaaaaattccatatctctgaaagagcaagaagaaagcttaggcagccctgtccaccattccccatttgatgctcagacaactggagatgggactgaggatccatccttaacagctttaaggatgagaatggcaaagctgggaaaaaaggtgatctaagagttgtaccacctatataaacatcctttgaagaagaaactaagaagcatttgcaaatttctcttctggatattttgtttattttttctgaagtccaaaaaattatcattacagtgtaccatattaagccatgtgaataagtagtagtcattatttgtgaaaaattcccaaaaagctggggaaaacaaatgtgtaacttttccagttacttgacacgattcagtgggggaaaaccagcattttttattctattgataccaaagcatttctaataagagcttgttaaatttaagaataaagttattt

SEQ ID NO: 163442 - DNA, 827 bp, Homo sapiens
  Payload ID: 12199
  Gene Symbol: PPT1
  Gene Name: palmitoyl-protein thioesterase 1
  ENST ID: ENST00000372779
  CDS Start-End: 15-827
gtgacacagcgaagatggcgtcgcccggctgcctgtggctcttggctgtggctctcctgccatggacctgcgcttctcgggcgctgcagcatctggacccgccggcgccgctgccgttggtgatctggcatgggatggggtctcgttatgttgcccaaactggtctcgaactcttggcctcaagcaatcctcctgcctcgtcttaccaaagcgctgggatgataggagacagctgttgcaatcccttaagcatgggtgctattaaaaaaatggtggagaagaaaatacctggaatttacgtcttatctttagagattgggaagaccctgatggaggacgtggagaacagcttcttcttgaatgtcaattcccaagtaacaacagtgtgtcaggcacttgctaaggatcctaaattgcagcaaggctacaatgctatgggattctcccagggaggccaatttctgagggcagtggctcagagatgcccttcacctcccatgatcaatctgatctcggttgggggacaacatcaaggtgtttttggactccctcgatgcccaggagagagctctcacatctgtgacttcatccgaaaaacactgaatgctggggcgtactccaaagttgttcaggaacgcctcgtgcaagccgaatactggcatgaccccataaaggaggatgtgtatcgcaaccacagcatcttcttggcagatataaatcaggagcggggtatcaatgagtcctacaagaaaaacctgatggccctgaagaagtttgtgatggtgaaattcctcaatgattccattgtggaccctgtagattcggag

SEQ ID NO: 163443 - DNA, 849 bp, Homo sapiens
  Payload ID: 12199
  Gene Symbol: PPT1
  Gene Name: palmitoyl-protein thioesterase 1
  Uniprot ID: P50897
  ENST ID: ENST00000449045
  CDS Start-End: 15-626
gtgacacagcgaagatggcgtcgcccggctgcctgtggctcttggctgtggctctcctgccatggacctgcgcttctcgggcgctgcagcatctggacccgccggcgccgctgccgttggtgatctggcatgggatgggtgtttttggactccctcgatgcccaggagagagctctcacatctgtgacttcatccgaaaaacactgaatgctggggcgtactccaaagttgttcaggaacgcctcgtgcaagccgaatactggcatgaccccataaaggaggatgtgtatcgcaaccacagcatcttcttggcagatataaatcaggagcggggtatcaatgagtcctacaagaaaaacctgatggccctgaagaagtttgtgatggtgaaattcctcaatgattccattgtggaccctgtagattcggagtggtttggattttacagaagtggccaagccaaggaaaccattcccttacaggagacctccctgtacacacaggaccgcctggggctaaaggaaatggacaatgcaggacagctagtgtttctggctacagaaggggaccatcttcagttgtctgaagaatggttttatgcccacatcataccattccttggatgaaacccgtatagttcacaatagagctcagggagcccctaactcttccaaaccacatgggagacagtttccttcatgcccaagcctgagctcagatccagcttgcaactaatccttctatcatctaacatgccctacttggaaagatctaagatctgaatcttatcctttgccatcttctgttaccatatggtgttgaatgcaagtttaattaccatggagattg

SEQ ID NO: 163444 - DNA, 2742 bp, Homo sapiens
  Payload ID: 12199
  Gene Symbol: PPT1
  Gene Name: palmitoyl-protein thioesterase 1
  Uniprot ID: P50897
  ENST ID: ENST00000433473
  CDS Start-End: 466-1386
atgtttcttgcaaaggcagtacagggcagtggtgaagagcaacgactttggaaccaccaatttgctatctctgtgaccttgggcaccttactcagtgccaattcgcagtgcctcagtgtcctcacctgtcagggggagaagtgcatacagcattgttatgaagagtgaattagttaaaggttgtaagaatagtgcctgatagcatctgatcagcactgaatatatgttagcaattattttgattcaccgcagagggcggtctacgagagcgcagagccccactcggccagcggggtctggcgggggacctgtcgcgctgaaagctccagggtagggccgacgcccatcaggctgggcatccgttcgggatgcgcaggttgcgatctgcaaccggcggcgccacgcccaggcgggcggagcgcggttcccggagtctcgcgcccgcggtcatgtgacacagcgaagatggcgtcgcccggctgcctgtggctcttggctgtggctctcctgccatggacctgcgcttctcgggcgctgcagcatctggacccgccggcgccgctgccgttggtgatctggcatgggatgggagacagctgttgcaatcccttaagcatgggtgctattaaaaaaatggtggagaagaaaatacctggaatttacgtcttatctttagagattgggaagaccctgatggaggacgtggagaacagcttcttcttgaatgtcaattcccaagtaacaacagtgtgtcaggcacttgctaaggatcctaaattgcagcaaggctacaatgctatgggattctcccagggaggccaatttctgagggcagtggctcagagatgcccttcacctcccatgatcaatctgatctcggttgggggacaacatcaaggtgtttttggactccctcgatgcccaggagagagctctcacatctgtgacttcatccgaaaaacactgaatgctggggcgtactccaaagttgttcaggaacgcctcgtgcaagccgaatactggcatgaccccataaaggaggatgtgtatcgcaaccacagcatcttcttggcagatataaatcaggagcggggtatcaatgagtcctacaagaaaaacctgatggccctgaagaagtttgtgatggtgaaattcctcaatgattccattgtggaccctgtagattcggagtggtttggattttacagaagtggccaagccaaggaaaccattcccttacaggagacctccctgtacacacaggaccgcctggggctaaaggaaatggacaatgcaggacagctagtgtttctggctacagaaggggaccatcttcagttgtctgaagaatggttttatgcccacatcataccattccttggatgaaacccgtatagttcacaatagagctcagggagcccctaactcttccaaaccacatgggagacagtttccttcatgcccaagcctgagctcagatccagcttgcaactaatccttctatcatctaacatgccctacttggaaagatctaagatctgaatcttatcctttgccatcttctgttaccatatggtgttgaatgcaagtttaattaccatggagattgttttacaaacttttgatgtggtcaagttcagttttagaaaagggagtctgttccagatcagtgccagaactgtgcccaggcccaaaggagacaactaactaaagtagtgagatagattctaagggcaaacatttttccaagtcttgccatatttcaagcaaagaggtgcccaggcctgaggtactcacataaatgctttgttttgctggtgatttaaccagtgcttggaaaaatcttgcttggctatttctgcatcatttcttaaggctgccttcctctctcagtacgttgccctctgtgctatcatcttatcatcaattattagacaaatcccactggcctacagtcttgcttctgcagcacccactttgtctcctcaggtagtgatgaattagttgctgtcacaaaaggagggaagtagcacccaaattaagttgcttaagagaggaaatgtacatcttgtataacttagggagcgaagaaaatgtaggcgcgaaagtgaaaagtgaggcagctagttcttcctattccattctcgaccaacctgccctttcttaatatgactagtggtcttgatgctagagtcaacttactctgttgctggctttagcagagaataggaggaaccatatgaaaaagatcaggctttctgacttccatccccaaaacacatttaccagcatactccaaactgtttctgatgtgttccatgagaaaaggattgtttgctcaaaaagcttggaaaatactacacactccctttctccttctggagatcaacccacattagagtgtctaaggactcctgagaattcctgttacagtaaacaaaactaacgtaatctaccatttcctacactatttgagcatggaaatcatagtccccactctgtgaaaacttaacgctttttggaagacatttctgtagcatgtcagtttggagaaatgatgagctacgccttgatgaaagaaccgtgttggtgctgctaagtttagccattatggtttttcctttctctctcttaagccttattcttcaactaaaagatgaggattaagagcaagaagttgggggggatgtgaaaataattttatgaggttgtctaaaataaagagtagtttcttatccttgg

SEQ ID NO: 163445 - DNA, 659 bp, Homo sapiens
  Payload ID: 12199
  Gene Symbol: PPT1
  Gene Name: palmitoyl-protein thioesterase 1
  ENST ID: ENST00000439754
  CDS Start-End: 1-534
cagcaaggctacaatgctatgggattctcccagggaggccaatttctgagggcagtggctcagagatgcccttcacctcccatgatcaatctgatctcggttgggggacaacatcaaggtgtttttggactccctcgatgcccaggagagagctctcacatctgtgacttcatccgaaaaacactgaatgctggggcgtactccaaagttgttcaggaacgcctcgtgcaagccgaatactggcatgaccccataaaggaggatgtgtatcgcaaccacagcatcttcttggcagatataaatcaggagcggggtatcaatgagtcctacaagaaaaacctgatggccctgaagaagtttgtgatggtgaaattcctcaatgattccattgtggaccctgtagattcggaggaccgcctggggctaaaggaaatggacaatgcaggacagctagtgtttctggctacagaaggggaccatcttcagttgtctgaagaatggttttatgcccacatcataccattccttggatgaaacccgtatagttcacaatagagctcagggagcccctaactcttccaaaccacatgggagacagtttccttcatgcccaagcctgagctcagatccagcttgcaactaatccttctatcatctaa

SEQ ID NO: 163446 - DNA, 1314 bp, Homo sapiens
  Payload ID: 12199
  Gene Symbol: PPT1
  Gene Name: palmitoyl-protein thioesterase 1
  ENST ID: ENST00000530704
  CDS Start-End: 15-461
gtgacacagcgaagatggcgtcgcccggctgcctgtggctcttggctgtggctctcctgccatggacctgcgcttctcgggcgctgcagcatctggacccgccggcgccgctgccgttggtgatctggcatgggatgggagacagctgttgcaatcccttaagcatgggtgctattaaaaaaatggtggagaagaaaatacctggaatttacgtcttatctttagagattgggaagaccctgatggaggacgtggagaacagcttcttcttgaatgtcaattcccaagtaacaacagtgtgtcaggcacttgctaaggatcctaaattgcagcaaggctacaatgctatgggattctcccagggaggccaatttctgagggcagtggctcagagatgcccttcacctcccatgatcaatctgatctcggttgggggacaacatcaagtgccttgtgcatagtgggtattcgatacatcattattgaaggagtggatatttgtcatctaccactgtaggtgtttttggactccctcgatgcccaggagagagctctcacatctgtgacttcatccgaaaaacactgaatgctggggcgtactccaaagttgttcaggaacgcctcgtgcaagccgaatactggcatgaccccataaaggaggatgtgtatcgcaaccacagcatcttcttggcagatataaatcaggagcggggtatcaatgagtcctacaagaaaaacctgatggccctgaagaagtttgtgatggtgaaattcctcaatgattccattgtggaccctgtagattcggagtggtttggattttacagaagtggccaagccaaggaaaccattcccttacaggagacctccctgtacacacaggaccgcctggggctaaaggaaatggacaatgcaggacagctagtgtttctggctacagaaggggaccatcttcagttgtctgaagaatggttttatgcccacatcataccattccttggatgaaacccgtatagttcacaatagagctcagggagcccctaactcttccaaaccacatgggagacagtttccttcatgcccaagcctgagctcagatccagcttgcaactaatccttctatcatctaacatgccctacttggaaagatctaagatctgaatcttatcctttgccatcttctgttaccatatggtgttgaatgcaagtttaattaccatggagattgttttacaaacttttgatgtggtcaagttcagttttagaaaagggagtctgttccagatcagtgccagaactgtgcccaggcccaaa

SEQ ID NO: 163447 - DNA, 1836 bp, Homo sapiens
  Payload ID: 12199
  Gene Symbol: PPT1
  Gene Name: palmitoyl-protein thioesterase 1
  Uniprot ID: P50897
  ENST ID: ENST00000529905
  CDS Start-End: 8-928
agcgaagatggcgtcgcccggctgcctgtggctcttggctgtggctctcctgccatggacctgcgcttctcgggcgctgcagcatctggacccgccggcgccgctgccgttggtgatctggcatgggatgggagacagctgttgcaatcccttaagcatgggtgctattaaaaaaatggtggagaagaaaatacctggaatttacgtcttatctttagagattgggaagaccctgatggaggacgtggagaacagcttcttcttgaatgtcaattcccaagtaacaacagtgtgtcaggcacttgctaaggatcctaaattgcagcaaggctacaatgctatgggattctcccagggaggccaatttctgagggcagtggctcagagatgcccttcacctcccatgatcaatctgatctcggttgggggacaacatcaaggtgtttttggactccctcgatgcccaggagagagctctcacatctgtgacttcatccgaaaaacactgaatgctggggcgtactccaaagttgttcaggaacgcctcgtgcaagccgaatactggcatgaccccataaaggaggatgtgtatcgcaaccacagcatcttcttggcagatataaatcaggagcggggtatcaatgagtcctacaagaaaaacctgatggccctgaagaagtttgtgatggtgaaattcctcaatgattccattgtggaccctgtagattcggagtggtttggattttacagaagtggccaagccaaggaaaccattcccttacaggagacctccctgtacacacaggaccgcctggggctaaaggaaatggacaatgcaggacagctagtgtttctggctacagaaggggaccatcttcagttgtctgaagaatggttttatgcccacatcataccattccttggatgaaacccgtatagttcacaatagagctcagggagcccctaactcttccaaaccacatgggagacagtttccttcatgcccaagcctgagctcagatccagcttgcaactaatccttctatcatctaacatgccctacttggaaagatctaagatctgaatcttatcctttgccatcttctgttaccatatggtgttgaatgcaagtttaattaccatggagattgttttacaaacttttgatgtggtcaagttcagttttagaaaagggagtctgttccagatcagtgccagaactgtgcccaggcccaaaggagacaactaactaaagtagtgagatagattctaagggcaaacatttttccaagtcttgccatatttcaagcaaagaggtagtgatgaattagttgctgtcacaaaaggagggaagtagcacccaaattaagttgcttaagagaggaaatgtacatcttgtataacttagggagcgaagaaaatgtaggcgcgaaagtgaaaagtgaggcagctagttcttcctattccattctcgaccaacctgccctttcttaatatgactagtggtcttgatgctagagtcaacttactctgttgctggctttagcagagaataggaggaaccatatgaaaaagatcaggctttctgacttccatccccaaaacacatttaccagcatactccaaactgtttctgatgtgttccatgagaaaaggattgtttgctcaaaaagcttggaaaatactacacactccctttctccttctggagatcaacccacattagagtgtctaaggactcctgagaattcctgttacagtaaacaaaactaacgtaatctaccatttcctacactatttgagcatggaaatcatagtccccactctgtgaaaact

SEQ ID NO: 163448 - DNA, 550 bp, Homo sapiens
  Payload ID: 12199
  Gene Symbol: PPT1
  Gene Name: palmitoyl-protein thioesterase 1
  ENST ID: ENST00000530076
  CDS Start-End: 260-523
agtctcatctgctcctgggagggagagctccatctctgacgtagctggctctgttgggctttagcgccagcctgctccaccgagtggcgttttcaggaccactgcctctgggcagctcttccactctggctacggagccctcgtgcaagccgaatactggcatgaccccataaaggaggatgtgtatcgcaaccacagcatcttcttggcagatataaatcaggagcggggtatcaatgagtcctacaagaaaaacctgatggccctgaagaagtttgtgatggtgaaattcctcaatgattccattgtggaccctgtagattcggagtggtttggattttacagaagtggccaagccaaggaaaccattcccttacaggagacctccctgtacacacaggaccgcctggggctaaaggaaatggacaatgcaggacagctagtgtttctggctacagaaggggaccatcttcagttgtctgaagaatggttttatgcccacatcataccattccttggatgaaacccgtatagttcacaatagagctca

SEQ ID NO: 163449 - DNA, 565 bp, Homo sapiens
  Payload ID: 12199
  Gene Symbol: PPT1
  Gene Name: palmitoyl-protein thioesterase 1
  ENST ID: ENST00000526547
  CDS Start-End: 272-565
atctgcaaaatgcgggtgtagagggcgaggacgtggtcccacagcacgcggctgcctcgacattttaggatttgaaggatctgcattggaaagagagaaggggaaggagccgtccccttcactggaaagagagaaggggaaggaaagagagagccgcgcacggcgttgaagttttacatgctgtccttgattaatccttacagtagtggcgtcaggatgcagcatctctcacttggtcaggctaggagacagctgttgcaatcccttaagcatgggtgctattaaaaaaatggtggagaagaaaatacctggaatttacgtcttatctttagagattgggaagaccctgatggaggacgtggagaacagcttcttcttgaatgtcaattcccaagtaacaacagtgtgtcaggcacttgctaaggatcctaaattgcagcaaggctacaatgctatgggattctcccagggaggccaatttctgagggcagtggctcagagatgcccttcacctcccatgatcaatctgatctcggttgggggacaacatcaaggtgtttttgga

SEQ ID NO: 163450 - DNA, 623 bp, Homo sapiens
  Payload ID: 12199
  Gene Symbol: PPT1
  Gene Name: palmitoyl-protein thioesterase 1
  ENST ID: ENST00000527311
  CDS Start-End: 10-623
acagcgaagatggcgtcgcccggctgcctgtggctcttggctgtggctctcctgccatggacctgcgcttctcgggcgctgcagcatctggacccgccggcgccgctgccgttggtgatctggcatgggatgggaggccaatttctgagggcagtggctcagagatgcccttcacctcccatgatcaatctgatctcggttgggggacaacatcaaggtgtttttggactccctcgatgcccaggagagagctctcacatctgtgacttcatccgaaaaacactgaatgctggggcgtactccaaagttgttcaggaacgcctcgtgcaagccgaatactggcatgaccccataaaggaggatgtgtatcgcaaccacagcatcttcttggcagatataaatcaggagcggggtatcaatgagtcctacaagaaaaacctgatggccctgaagaagtttgtgatggtgaaattcctcaatgattccattgtggaccctgtagattcggagtggtttggattttacagaagtggccaagccaaggaaaccattcccttacaggagacctccctgtacacacaggaccgcctggggctaaaggaaatggacaatgcaggacagct

SEQ ID NO: 163451 - DNA, 2053 bp, Homo sapiens
  Payload ID: 12200
  Gene Symbol: PPT2
  Gene Name: palmitoyl-protein thioesterase 2
  Uniprot ID: Q9UMR5
  ENST ID: ENST00000324816
  CDS Start-End: 415-1323
cacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgcgggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtgtg

SEQ ID NO: 163452 - DNA, 1759 bp, Homo sapiens
  Payload ID: 12200
  Gene Symbol: PPT2
  Gene Name: palmitoyl-protein thioesterase 2
  Uniprot ID: Q9UMR5
  ENST ID: ENST00000361568
  CDS Start-End: 105-1031
ggagtagagtagggcaggagaaactgggccaggctgcacttagctcaaggggcctcgaggactctctgcgtctctggagacaagggcactacacgcacttcagaatgaagagttgcgggagcatgctggggctctgcgggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtg

SEQ ID NO: 163453 - DNA, 1945 bp, Homo sapiens
  Payload ID: 12200
  Gene Symbol: PPT2
  Gene Name: palmitoyl-protein thioesterase 2
  Uniprot ID: Q9UMR5
  ENST ID: ENST00000375137
  CDS Start-End: 309-1217
acggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggcgggagcatgctggggctctgcgggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtg

SEQ ID NO: 163454 - DNA, 1754 bp, Homo sapiens
  Payload ID: 12200
  Gene Symbol: PPT2
  Gene Name: palmitoyl-protein thioesterase 2
  Uniprot ID: Q9UMR5
  ENST ID: ENST00000375143
  CDS Start-End: 118-1026
tccgtcattcccctgcgctctctttcctcacccttccccccgccaccgtgggttccagacttgggataagtaaacagcgggtggagcgaggcctacggacccaggccaggcgggagcatgctggggctctgcgggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtg

SEQ ID NO: 163455 - DNA, 1759 bp, Homo sapiens
  Payload ID: 12200
  Gene Symbol: PPT2
  Gene Name: palmitoyl-protein thioesterase 2
  ENST ID: ENST00000383152
  CDS Start-End: 105-1031
ggagtagagtagggcaggagaaactgggccaggctgcacttagctcaaggggcctcgaggactctctgcgtctctggagacaagggcactacacgcacttcagaatgaagagttgcgggagcatgctggggctctgggggcagcggctccccgcggcgtgggtcctgcttctgttgcctttcctgccgctgctgctgcttgcagcccccgcgccccaccgcgagtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtg

SEQ ID NO: 163456 - DNA, 1759 bp, Homo sapiens
  Payload ID: 12200
  Gene Symbol: PPT2
  Gene Name: palmitoyl-protein thioesterase 2
  Uniprot ID: Q9UMR5
  ENST ID: ENST00000383301
  CDS Start-End: 105-1031
ggagtagagtagggcaggagaaactgggccaggctgcacttagctcaaggggcctcgaggactctctgcgtctctggagacaagggcactacacgcacttcagaatgaagagttgcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtg

SEQ ID NO: 163457 - DNA, 2111 bp, Homo sapiens
  Payload ID: 12200
  Gene Symbol: PPT2
  Gene Name: palmitoyl-protein thioesterase 2
  Uniprot ID: Q9UMR5
  ENST ID: ENST00000395523
  CDS Start-End: 475-1383
tcgaggactctctgcgtctctggagacaagggcactacacgcacttcagaatgaagagttcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgcgggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtg

SEQ ID NO: 163458 - DNA, 1754 bp, Homo sapiens
  Payload ID: 12200
  Gene Symbol: PPT2
  Gene Name: palmitoyl-protein thioesterase 2
  ENST ID: ENST00000399660
  CDS Start-End: 118-1026
tccgtcattcccctgcgctctctttcctcacccttccccccgccaccgtgggttccagacttgggataagtaaacagcgggtggagcgaggcctacggacccaggccaggcgggagcatgctggggctctgggggcagcggctccccgcggcgtgggtcctgcttctgttgcctttcctgccgctgctgctgcttgcagcccccgcgccccaccgcgagtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtg

SEQ ID NO: 163459 - DNA, 1945 bp, Homo sapiens
  Payload ID: 12200
  Gene Symbol: PPT2
  Gene Name: palmitoyl-protein thioesterase 2
  ENST ID: ENST00000399662
  CDS Start-End: 309-1217
acggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggcgggagcatgctggggctctgggggcagcggctccccgcggcgtgggtcctgcttctgttgcctttcctgccgctgctgctgcttgcagcccccgcgccccaccgcgagtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtg

SEQ ID NO: 163460 - DNA, 2111 bp, Homo sapiens
  Payload ID: 12200
  Gene Symbol: PPT2
  Gene Name: palmitoyl-protein thioesterase 2
  ENST ID: ENST00000399665
  CDS Start-End: 475-1383
tcgaggactctctgcgtctctggagacaagggcactacacgcacttcagaatgaagagttcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgagtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtg

SEQ ID NO: 163461 - DNA, 1754 bp, Homo sapiens
  Payload ID: 12200
  Gene Symbol: PPT2
  Gene Name: palmitoyl-protein thioesterase 2
  ENST ID: ENST00000399856
  CDS Start-End: 118-1026
tccgtcattcccctgcgctctctttcctcacccttccccccgccaccgtgggttccagacttgggataagtaaacagcgggtggagcgaggcctacggacccaggccaggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtg

SEQ ID NO: 163462 - DNA, 1945 bp, Homo sapiens
  Payload ID: 12200
  Gene Symbol: PPT2
  Gene Name: palmitoyl-protein thioesterase 2
  ENST ID: ENST00000399859
  CDS Start-End: 309-1217
acggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtg

SEQ ID NO: 163463 - DNA, 2111 bp, Homo sapiens
  Payload ID: 12200
  Gene Symbol: PPT2
  Gene Name: palmitoyl-protein thioesterase 2
  ENST ID: ENST00000399860
  CDS Start-End: 475-1383
tcgaggactctctgcgtctctggagacaagggcactacacgcacttcagaatgaagagttcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtg

SEQ ID NO: 163464 - DNA, 730 bp, Homo sapiens
  Payload ID: 12200
  Gene Symbol: PPT2
  Gene Name: palmitoyl-protein thioesterase 2
  ENST ID: ENST00000426325
  CDS Start-End: 130-730
gctattttgtgacacggacctggtgtgggagcgagaggaggtggcttgattgccgggcgtctgttccgagggaggagggtgttgccatctccctcacatgcccttatcacccctttctcaggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatgggg

SEQ ID NO: 163465 - DNA, 2111 bp, Homo sapiens; identical to SEQ ID NO: 163463
  Payload ID: 12200
  Gene Symbol: PPT2
  Gene Name: palmitoyl-protein thioesterase 2
  ENST ID: ENST00000457509
  CDS Start-End: 475-1383

SEQ ID NO: 163466 - DNA, 1049 bp, Homo sapiens
  Payload ID: 12200
  Gene Symbol: PPT2
  Gene Name: palmitoyl-protein thioesterase 2
  ENST ID: ENST00000429696
  CDS Start-End: 344-637
gttgccagagaaagccccggacgtgacggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactgcctgtagggtccagcgtcaaagcgaatcatggggtccagggctgagctgtgcactctcttaggcggattctccttcctcctgctactgataccag

SEQ ID NO: 163467 - DNA, 396 bp, Homo sapiens
  Payload ID: 12200
  Gene Symbol: PPT2
  Gene Name: palmitoyl-protein thioesterase 2
  ENST ID: ENST00000458738
  CDS Start-End: 118-396
cacggacctggtgtgggagcgagaggaggtggcttgattgccgggcgtctgttccgagggaggagggtgttgccatctccctcacatgcccttatcacccctttctcaggcgggagcatgctggggctctgggggcagcggctccccgcggcgtgggtcctgcttctgttgcctttcctgccgctgctgctgcttgcagcccccgcgccccaccgcgagtcctacaagccggtcatcgtggtgcatgggctcttcgacagctcgtacagcttccgccacctgctggaatacatcaatgagggggccttgtgtgccgggctctgctttctgtcatggatgatcacaacgtggattctttcatctccctctcctctccacagatgggacagtatggag

SEQ ID NO: 163468 - DNA, 1754 bp, Homo sapiens
  Payload ID: 12200
  Gene Symbol: PPT2
  Gene Name: palmitoyl-protein thioesterase 2
  ENST ID: ENST00000427556
  CDS Start-End: 118-1026
tccgtcattcccctgcgttctctttcctcacccttccccccgccaccgtgggttccagacttgggataagtaaacagcgggtggagcgaggcctacggacccaggccaggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtg

SEQ ID NO: 163469 - DNA, 730 bp, Homo sapiens; identical to SEQ ID NO: 163464
  Payload ID: 12200
  Gene Symbol: PPT2
  Gene Name: palmitoyl-protein thioesterase 2
  ENST ID: ENST00000443321
  CDS Start-End: 130-730

SEQ ID NO: 163470 - DNA, 827 bp, Homo sapiens
  Payload ID: 12200
  Gene Symbol: PPT2
  Gene Name: palmitoyl-protein thioesterase 2
  ENST ID: ENST00000425659
  CDS Start-End: 118-827
tccgtcattcccctgcgctctctttcctcacccttccccccgccaccgtgggttccagacttgggataagtaaacagcgggtggagcgaggcctacggacccaggccaggcgggagcatgctggggctctgggggcagcggctccccgcggcgtgggtcctgcttctgttgcctttcctgccgctgctgctgcttgcagcccccgcgccccaccgcgagtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccag

SEQ ID NO: 163471 - DNA, 2111 bp, Homo sapiens; identical to SEQ ID NO: 163463
  Payload ID: 12200
  Gene Symbol: PPT2
  Gene Name: palmitoyl-protein thioesterase 2
  ENST ID: ENST00000440507
  CDS Start-End: 475-1383

SEQ ID NO: 163472 - DNA, 1018 bp, Homo sapiens
  Payload ID: 12200
  Gene Symbol: PPT2
  Gene Name: palmitoyl-protein thioesterase 2
  ENST ID: ENST00000424667
  CDS Start-End: 309-1018
acggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggcgggagcatgctggggctctgggggcagcggctccccgcggcgtgggtcctgcttctgttgcctttcctgccgctgctgctgcttgcagcccccgcgccccaccgcgagtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccag

SEQ ID NO: 163473 - DNA, 722 bp, Homo sapiens
  Payload ID: 12200
  Gene Symbol: PPT2
  Gene Name: palmitoyl-protein thioesterase 2
  ENST ID: ENST00000437214
  CDS Start-End: 247-722
acccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccag

SEQ ID NO: 163474 - DNA, 396 bp, Homo sapiens
  Payload ID: 12200
  Gene Symbol: PPT2
  Gene Name: palmitoyl-protein thioesterase 2
  ENST ID: ENST00000453393
  CDS Start-End: 118-396
cacggacctggtgtgggagcgagaggaggtggcttgattgccgggcgtctgttccgagggaggagggtgttgccatctccctcacatgcccttatcacccctttctcaggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagggggccttgtgtgccgggctctgctttctgtcatggatgatcacaacgtggattctttcatctccctctcctctccacagatgggacagtatggag

SEQ ID NO: 163475 - DNA, 1874 bp, Homo sapiens
  Payload ID: 12200
  Gene Symbol: PPT2
  Gene Name: palmitoyl-protein thioesterase 2
  ENST ID: ENST00000438385
  CDS Start-End: 238-1146
tattccattgcccctcctgtcctgggtctgtgttgcggggaacgctcgcgcggttgccagagaaagccccggacgtgacggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtg

SEQ ID NO: 163476 - DNA, 954 bp, Homo sapiens
  Payload ID: 12200
  Gene Symbol: PPT2
  Gene Name: palmitoyl-protein thioesterase 2
  ENST ID: ENST00000416892
  CDS Start-End: 414-954
gactggtcgaaattacgcgggcatgagtcagcgcatccctacgcgccctccgccccttgagggtgggtcgcttatagggaggggagtagagtagggcaggagaaactgggccaggctgcacttagctcaaggggcctcgaggactctctgcgtctctggagacaagggcactacacgcacttcagaatgaagagttacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatg

SEQ ID NO: 163477 - DNA, 633 bp, Homo sapiens
  Payload ID: 12200
  Gene Symbol: PPT2
  Gene Name: palmitoyl-protein thioesterase 2
  ENST ID: ENST00000436118
  CDS Start-End: 143-436
aagttaaaagtaggctattttgtgacacggacctggtgtgggagcgagaggaggtggcttgattgccgggcgtctgttccgagggaggagggtgttgccatctccctcacatgcccttatcacccctttctcaggcgggagcatgctggggctctgcgggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctg

SEQ ID NO: 163478 - DNA, 396 bp, Homo sapiens; identical to SEQ ID NO: 163467
  Payload ID: 12200
  Gene Symbol: PPT2
  Gene Name: palmitoyl-protein thioesterase 2
  ENST ID: ENST00000441396
  CDS Start-End: 118-396

SEQ ID NO: 163479 - DNA, 722 bp, Homo sapiens; identical to SEQ ID NO: 163473
  Payload ID: 12200
  Gene Symbol: PPT2
  Gene Name: palmitoyl-protein thioesterase 2
  ENST ID: ENST00000431338
  CDS Start-End: 247-722

SEQ ID NO: 163480 - DNA, 1184 bp, Homo sapiens
  Payload ID: 12200
  Gene Symbol: PPT2
  Gene Name: palmitoyl-protein thioesterase 2
  ENST ID: ENST00000429189
  CDS Start-End: 475-1184
tcgaggactctctgcgtctctggagacaagggcactacacgcacttcagaatgaagagttcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgagtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccag

SEQ ID NO: 163481 - DNA, 722 bp, Homo sapiens; identical to SEQ ID NO: 163473
  Payload ID: 12200
  Gene Symbol: PPT2
  Gene Name: palmitoyl-protein thioesterase 2
  ENST ID: ENST00000433658
  CDS Start-End: 247-722

SEQ ID NO: 163482 - DNA, 1759 bp, Homo sapiens; identical to SEQ ID NO: 163456
  Payload ID: 12200
  Gene Symbol: PPT2
  Gene Name: palmitoyl-protein thioesterase 2
  Uniprot ID: Q9UMR5
  ENST ID: ENST00000414356
  CDS Start-End: 105-1031

SEQ ID NO: 163483 - DNA, 954 bp, Homo sapiens
  Payload ID: 12200
  Gene Symbol: PPT2
  Gene Name: palmitoyl-protein thioesterase 2
  ENST ID: ENST00000414204
  CDS Start-End: 414-954
gactggtcgaaattacgcgggcatgagtcagcgcatccctacgcgccctccgccccttgagggtgggtcgcttatagggaggggagtagagtagggcaggagaaactgggccaggctgcacttagctcaaggggcctcgaggactctctgcgtctctggagacaagggcactacacgcacttcagaatgaagagttacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgcgggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatg

SEQ ID NO: 163484 - DNA, 954 bp, Homo sapiens; identical to SEQ ID NO: 163476
  Payload ID: 12200
  Gene Symbol: PPT2
  Gene Name: palmitoyl-protein thioesterase 2
  ENST ID: ENST00000431414
  CDS Start-End: 414-954

SEQ ID NO: 163485 - DNA, 722 bp, Homo sapiens
  Payload ID: 12200
  Gene Symbol: PPT2
  Gene Name: palmitoyl-protein thioesterase 2
  ENST ID: ENST00000416489
  CDS Start-End: 247-722
acccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgagtcctacaagccggtcatcgtggtgcatgggctcttcgacagctcgtacagcttccgccacctgctggaatacatcaatgagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccag

SEQ ID NO: 163486 - DNA, 1754 bp, Homo sapiens; identical to SEQ ID NO: 163461
  Payload ID: 12200
  Gene Symbol: PPT2
  Gene Name: palmitoyl-protein thioesterase 2
  ENST ID: ENST00000445462
  CDS Start-End: 118-1026

SEQ ID NO: 163487 - DNA, 954 bp, Homo sapiens
  Payload ID: 12200
  Gene Symbol: PPT2
  Gene Name: palmitoyl-protein thioesterase 2
  ENST ID: ENST00000458042
  CDS Start-End: 414-954
gactggtcgaaattacgcgggcatgagtcagcgcatccctacgcgccctccgccccttgagggtgggtcgcttatagggaggggagtagagtagggcaggagaaactgggccaggctgcacttagctcaaggggcctcgaggactctctgcgtctctggagacaagggcactacacgcacttcagaatgaagagttacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgagtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatg

SEQ ID NO: 163488 - DNA, 954 bp, Homo sapiens; identical to SEQ ID NO: 163476
  Payload ID: 12200
  Gene Symbol: PPT2
  Gene Name: palmitoyl-protein thioesterase 2
  ENST ID: ENST00000419970
  CDS Start-End: 414-954

SEQ ID NO: 163489 - DNA, 954 bp, Homo sapiens; identical to SEQ ID NO: 163487
  Payload ID: 12200
  Gene Symbol: PPT2
  Gene Name: palmitoyl-protein thioesterase 2
  ENST ID: ENST00000458119
  CDS Start-End: 414-954

SEQ ID NO: 163490 - DNA, 1945 bp, Homo sapiens; identical to SEQ ID NO: 163462
  Payload ID: 12200
  Gene Symbol: PPT2
  Gene Name: palmitoyl-protein thioesterase 2
  ENST ID: ENST00000440533
  CDS Start-End: 309-1217

SEQ ID NO: 163491 - DNA, 730 bp, Homo sapiens; identical to SEQ ID NO: 163464
  Payload ID: 12200
  Gene Symbol: PPT2
  Gene Name: palmitoyl-protein thioesterase 2
  ENST ID: ENST00000451460
  CDS Start-End: 130-730

SEQ ID NO: 163492 - DNA, 396 bp, Homo sapiens; identical to SEQ ID NO: 163474
  Payload ID: 12200
  Gene Symbol: PPT2
  Gene Name: palmitoyl-protein thioesterase 2
  ENST ID: ENST00000426390
  CDS Start-End: 118-396

SEQ ID NO: 163493 - DNA, 730 bp, Homo sapiens; identical to SEQ ID NO: 163464
  Payload ID: 12200
  Gene Symbol: PPT2
  Gene Name: palmitoyl-protein thioesterase 2
  ENST ID: ENST00000442463
  CDS Start-End: 130-730

SEQ ID NO: 163494 - DNA, 1759 bp, Homo sapiens; identical to SEQ ID NO: 163456
  Payload ID: 12200
  Gene Symbol: PPT2
  Gene Name: palmitoyl-protein thioesterase 2
  Uniprot ID: Q9UMR5
  ENST ID: ENST00000423347
  CDS Start-End: 105-1031

SEQ ID NO: 163495 - DNA, 1945 bp, Homo sapiens; identical to SEQ ID NO: 163462
  Payload ID: 12200
  Gene Symbol: PPT2
  Gene Name: palmitoyl-protein thioesterase 2
  ENST ID: ENST00000456497
  CDS Start-End: 309-1217

SEQ ID NO: 163496 - DNA, 2128 bp, Homo sapiens
  Payload ID: 12200
  Gene Symbol: PPT2
  Gene Name: palmitoyl-protein thioesterase 2
  ENST ID: ENST00000422988
  CDS Start-End: 492-1400
acttagctcaaggggcctcgaggactctctgcgtctctggagacaagggcactacacgcacttcagaatgaagagttcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtg

SEQ ID NO: 163497 - DNA, 730 bp, Homo sapiens
  Payload ID: 12200
  Gene Symbol: PPT2
  Gene Name: palmitoyl-protein thioesterase 2
  Uniprot ID: Q9UMR5
  ENST ID: ENST00000415972
  CDS Start-End: 130-730
gctattttgtgacacggacctggtgtgggagcgagaggaggtggcttgattgccgggcgtctgttccgagggaggagggtgttgccatctccctcacatgcccttatcacccctttctcaggcgggagcatgctggggctctgggggcagcggctccccgcggcgtgggtcctgcttctgttgcctttcctgccgctgctgctgcttgcagcccccgcgccccaccgcgagtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatgggg

SEQ ID NO: 163498 - DNA, 2111 bp, Homo sapiens
  Payload ID: 12200
  Gene Symbol: PPT2
  Gene Name: palmitoyl-protein thioesterase 2
  ENST ID: ENST00000452562
  CDS Start-End: 475-1383
tcgaggactctctgcgtctctggagacaagggcactacacgcacttcagaatgaagagttcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgttctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtg

SEQ ID NO: 163499 - DNA, 722 bp, Homo sapiens; identical to SEQ ID NO: 163473
  Payload ID: 12200
  Gene Symbol: PPT2
  Gene Name: palmitoyl-protein thioesterase 2
  ENST ID: ENST00000418283
  CDS Start-End: 247-722

SEQ ID NO: 163500 - DNA, 954 bp, Homo sapiens; identical to SEQ ID NO: 163476
  Payload ID: 12200
  Gene Symbol: PPT2
  Gene Name: palmitoyl-protein thioesterase 2
  ENST ID: ENST00000425475
  CDS Start-End: 414-954

SEQ ID NO: 163501 - DNA, 730 bp, Homo sapiens; identical to SEQ ID NO: 163464
  Payload ID: 12200
  Gene Symbol: PPT2
  Gene Name: palmitoyl-protein thioesterase 2
  ENST ID: ENST00000427642
  CDS Start-End: 130-730

SEQ ID NO: 163502 - DNA, 722 bp, Homo sapiens
  Payload ID: 12200
  Gene Symbol: PPT2
  Gene Name: palmitoyl-protein thioesterase 2
  ENST ID: ENST00000424499
  CDS Start-End: 247-722
acccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgcgggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccag

SEQ ID NO: 163503 - DNA, 730 bp, Homo sapiens; identical to SEQ ID NO: 163497
  Payload ID: 12200
  Gene Symbol: PPT2
  Gene Name: palmitoyl-protein thioesterase 2
  Uniprot ID: Q9UMR5
  ENST ID: ENST00000433748
  CDS Start-End: 130-730

SEQ ID NO: 163504 - DNA, 722 bp, Homo sapiens; identical to SEQ ID NO: 163473
  Payload ID: 12200
  Gene Symbol: PPT2
  Gene Name: palmitoyl-protein thioesterase 2
  ENST ID: ENST00000443298
  CDS Start-End: 247-722

SEQ ID NO: 163505 - DNA, 1945 bp, Homo sapiens; identical to SEQ ID NO: 163462
  Payload ID: 12200
  Gene Symbol: PPT2
  Gene Name: palmitoyl-protein thioesterase 2
  ENST ID: ENST00000424353
  CDS Start-End: 309-1217

SEQ ID NO: 163506 - DNA, 1754 bp, Homo sapiens; identical to SEQ ID NO: 163461
  Payload ID: 12200
  Gene Symbol: PPT2
  Gene Name: palmitoyl-protein thioesterase 2
  ENST ID: ENST00000452304
  CDS Start-End: 118-1026

SEQ ID NO: 163507 - DNA, 954 bp, Homo sapiens; identical to SEQ ID NO: 163476
  Payload ID: 12200
  Gene Symbol: PPT2
  Gene Name: palmitoyl-protein thioesterase 2
  ENST ID: ENST00000447703
  CDS Start-End: 414-954

SEQ ID NO: 163508 - DNA, 1945 bp, Homo sapiens
  Payload ID: 12200
  Gene Symbol: PPT2
  Gene Name: palmitoyl-protein thioesterase 2
  ENST ID: ENST00000420778
  CDS Start-End: 309-1217
acggatttgcgcgaccccaagcagcccgcccttccccctcccatccgtcattcccctgcgttctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtg

SEQ ID NO: 163509 - DNA, 722 bp, Homo sapiens; identical to SEQ ID NO: 163485
  Payload ID: 12200
  Gene Symbol: PPT2
  Gene Name: palmitoyl-protein thioesterase 2
  ENST ID: ENST00000446563
  CDS Start-End: 247-722

SEQ ID NO: 163510 - DNA, 396 bp, Homo sapiens; identical to SEQ ID NO: 163474
  Payload ID: 12200
  Gene Symbol: PPT2
  Gene Name: palmitoyl-protein thioesterase 2
  ENST ID: ENST00000413836
  CDS Start-End: 118-396

SEQ ID NO: 163511 - DNA, 396 bp, Homo sapiens; identical to SEQ ID NO: 163474
  Payload ID: 12200
  Gene Symbol: PPT2
  Gene Name: palmitoyl-protein thioesterase 2
  ENST ID: ENST00000424311
  CDS Start-End: 118-396

SEQ ID NO: 163512 - DNA, 832 bp, Homo sapiens
  Payload ID: 12200
  Gene Symbol: PPT2
  Gene Name: palmitoyl-protein thioesterase 2
  ENST ID: ENST00000427896
  CDS Start-End: 105-832
ggagtagagtagggcaggagaaactgggccaggctgcacttagctcaaggggcctcgaggactctctgcgtctctggagacaagggcactacacgcacttcagaatgaagagttgcgggagcatgctggggctctgggggcagcggctccccgcggcgtgggtcctgcttctgttgcctttcctgccgctgctgctgcttgcagcccccgcgccccaccgcgagtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccag

SEQ ID NO: 163513 - DNA, 1759 bp, Homo sapiens; identical to SEQ ID NO: 163456
  Payload ID: 12200
  Gene Symbol: PPT2
  Gene Name: palmitoyl-protein thioesterase 2
  Uniprot ID: Q9UMR5
  ENST ID: ENST00000412651
  CDS Start-End: 105-1031

SEQ ID NO: 163514 - DNA, 1010 bp, Homo sapiens; identical to SEQ ID NO: 124907
  Payload ID: 12200
  Gene Symbol: PPT2
  Gene Name: palmitoyl-protein thioesterase 2
  ENST ID: ENST00000483803
  CDS Start-End: 1-383

SEQ ID NO: 163515 - DNA, 4181 bp, Homo sapiens
  Payload ID: 12200
  Gene Symbol: PPT2
  Gene Name: palmitoyl-protein thioesterase 2
  Uniprot ID: Q9UMR5
  ENST ID: ENST00000483565
  CDS Start-End: 192-1097
agcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactgcctgccaggcccacccaccagtctgagctgcttctgctgaggctggtctgcttgaagcctcccaggagaaagaagccagcctgtagggtccagcgtcaaagcgaatcatggggtccagggctgagctgtgcactctcttaggcggattctccttcctcctgctactgataccagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaggcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtgggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccgttcgggaggcagaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaagggggaggcctgtgttcttggcctgcccctgagtcttctggctgggggcaggttgcctgggcaagaactgcttcttcaattccttaacaaatgcaaccaccaacacccagatctctctctctctttattttcagtttttttgctgttatccagataattaataaaaaccaaccacgcaaaactgggtcccaccctctccttttgctcccagcctacctccccagttgtgggaacaggtctggagtgagaggcagggagtggctaatgccaccaggaagaaatgaaaactggctcagagagggggaagcctcaacagaaaaagaaataaattaaaagccctcctatcccctccagccagggttcgttcctttccccaactccccagggggcagaagtgagtgcagcacctgatgtctgcttcttccccttgtgtctggcttcttcagatagtcaccaccaccccggccatcagtggagatttcccggaaaacagtgagcatggagtgccggactctgtcagccagagctgggacgtcatctggtgtcagcccttccgtgggcactgggggcagcacccgcacctgacattgtcctggggcaaggggagcaccatcatggcctgtccacccaggtctttgcccacagggatgtcctcccagcctctccggacacaccctaccccagaactgctcaaagccctcacccgaggtgaagcgacgctccttcttgcagtagaagtcttggatgactcacgtcctgggtgagcagggtctgggcgacctcagacatgacactgatggcatcccccgtgcgcttccggtcgatgaagatgactcctgccagccagcaggccagcccggcagagccagcccacagtagctcgcgcttggcaatgggcacacagcggcctggcagtacctccatcatcccttgggcagggtgggagtgggtgaggatcggggtggaggcagagtgtcacagaaggcaacccacctcacccagctcatcaccctctggtagggactggaggtgaaggaggagactaggcagggaggggggccccaagtgaaggaaagggtgaccaaaagtatatgtaccctgcttatgagggcagttctacccagggaatgaaggcctgagtgggaggcaagggggcaatgtcccagaggaaggggaattgaggatctctaggagaagatattctagggaaggtttcaggaggggaggcatggctgggggaggtgtgccctgtggtggggtctcaccaagcagatcgagagagctctggtggttggagacaacaacatagggctgcgagggagggaagtggtgagcccctcgcacctccactcggatcccgtacaggtatttgatgtggagcagcattagacgcaagatcctgtggggtcatggcaaggggtcccagtgggatccattgatgtccatctgcatgcctcagctccccccaccttactgtctttctgaccacctttgcagtcctctccccattccctgtctctggtctctctcagtcttttctacacacaccatgcccccttcccccaatccactactcactttgtacccttaggttccctcattgcccaagaccccttgcccctcacttcatgttctcgacgttgcgtcctcgcacggcacacacagggatggcgagcacagccaggaagaggatccagccattgtagaaggccatcttgaagaagtacttggcactggggctgcagaaccacagggtgggcagcaggaagagcagcagcaggaagagcagcagcagcagcatccatgcccctggccacaaatccattctggccacctgcaggggatggggcaagggacaatcagcctggtttctggaggagagtggggctccggatatattcagacaagagacacaagacacagacatctacaattcacagatacctgataataaatgacaacaagaataatagctaacacttgtagctggtaagggtcttataatggtctatacttgtgctgtccgagaaagtagccaccacctacatgtggctacttgaaatgcagctagtctgaactgagatgtgctggaaatgtaaaatacacatcagatttcaaagactgaataaaaaacaaaatgtg

SEQ ID NO: 163516 - DNA, 4178 bp, Homo sapiens
  Payload ID: 12200
  Gene Symbol: PPT2
  Gene Name: palmitoyl-protein thioesterase 2
  Uniprot ID: Q9UMR5
  ENST ID: ENST00000476214
  CDS Start-End: 192-1097
agcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactgcctgccaggcccacccaccagtctgagctgcttctgctgaggctggtctgcttgaagcctcccaggagaaagaagccagcctgtagggtccagcgtcaaagcgaatcatggggtccagggctgagctgtgcactctcttaggcggattctccttcctcctgctactgataccagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaggcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtgggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccgttcgggaggcggaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaagggggaggcctgtgttcttggcctgcccctgagtcttctggctgggggcaggttgcctgggcaagaactgcttcaattccttaacaaatgcaaccaccaacacccagatctctctctctctttattttcagtttttttgctgttatccagataattaataaaaaccaaccacgcaaaactgggtcccaccctctccttttgctcccagcctacctccccagttgtgggaacaggtctggagtgagaggcagggagtggctaatgccaccaggaagaaatgaaaactggctcagagagggggaagcctcaacagaaaaagaaataaattaaaagccctcctatcccctccagccagggttcgttcctttccccaactccccagggggcagaagtgagtgcagcacctgatgtctgcttcttccccttgtgtctggcttcttcagatagtcaccaccaccccggccatcagtggagatttcccggaaaacagtgagcatggagtgccggactctgtcagccagagctgggacgtcatctggtgtcagcccttccgtgggcactgggggcagcacccgcacctgacattgtcctggggcaaggggagcaccatcatggcctgtccacccaggtctttgcccacagggatgtcctcccagcctctccggacacaccctaccccagaactgctcaaagccctcacccgaggtgaagcgacgctccttcttgcagtagaagtcttggatgactcacgtcctgggtgagcagggtctgggcgacctcagacatgacactgatggcatcccccgtgcgcttccggtcgatgaagatgactcctgccagccagcaggccagcccggcagagccagcccacagtagctcgcgcttggcaatgggcacacagcggcctggcagtacctccatcatcccttgggcagggtgggagtgggtgaggatcggggtggaggcagagtgtcacagaaggcaacccacctcacccagctcatcaccctctggtagggactggaggtgaaggaggagactaggcagggaggggggccccaagtgaaggaaagggtgaccaaaagtatatgtaccctgcttatgagggcagttctacccagggaatgaaggcctgagtgggaggcaagggggcaatgtcccagaggaaggggaattgaggatctctaggagaagatattctagggaaggtttcaggaggggaggcatggctgggggaggtgtgccctgtggtggggtctcaccaagcagatcgagagagctctggtggttggagacaacaacatagggctgcgagggagggaagtggtgagcccctcgcacctccactcggatcccgtacaggtatttgatgtggagcagcattagacgcaagatcctgtggggtcatggcaaggggtcccagtgggatccattgatgtccatctgcatgcctcagctccccccaccttactgtctttctgaccacctttgcagtcctctccccattccctgtctctggtctctctcagtcttttctacacacaccatgcccccttcccccaatccactactcactttgtacccttaggttccctcattgcccaagaccccttgcccctcacttcatgttctcgacgttgcgtcctcgcacggcacacacagggatggcgagcacagccaggaagaggatccagccattgtagaaggccatcttgaagaagtacttggcactggggctgcagaaccacagggtgggcagcaggaagagcagcagcaggaagagcagcagcagcagcatccatgcccctggccacaaatccattctggccacctgcaggggatggggcaagggacaatcagcctggtttctggaggagagtggggctccggatatattcagacaagagacacaagacacagacatctacaattcacagatacctgataataaatgacaacaagaataatagctaacacttgtagctggtaagggtcttataatggtctatacttgtgctgtccgagaaagtagccaccacctacatgtggctacttgaaatgcagctagtctgaactgagatgtgctggaaatgtaaaatacacatcagatttcaaagactgaataaaaaacaaaatgtg

SEQ ID NO: 163517 - DNA, 4181 bp, Homo sapiens
  Payload ID: 12200
  Gene Symbol: PPT2
  Gene Name: palmitoyl-protein thioesterase 2
  Uniprot ID: Q9UMR5
  ENST ID: ENST00000480383
  CDS Start-End: 192-1097
agcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactgcctgccaggcccacccaccagtctgagctgcttctgctgaggctggtctgcttgaagcctcccaggagaaagaagccagcctgtagggtccagcgtcaaagcgaatcatggggtccagggctgagctgtgcactctcttaggcggattctccttcctcctgctactgataccagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaggcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtgggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccgttcgggaggcggaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaagggggaggcctgtgttcttggcctgcccctgagtcttctggctgggggcaggttgcctgggcaagaactgcttcttcaattccttaacaaatgcaaccaccaacacccagatctctctctctctttattttcagtttttttgctgttatccagataattaataaaaaccaaccacgcaaaactgggtcccaccctctccttttgctcccagcctacctccccagttgtgggaacaggtctggagtgagaggcagggagtggctaatgccaccaggaagaaatgaaaactggctcagagagggggaagcctcaacagaaaaagaaataaattaaaagccctcctatcccctccagccagggttcgttcctttccccaactccccagggggcagaagtgagtgcagcacctgatgtctgcttcttccccttgtgtctggcttcttcagatagtcaccaccaccccggccatcagtggagatttcccggaaaacagtgagcatggagtgccggactctgtcagccagagctgggacgtcatctggtgtcagcccttccgtgggcactgggggcagcacccgcacctgacattgtcctggggcaaggggagcaccatcatggcctgtccacccaggtctttgcccacagggatgtcctcccagcctctccggacacaccctaccccagaactgctcaaagccctcacccgaggtgaagcgacgctccttcttgcagtagaagtcttggatgactcacgtcctgggtgagcagggtctgggcgacctcagacatgacactgatggcatcccccgtgcgcttccggtcgatgaagatgactcctgccagccagcaggccagcccggcagagccagcccacagtagctcgcgcttggcaatgggcacacagcggcctggcagtacctccatcatcccttgggcagggtgggagtgggtgaggatcggggtggaggcagagtgtcacagaaggcaacccacctcacccagctcatcaccctctggtagggactggaggtgaaggaggagactaggcagggaggggggccccaagtgaaggaaagggtgaccaaaagtatatgtaccctgcttatgagggcagttctacccagggaatgaaggcctgagtgggaggcaagggggcaatgtcccagaggaaggggaattgaggatctctaggagaagatattctagggaaggtttcaggaggggaggcatggctgggggaggtgtgccctgtggtggggtctcaccaagcagatcgagagagctctggtggttggagacaacaacatagggctgcgagggagggaagtggtgagcccctcgcacctccactcggatcccgtacaggtatttgatgtggagcagcattagacgcaagatcctgtggggtcatggcaaggggtcccagtgggatccattgatgtccatctgcatgcctcagctccccccaccttactgtctttctgaccacctttgcagtcctctccccattccctgtctctggtctctctcagtcttttctacacacaccatgcccccttcccccaatccactactcactttgtacccttaggttccctcattgcccaagaccccttgcccctcacttcatgttctcgacgttgcgtcctcgcacggcacacacagggatggcgagcacagccaggaagaggatccagccattgtagaaggccatcttgaagaagtacttggcactggggctgcagaaccacagggtgggcagcaggaagagcagcagcaggaagagcagcagcagcagcatccatgcccctggccacaaatccattctggccacctgcaggggatggggcaagggacaatcagcctggtttctggaggagagtggggctccggatatattcagacaagagacacaagacacagacatctacaattcacagatacctgataataaatgacaacaagaataatagctaacacttgtagctggtaagggtcttataatggtctatacttgtgctgtccgagaaagtagccaccacctacatgtggctacttgaaatgcagctagtctgaactgagatgtgctggaaatgtaaaatacacatcagatttcaaagactgaataaaaaacaaaatgtg

SEQ ID NO: 163518 - DNA, 1010 bp, Homo sapiens; identical to SEQ ID NO: 124907
  Payload ID: 12200
  Gene Symbol: PPT2
  Gene Name: palmitoyl-protein thioesterase 2
  ENST ID: ENST00000492976
  CDS Start-End: 1-383

SEQ ID NO: 163519 - DNA, 2878 bp, Homo sapiens
  Payload ID: 12200
  Gene Symbol: PPT2
  Gene Name: palmitoyl-protein thioesterase 2
  Uniprot ID: Q9UMR5
  ENST ID: ENST00000496937
  CDS Start-End: 569-1474
ggaagtggggagaatcaaggcggggaaatcggacttttgggtcgctgggggcaacgaagcctggagaggccttctttccattcccagaatatgtttgctgctttttcctctccccactggcctaaatggatcgctccgcctgtttcctccccagcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactgcctgccaggcccacccaccagtctgagctgcttctgctgaggctggtctgcttgaagcctcccaggagaaagaagccagcctgtagggtccagcgtcaaagcgaatcatggggtccagggctgagctgtgcactctcttaggcggattctccttcctcctgctactgataccaggcgagggggccaagggtggatccctcagagagaggtgacaacagagggggtagggcccggggtgagctcttctcaggagccttctgctgggggtggggcttcacaggaggcaaaacataactgtaagtttagaatgggggtgagaggctgtcatctggagggagagcggggggcctcagtagcctcttgagggaagtgggactcctggctccccagggcctggcctactcaatctctcccacctcatcctctggcatggacgcagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaggcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtggacgtggatgaatgtaggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccgttcgggaggcagaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaagggggaggcctgtgttcttggcctgcccctgagtcttctggctgggggcaggttgcctgggcaagaactgcttcttcaattccttaacaaatgcaaccaccaacacccagatctctctctctctttattttcagtttttttgctgttatccagataattaataaaaaccaaccacgcaaaa

SEQ ID NO: 163520 - DNA, 2878 bp, Homo sapiens
  Payload ID: 12200
  Gene Symbol: PPT2
  Gene Name: palmitoyl-protein thioesterase 2
  Uniprot ID: Q9UMR5
  ENST ID: ENST00000527704
  CDS Start-End: 569-1474
ggaagtggggagaatcaaggcggggaaatcggacttttgggtcgctgggggcaacgaagcctggagaggccttctttccattcccagaatatgtttgctgctttttcctctccccactggcctaaatggatcgctccgcctgtttcctccccagcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactgcctgccaggcccacccaccagtctgagctgcttctgctgaggctggtctgcttgaagcctcccaggagaaagaagccagcctgtagggtccagcgtcaaagcgaatcatggggtccagggctgagctgtgcactctcttaggcggattctccttcctcctgctactgataccaggcgagggggccaagggtggatccctcagagagaggtgacaacagagggggtagggcccggggtgagctcttctcaggagccttctgctgggggtggggcttcacaggaggcaaaacataactgtaagtttagaatgggggtgagaggctgtcatctggagggagagcggggggcctcagtagcctcttgagggaagtgggactcctggctccccagggcctggcctactcaatctctcccacctcatcctctggcatggacgcagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaggcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtggacgtggatgaatgtaggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccgttcgggaggcggaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaagggggaggcctgtgttcttggcctgcccctgagtcttctggctgggggcaggttgcctgggcaagaactgcttcttcaattccttaacaaatgcaaccaccaacacccagatctctctctctctttattttcagtttttttgctgttatccagataattaataaaaaccaaccacgcaaaa

SEQ ID NO: 163521 - DNA, 901 bp, Homo sapiens
  Payload ID: 12200
  Gene Symbol: PPT2
  Gene Name: palmitoyl-protein thioesterase 2
  ENST ID: ENST00000478621
  CDS Start-End: 192-901
agcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgagtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccag

SEQ ID NO: 163522 - DNA, 584 bp, Homo sapiens
  Payload ID: 12200
  Gene Symbol: PPT2
  Gene Name: palmitoyl-protein thioesterase 2
  ENST ID: ENST00000488435
  CDS Start-End: 104-397
gaaactgggccaggctgcacttagctcaaggggcctcgaggactctctgcgtctctggagacaagggcactacacgcacttcagaatgaagagttgcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaa

SEQ ID NO: 163523 - DNA, 2875 bp, Homo sapiens
  Payload ID: 12200
  Gene Symbol: PPT2
  Gene Name: palmitoyl-protein thioesterase 2
  Uniprot ID: Q9UMR5
  ENST ID: ENST00000490624
  CDS Start-End: 569-1474
ggaagtggggagaatcaaggcggggaaatcggactttcgggtcgctgggggcaacgaagcctggagaggccttctttccattcccagaatatgtttgctgctttttcctctccccactggcctaaatggatcgctccgcctgtttcctccccagcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgttctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactgcctgccaggcccacccaccagtctgagctgcttctgctgaggctggtctgcttgaagcctcccaggagaaagaagccagcctgtagggtccagcgtcaaagcgaatcatggggtccagggctgagctgtgcactctcttaggcggattctccttcctcctgctactgataccaggcgagggggccaagggtggatccctcagagagaggtgacaacagagggggtagggcccggggtgagctcttctcaggagccttctgctgggggtggggcttcacaggaggcaaaacataactgtaagtttagaatgggggtgagaggctgtcatctggagggagagcggggggcctcagtagcctcttgagggaagtgggactcctggctccccagggcctggcctactcaatctctcccacctcatcctctggcatggacgcagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaggcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtggacgtggatgaatgtaggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccgttcgggaggcggaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaagggggaggcctgtgttcttggcctgcccctgagtcttctggctgggggcaggttgcctgggcaagaactgcttcaattccttaacaaatgcaaccaccaacacccagatctctctctctctttattttcagtttttttgctgttatccagataattaataaaaaccaaccacgcaaaa

SEQ ID NO: 163524 - DNA, 2382 bp, Homo sapiens
  Payload ID: 12200
  Gene Symbol: PPT2
  Gene Name: palmitoyl-protein thioesterase 2
  ENST ID: ENST00000525601
  CDS Start-End: 746-1654
tttttttttttttttaaacaaaaacacagccagataatcattattcttcccttacgtccccccagcccccacctggggcagtcgctctcccggctgcgtcccttttcgtccatgtcctagcagagactacagagcagtacagaggctctcgctgaaaccagtcccaggctccacagagtcagatcacggcttcacaccagtcgttctggtcacttaggcgttcgcgtgagcgctcaaccccttaccgccacctcatcgtcactctacaccattctgagcgcaaaaatgttttgattgagacaaatttagaccaagcaatgaccttgtaaacagagagaggggctcagacatgctgagaaatccttatctctagagaaacgtctttaaatgctaagtaaaagccctagcaagtaaaagccctgaggcactagggtgtcggttaggggtcacaggcggagaggtggggcgcctgggggtttcggtagggagccacccacagataactcagacagccagattctgggggtcgttcaggttgaaagactggtcgaaattacgcgggcatgagtcagcgcatccctacgcgccctccgccccttgagggtgggtcgcttatagggaggggagtagagtagggcaggagaaactgggccaggctgcacttagctcaaggggcctcgaggactctctgcgtctctggagacaagggcactacacgcacttcagaatgaagagttgcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtg

SEQ ID NO: 163525 - DNA, 2878 bp, Homo sapiens; identical to SEQ ID NO: 163520
  Payload ID: 12200
  Gene Symbol: PPT2
  Gene Name: palmitoyl-protein thioesterase 2
  Uniprot ID: Q9UMR5
  ENST ID: ENST00000488579
  CDS Start-End: 569-1474

SEQ ID NO: 163526 - DNA, 1010 bp, Homo sapiens; identical to SEQ ID NO: 124907
  Payload ID: 12200
  Gene Symbol: PPT2
  Gene Name: palmitoyl-protein thioesterase 2
  ENST ID: ENST00000497702
  CDS Start-End: 1-383

SEQ ID NO: 163527 - DNA, 163 bp, Homo sapiens
  Payload ID: 12200
  Gene Symbol: PPT2
  Gene Name: palmitoyl-protein thioesterase 2
  ENST ID: ENST00000469283
  CDS Start-End: 1-163
accacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccag

SEQ ID NO: 163528 - DNA, 1278 bp, Homo sapiens
  Payload ID: 12200
  Gene Symbol: PPT2
  Gene Name: palmitoyl-protein thioesterase 2
  ENST ID: ENST00000467040
  CDS Start-End: 569-1278
ggaagtggggagaatcaaggcggggaaatcggacttttgggtcgctgggggcaacgaagcctggagaggccttctttccattcccagaatatgtttgctgctttttcctctccccactggcctaaatggatcgctccgcctgtttcctccccagcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgagtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccag

SEQ ID NO: 163529 - DNA, 1010 bp, Homo sapiens; identical to SEQ ID NO: 124907
  Payload ID: 12200
  Gene Symbol: PPT2
  Gene Name: palmitoyl-protein thioesterase 2
  ENST ID: ENST00000493225
  CDS Start-End: 1-383

SEQ ID NO: 163530 - DNA, 790 bp, Homo sapiens
  Payload ID: 12200
  Gene Symbol: PPT2
  Gene Name: palmitoyl-protein thioesterase 2
  ENST ID: ENST00000485053
  CDS Start-End: 217-615
cttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagcttctttggtttctatgatgcaaatgaga

SEQ ID NO: 163531 - DNA, 4181 bp, Homo sapiens; identical to SEQ ID NO: 163517
  Payload ID: 12200
  Gene Symbol: PPT2
  Gene Name: palmitoyl-protein thioesterase 2
  Uniprot ID: Q9UMR5
  ENST ID: ENST00000493809
  CDS Start-End: 192-1097

SEQ ID NO: 163532 - DNA, 2053 bp, Homo sapiens
  Payload ID: 12200
  Gene Symbol: PPT2
  Gene Name: palmitoyl-protein thioesterase 2
  ENST ID: ENST00000550796
  CDS Start-End: 415-1323
cacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtgtg

SEQ ID NO: 163533 - DNA, 2053 bp, Homo sapiens
  Payload ID: 12200
  Gene Symbol: PPT2
  Gene Name: palmitoyl-protein thioesterase 2
  ENST ID: ENST00000552922
  CDS Start-End: 415-1323
cacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgttctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtgtg

SEQ ID NO: 163534 - DNA, 2053 bp, Homo sapiens; identical to SEQ ID NO: 163532
  Payload ID: 12200
  Gene Symbol: PPT2
  Gene Name: palmitoyl-protein thioesterase 2
  ENST ID: ENST00000551222
  CDS Start-End: 415-1323

SEQ ID NO: 163535 - DNA, 2053 bp, Homo sapiens; identical to SEQ ID NO: 163532
  Payload ID: 12200
  Gene Symbol: PPT2
  Gene Name: palmitoyl-protein thioesterase 2
  ENST ID: ENST00000546871
  CDS Start-End: 415-1323

SEQ ID NO: 163536 - DNA, 2053 bp, Homo sapiens; identical to SEQ ID NO: 163532
  Payload ID: 12200
  Gene Symbol: PPT2
  Gene Name: palmitoyl-protein thioesterase 2
  ENST ID: ENST00000547309
  CDS Start-End: 415-1323

SEQ ID NO: 163537 - DNA, 2053 bp, Homo sapiens
  Payload ID: 12200
  Gene Symbol: PPT2
  Gene Name: palmitoyl-protein thioesterase 2
  ENST ID: ENST00000547646
  CDS Start-End: 415-1323
cacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgagtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtgtg

SEQ ID NO: 163538 - DNA, 238 bp, Homo sapiens
  Payload ID: 12200
  Gene Symbol: PPT2
  Gene Name: palmitoyl-protein thioesterase 2
  ENST ID: ENST00000475020
  CDS Start-End: 121-238
cccttcccacagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcct

SEQ ID NO: 163539 - DNA, 790 bp, Homo sapiens; identical to SEQ ID NO: 163530
  Payload ID: 12200
  Gene Symbol: PPT2
  Gene Name: palmitoyl-protein thioesterase 2
  ENST ID: ENST00000469411
  CDS Start-End: 217-615

SEQ ID NO: 163540 - DNA, 584 bp, Homo sapiens; identical to SEQ ID NO: 163522
  Payload ID: 12200
  Gene Symbol: PPT2
  Gene Name: palmitoyl-protein thioesterase 2
  ENST ID: ENST00000494953
  CDS Start-End: 104-397

SEQ ID NO: 163541 - DNA, 3101 bp, Homo sapiens
  Payload ID: 12201
  Gene Symbol: ZDHHC3
  Gene Name: Palmitoyltransferase ZDHHC3
  ENST ID: ENST00000630389
  CDS Start-End: 275-1258
gcgtcatcaacctgcgcggcggccgctcctgcagccgcggccgccgccactgccgggagagctcgatgggcttctcctgcgcgccgcccggtgtctggccgagtccagagagccgcggcgcctcgttccgaggagccatcgccgaagcccgaggccgggtcccgggttggggactgcaggggaaggcagcggcggcggcggcgggagccccaccggggtctgggactggggaactgcctccggcttcacgatgccagtatggacagaatagcttatgatgcttatccccacccaccacttccgaaacattgagcggaaaccagaatacctccagccagagaagtgtgtcccacccccctaccctggtcctgtgggaaccatgtggtttatccgtgacggctgtggcatcgcctgtgccatcgttacctggtttctggtcctctatgcggagttcgtggtcctctttgtcatgctgattccatctcgagactacgtgtatagcatcatcaacggaattgtgttcaacctgctggccttcttggccctggcctcccactgccgggccatgctgacggaccccggggcagtgcccaaaggaaatgccactaaagaattcatcgagagtttacagttgaagcctgggcaggtggtgtacaagtgccccaaatgctgcagcatcaagcccgaccgagcccaccactgcagtgtttgtaagcggtgcattcggaagatggaccaccactgtccctgggtcaacaactgtgtaggcgagaacaaccagaagtacttcgtcctgtttacaatgtacatagctctcatttccttgcacgccctcatcatggtgggattccacttcctgcattgctttgaagaagattggacaacctatggactgaacagggaagaaatggcagagactggaatctctcttcatgaaaaaatgcagccccttaacttcagttcgacagagtgcagctccttctctccacccaccacagtgattctccttatcctgctgtgctttgagggcctgctcttcctcattttcacatcagtgatgtttgggacccaggtgcactccatctgcacagatgagacgggaatagaacaattgaaaaaggaagagagaagatgggctaaaaaaacaaaatggatgaacatgaaagccgtttttggccaccccttctctctaggctgggccagcccctttgccacgccagaccaagggaaggcagacccgtaccagtatgtggtctgaaggaccccgaccggcatggccactcagacacaagtccacaccacagcactaccgtcccatccgttctcatgaatgtttaaatcgaaaaagcaaaacaactactcttaaaactttttttatgtctcaagtaaaatggctgagcattgcagagaaaaaaaaaagtccccacattttattttttaaaaaccatcctttcgatttcttttggtgaccgaagctgctctcttttccttttaaaatcacttctctggcctctggtttctctctgctgtctgtctggcatgactaatgtagagggcgctgtctcgcgctgtgcccattctactaactgagtgagacatgacgctgtgcgtggatggaatagtctggacacctggtgggggatgcatgggaaagccaggagggccctgacctcccactgcccaggaggcagtggcgggctccccgatgggacataaaacctcaccgaagatggatgcttaccccttgaggcctgagaagggcaggatcagaagggaccttggcacagcgacctcatcccccaagtggacacggtttgcctgctaactcgcaaagcaattgcctgccttgtactttatgggcttggggtgtgtagaatgattttgcgggggagtggggagaaagatgaaagaggtcttatttgtattctgaatcagcaattatattccctgtgattatttggaagagtgtgtaggaaagacgtttttccagttcaaaatgccttatacaatcaagaggaaaaaaaattacacaatttcaggcaagctacgttttcctttgtttcatctgcttcctctctcaccaccccatctccctctcttccccagcaagatgtcaattaagcagtgtgaattctgactgcaataggcaccagtgcccaacacatacagccccaccatcatccccttctcattttataaacctcaaagtggattcactttctgatagttaacccccataaatgtgcacgtacctgtgtcttatctatattttaacctgggagactgttgtcctggcatggagatgaccatgatgctggggttacctcacagtccccaccctttcaaagttgacatatggccatcccattggccagaatccacagacacacctaagcctgtggcactgggacagaatagattttccatttgagaggcacttcctgtgtcagtcttgtttgaaggaggtggtgatggtggatagaggtgaaggaggtagggagtgccctccaagtgcaaaaataacaaatatgattattgaccatcggggaattctcacacattgatttgttttttaagcaattgccagaaacccccttttttagcttttgcttggggtgggggtaggagttaaggtttattcaatcctgtcctgggtagggcgaaagttaatctagccatgtgatttttcagaaaagtaagtggaacatgctgccacttttcaattctgtcagtgcttccacatggaaacaaaatgcaataaaatttttccaaaacctgttctgatttagctctctcttgaggtgttacccttagtgggaggccgactatccacaatctacttgagttttctctggttgggtgtttgtttcattgctctgtctcttgaatgaggatactttattttttttgttttaaaatgcatttatggtccctctcttgaaccagcttgccccaccaggcctctttcctttgctttctgcagcctgaatcaattcctttgtgctgatgggctctcctaagagctttcctgagtcagttaactttacctcgtgtctacggtgctattcatgcgatacgggcgaggctgagatgctaagatt

SEQ ID NO: 163542 - DNA, 407 bp, Homo sapiens
  Payload ID: 12201
  Gene Symbol: ZDHHC3
  Gene Name: Palmitoyltransferase ZDHHC3
  ENST ID: ENST00000628490
  CDS Start-End: 1-182
cagtgatgtttgggacccaggtgcactccatctgcacagatgagacggctgcagatgatcacccaggaagagaatgcagaatgcccaaagcaaaccatctcagctggtcactgcttctgtgccaagaagggaggcctggcgaggggccagtcaggaagcagcatggcatcacatgctcatgacccacatgaaggtccctttagacttgtgtcaacaagatccattttctgaaacaactatttttgttctgattataaaagtaacattggctcattggtaaaacttggattgtgtgagaagtctacagaaataaatacaaatcctctagaattccatccccaaaagtaaccactcagacaaatgttctaatgtcatgtaaaaccatattaaaccatcttttctagctg

SEQ ID NO: 163543 - DNA, 472 bp, Homo sapiens
  Payload ID: 12201
  Gene Symbol: ZDHHC3
  Gene Name: Palmitoyltransferase ZDHHC3
  ENST ID: ENST00000630967
  CDS Start-End: 188-472
cccagcccaaccctgatacctttcatctttcctacagggggcagtgcccaaaggaaatgccactaaagaattcatcgagagtttacagttgaagcctgggcaggtggtgtacaagtgccccaaatgctgcagcatcaagcccgaccgagcccaccactgcagtgtttgtaagcggtgcattcggaagatggaccaccactgtccctgggtcaacaactgtgtaggcgagaacaaccagaagtacttcgtcctgtttacaatgtacatagctctcatttccttgcacgccctcatcatggtgggattccacttcctgcattgctttgaagaagattggacaaagtgcagctccttctctccacccaccacagtgattctccttatcctgctgtgctttgagggcctgctcttcctcattttcacatcagtgatgtttgggacccaggtgcactccatctgcacagatgagacg

SEQ ID NO: 163544 - DNA, 1336 bp, Homo sapiens
  Payload ID: 12201
  Gene Symbol: ZDHHC3
  Gene Name: Palmitoyltransferase ZDHHC3
  ENST ID: ENST00000629974
  CDS Start-End: 259-1260
cggcggccgctcctgcagccgcggccgccgccactgccgggagagctcgatgggcttctcctgcgcgccgcccggtgtctggccgagtccagagagccgcggcgcctcgttccgaggagccatcgccgaagcccgaggccgggtcccgggttggggactgcaggggaaggcagcggcggcggcggcgggagccccaccggggtctgggactggggaactgcctccggcttcacgatgccagtatggacagaatagcttatgatgcttatccccacccaccacttccgaaacattgagcggaaaccagaatacctccagccagagaagtgtgtcccacccccctaccctggtcctgtgggaaccatgtggtttatccgtgacggctgtggcatcgcctgtgccatcgttacctggtttctggtcctctatgcggagttcgtggtcctctttgtcatgctgattccatctcgagactacgtgtatagcatcatcaacggaattgtgttcaacctgctggccttcttggccctggcctcccactgccgggccatgctgacggaccccgtgagaacctgcacggaaatggccttcactttgcttgggcgaggtgcatcttttcctgaaaagctggacaagcctgtttcaggccgcagcaagtgcctcttgggggcagtgcccaaaggaaatgccactaaagaattcatcgagagtttacagttgaagcctgggcaggtggtgtacaagtgccccaaatgctgcagcatcaagcccgaccgagcccaccactgcagtgtttgtaagcggtgcattcggaagatggaccaccactgtccctgggtcaacaactgtgtaggcgagaacaaccagaagtacttcgtcctgtttacaatgtacatagctctcatttccttgcacgccctcatcatggtgggattccacttcctgcattgctttgaagaagattggacaaagtgcagctccttctctccacccaccacagtgattctccttatcctgctgtgctttgagggcctgctcttcctcattttcacatcagtgatgtttgggacccaggtgcactccatctgcacagatgagacgggaatagaacaattgaaaaaggaagagagaagatgggctaaaaaaacaaaatggatgaacatgaaagccgtttttggccaccccttctctctaggctgggccagcccctttgccacgccagaccaagggaaggcagacccgtaccagtatgtggtctgaaggaccccgaccggcatggccactcagacacaagtccacaccacagcactaccgtcccatccgttctcatgaatgt

SEQ ID NO: 163545 - DNA, 540 bp, Homo sapiens
  Payload ID: 12201
  Gene Symbol: ZDHHC3
  Gene Name: Palmitoyltransferase ZDHHC3
  ENST ID: ENST00000628075
  CDS Start-End: 1-335
tgcttatccccacccaccacttccgaaacattgagcggaaaccagaatacctccagccagagaagtgtgtcccacccccctaccctggtcctgtgggaaccatgtggtttatccgtgacggctgtggcatcgcctgtgccatcgttacctggtttctggtcctctatgcggagttcgtggtcctctttgtcatgctgattccatctcgagactacgtgtatagcatcatcaacggaattgtgttcaacctgctggccttcttggccctggcctcccactgccgggccatgctgacggaccccgtgaggggcagtgcccaaaggaaatgccactaaagaattcatcgagagtttacagttgaagcctgggcaggtggtgtacaagtgccccaaatgctgcagcatcaagcccgaccgagcccaccactgcagtgtttgtaagcggtgcattcggaagatggaccaccactgtccctgggtcaacaactgtgtaggcgagaacaaccagaagtacttcgtcctgtttacaatgtacatagct

SEQ ID NO: 163546 - DNA, 3226 bp, Homo sapiens
  Payload ID: 12201
  Gene Symbol: ZDHHC3
  Gene Name: Palmitoyltransferase ZDHHC3
  ENST ID: ENST00000627481
  CDS Start-End: 1-588
atcaagcccgaccgagcccaccactgcagtgtttgtaagcggtgcattcggaagatggaccaccactgtccctgggtcaacaactgtgtaggcgagaacaaccagaagtacttcgtcctgtttacaatgtacatagctctcatttccttgcacgccctcatcatggtgggattccacttcctgcattgctttgaagaagattggacaaagtgcagctccttctctccacccaccacagtgattctccttatcctgctgtgctttgagggcctgctcttcctcattttcacatcagtgatgtttgggacccaggtgcactccatctgcacagatgagacgggcatcgagcgcctcaaacgaaagaaccagcccagggagcacatggggagctggcagtcagtaaaggagacctttggtggggacttctccctgaactggttcaaccccttctccagaccgtgtcagccagagatccccagtgacaaagacatggtgcggcaggtgacatcgctgtcagacaccgaaacaatggaggatccatcagaggagacaaaggacgaggactctgtggaggtgacagatgaatagatgctgctgtggggagagaagcaaacactaaaaagtgctgtcaaccttcatcctggggttttggctaaaggggcttatgggcatggtgcgctcccagcacccccagtgcttcccttagccactcgcttggccttgccatttcccctccttcttctctccatgttgggccaggtctgggggtcgggagtaggctggggacatcagaggaggatgggggctttctcagagttcatctaagaagagtctgcactgagacggctcatcaagaaccgttctccaagactgggtggctttcacattctccgcccagcaaagggagcttttgaacagggcatcccaggggcagaaaagagcttgcctttggctttccccaggatttctgtcttctcttgggaaggctgggcccctggctcctggctttgagaagtaaggttgtgacagaaggaccgggcagggcttgccttggggacctgggttgggacactgacatcaggggagactagcctggaaagactgcagagctgccagctactccctggaaagggcttccccatgctgcctgccgaaattaggaggtagaggtggctgccacatctacctgcaagggccaggcatggttcaaagaggaccctgcattaagctctacacacacatgtgcaggacatgtccagcatggacagagccagagttaagacagtagcaccgaaaatgagcccccattccacagacactggagtcttcactgagcgagacagctgggagctgtcctgcctgtggctacatatctagccattcacagatgtggatatgggaaggacctctttggagctactggggactccctaaccactcgcatgagaacttaattgaatgttacctcttggagggagtctaataacacatgtaggtagaactgaccataaaccctgcctgtgtgtttgaaaaggccagttctcccaaattggtgcccatcttgtctctgaaaagatgggtgatggccagggtctgctgattgatgaatcagatgaatcaggaagatagacaaacacacacacacacacacacaccccaccaggatgagtctgccctctattcaccccatttgaagcctgtggtgtctgtgaccactgctgaaggtctgagcagcgttctggtgctcctaaaccccattccagtggttgctgaagcagcatcttctgcacaaagcccaacagaagggttcttatccccgtttggtataagaagtggattcaccacccactccctccacgtgcctttgttcctctctttggcccatttccccagcgtctactggcgtcaggattggcaggagcacaggcactcagcagagcatgcccctgcaagacctcagtgttagggccccccttccagctccaggcaaaagggcatgagtcctggccccaaggggcctgtggctgcagttcagaggagaagaaggtcagtgtttggaggtgcagcctcaggatgctgagaaaggaaactggcgaccgtgagaaagaaaagagccaagcagcatcctggttcttggacagcatctttggacactctgtgaagggcaacgatcctgccagagaccgtctctctacaactgatgacccactagggcctggggttaattgctcaaagggcccagtgttcacaaagccacctctgccctaacccttgccagagctctccaactatgacccacgagaggggtgatggtgggattctaacatcaacagagcaaccagaaagacattgggcctcccacactcaggctgcaggcccactttcttggtccttatcagctttaatatttattaatgacgacataggagcccgagtcagctgtaaaggccattaacttgcaatctggacaggaagttgacgctcaccactttgggtaagagctgctctgactgtagggccccctatttgttgtcctaacccagaagcagctctgggctgccaggatggtggatggaataccagagagttcacactagggaggaagcaatgcctgccccctggagtctcctagggggcagcagttagaataagggaagaggatttgctggtcactgtttgctgacatgggtttccatggtgagttcaggcctgaggacagcagtgtctgcaaaaccacatggcccttgagaaatgtccttgcacattgggcttcaaactcctcttctagggaatccatcttggcctgaaagcagaggtacaacaccagccccaaaggcaattctgttttcagattggttgctctggaaaggaaggctggggtgagggggcattttacttgcacagaggctgaccctgcctcccctcttcactgaccccatctccaaggtagacctcagccatgtcagtccctgttctgggaggtgctgggctgggccacagccagggttatgtaggtaattaacctgtccaaccctgagcctcgcctccccacaccagcaacacagtggtctctctgtggtgaccattcacagcataacattctgcttagcctcagactgaaagcattgcaactgatgtcaaaaccagatgagatcttacagggagagagattgggtgcaatttgcctctttctttgaataaaaagctctttgctcaccctcagtga

SEQ ID NO: 163547 - DNA, 2687 bp, Homo sapiens
  Payload ID: 12201
  Gene Symbol: ZDHHC3
  Gene Name: Palmitoyltransferase ZDHHC3
  ENST ID: ENST00000628351
  CDS Start-End: 270-1169
atcaacctgcgcggcggccgctcctgcagccgcggccgccgccactgccgggagagctcgatgggcttctcctgcgcgccgcccggtgtctggccgagtccagagagccgcggcgcctcgttccgaggagccatcgccgaagcccgaggccgggtcccgggttggggactgcaggggaaggcagcggcggcggcggcgggagccccaccggggtctgggactggggaactgcctccggcttcacgatgccagtatggacagaatagcttatgatgcttatccccacccaccacttccgaaacattgagcggaaaccagaatacctccagccagagaagtgtgtcccacccccctaccctggtcctgtgggaaccatgtggtttatccgtgacggctgtggcatcgcctgtgccatcgttacctggtttctggtcctctatgcggagttcgtggtcctctttgtcatgctgattccatctcgagactacgtgtatagcatcatcaacggaattgtgttcaacctgctggccttcttggccctggcctcccactgccgggccatgctgacggaccccggggcagtgcccaaaggaaatgccactaaagaattcatcgagagtttacagttgaagcctgggcaggtggtgtacaagtgccccaaatgctgcagcatcaagcccgaccgagcccaccactgcagtgtttgtaagcggtgcattcggaagatggaccaccactgtccctgggtcaacaactgtgtaggcgagaacaaccagaagtacttcgtcctgtttacaatgtacatagctctcatttccttgcacgccctcatcatggtgggattccacttcctgcattgctttgaagaagattggacaaagtgcagctccttctctccacccaccacagtgattctccttatcctgctgtgctttgagggcctgctcttcctcattttcacatcagtgatgtttgggacccaggtgcactccatctgcacagatgagacgggaatagaacaattgaaaaaggaagagagaagatgggctaaaaaaacaaaatggatgaacatgaaagccgtttttggccaccccttctctctaggctgggccagcccctttgccacgccagaccaagggaaggcagacccgtaccagtatgtggtctgaaggaccccgaccggcatggccactcagacacaagtccacaccacagcactaccgtcccatccgttctcatgaatgtttaaatcgaaaaagcaaaacaactactcttaaaactttttttatgtctcaagtaaaatggctgagcattgcagagaaaaaaaaaagtccccacattttattttttaaaaaccatcctttcgatttcttttggtgaccgaagctgctctcttttccttttaaaatcacttctctggcctctggtttctctctgctgtctgtctggcatgactaatgtagagggcgctgtctcgcgctgtgcccattctactaactgagtgagacatgacgctgtgcgtggatggaatagtctggacacctggtgggggatgcatgggaaagccaggagggccctgacctcccactgcccaggaggcagtggcgggctccccgatgggacataaaacctcaccgaagatggatgcttaccccttgaggcctgagaagggcaggatcagaagggaccttggcacagcgacctcatcccccaagtggacacggtttgcctgctaactcgcaaagcaattgcctgccttgtactttatgggcttggggtgtgtagaatgattttgcgggggagtggggagaaagatgaaagaggtcttatttgtattctgaatcagcaattatattccctgtgattatttggaagagtgtgtaggaaagacgtttttccagttcaaaatgccttatacaatcaagaggaaaaaaaattacacaatttcaggcaagctacgttttcctttgtttcatctgcttcctctctcaccaccccatctccctctcttccccagcaagatgtcaattaagcagtgtgaattctgactgcaataggcaccagtgcccaacacatacagccccaccatcatccccttctcattttataaacctcaaagtggattcactttctgatagttaacccccataaatgtgcacgtacctgtgtcttatctatattttaacctgggagactgttgtcctggcatggagatgaccatgatgctggggttacctcacagtccccaccctttcaaagttgacatatggccatcccattggccagaatccacagacacacctaagcctgtggcactgggacagaatagattttccatttgagaggcacttcctgtgtcagtcttgtttgaaggaggtggtgatggtggatagaggtgaaggaggtagggagtgccctccaagtgcaaaaataacaaatatgattattgaccatcggggaattctcacacattgatttgttttttaagcaattgccagaaacccccttttttagcttttgcttggggtgggggtaggagttaaggtttattcaatcctgtcctgggtagggcgaaagttaatctagccatgtgatttttcagaaaagtaagtggaacatgctgccacttttcaattctgtcagtgcttccacatggaaacaaaatgcaataaaatttttccaaaacc

SEQ ID NO: 163548 - DNA, 537 bp, Homo sapiens
  Payload ID: 12201
  Gene Symbol: ZDHHC3
  Gene Name: Palmitoyltransferase ZDHHC3
  ENST ID: ENST00000631250
  CDS Start-End: 404-537
agcgcgtcatcaacctgcgcggcggccgctcctgcagccgcggccgccgccactgccgggagagctcgatgggcttctcctgcgcgccgcccggtgtctggccgagtccagagagccgcggcgcctcgttccgaggagccatcgccgaagcccgaggccgggtcccgggttggggactgcaggggaaggcagcggcggcggcggcgggagccccaccggggtctgggactggggaactgcctccggcttcacgggggcagtgcccaaaggaaatgccactaaagaattcatcgagagtttacagttgaagcctgggcaggtggtgtacaagtgccccaaatgctgcagcatcaagcccgaccgagcccaccactgcagtgtttgtaagcggtgcattcggaagatggaccaccactgtccctgggtcaacaactgtgtaggcgagaacaaccagaagtacttcgtcctgtttacaatgtacatagctctcatttccttgcacgccctcatcatggtgggattccacttcctgcattg

SEQ ID NO: 163549 - DNA, 4537 bp, Homo sapiens
  Payload ID: 12202
  Gene Symbol: PAN2
  Gene Name: PAN2 poly(A) specific ribonuclease subunit
  Uniprot ID: Q504Q3
  ENST ID: ENST00000257931
  CDS Start-End: 260-3865
cttggcgccgtagtggttaggttgagccctaggcgtgggggagaactggggaaactggaatttcccgcggagctgacagcgcttgcgctccccctactcgttctaattccacgcgctccaaaatatccgccatggagaaatcttggccaggatgtccattctaggcccatcggtgctgtcttgctgaaggttgggtcaggcatctaaagggactgtggtaagggagggtgtgacacaggtgtaagctgccatcgtcatcatgaactttgagggtctggaccctggactggcagaatatgccccagccatgcattctgccctggaccctgtcttggatgcccacctgaacccaagtctgctacagaatgtggagctggacccagagggagtggccttggaggctcttcccgtccaggaatcagtgcacataatggaaggtgtctactctgaattgcacagcgtggtggctgaagtgggtgtacctgtttccgtctcccactttgacttgcacgaggagatgctgtgggtggggagccacgggggccatgccacttcattttttggcccagccttggagcgctactcatcctttcaagtcaatggcagtgatgatattcggcagatccagagcctggagaatggtatcctttttctcaccaagaacaacctcaagtatatggcccgtgggggcctcattatatttgattacctgctggatgagaatgaggatatgcacagtctcctactgactgacagcagcactctactcgttggtgggctgcagaatcacataatagagattgatcttaacactgtccaggagactcagaagtatgcagtagagacgcctggagtcaccatcatgagacagacaaatcgcttcttcttctgcggccacacgtctggcaaggtttccctgagagacctccgtacttttaaggtggaacatgagtttgatgccttctcaggaagtctgtcagactttgatgtgcatggcaacctgctagctgcctgtggcttctccagccgcctcactggcctggcctgcgaccgtttcctcaaggtgtatgatttgcgcatgatgcgtgccatcacaccacttcaagtacatgtggatcctgccttcttgcgcttcattcctacatatacttctcgtcttgctatcatctctcagtcagggcagtgccaattctgtgaacccacaggcctggccaacccagccgatatctttcatgtgaatcctgtggggcctctgctaatgacatttgatgtgtcagccagcaagcaggctctggcctttggggattctgagggctgtgtgcacctctggactgattccccggagccttccttcaacccctactcccgtgagactgagtttgctttgccgtgtctcgtggactcactgcctcctctggactggagccaggacctgctgcctctttccctcatccctgtcccactcaccactgacacacttctctctgattggcctgctgccaactctgctccagctcccaggcgagcaccacccgtggatgcagagattctgcgcaccatgaagaaggtgggcttcattggctatgcgcccaatccccgcaccaggctgcgcaatcagataccctacagactcaaggagtcagacagtgaatttgacagcttcagccaggtcactgagtcaccagtaggacgagaagaggaaccacatctccacatggtttctaagaaataccgcaaggtgaccatcaaatattccaagctagggctggaggactttgacttcaaacactacaataagaccttgtttgctggattagagccccacattcccaacgcctactgtaactgcatgatccaggtgctctatttcctggagcctgtacgctgtctaattcaaaaccacctttgccagaaggagttctgtctggcatgtgagctgggcttcctgtttcacatgttggacctctctcgtggtgacccttgccagggcaataattttcttcgggcattccgtactattcctgaggcctcagccctcggtctaatcctggctgactcagatgaggcctcaggcaagggcaatctggccaggctcattcagaggtggaatcgcttcattctcactcaactgcatcaagatatgcaggagctggaaataccacaggcttatcgaggtgctggaggcagcttttgctcatcgggggactctgttattgggcagctcttcagctgtgagatggagaactgcagcctctgccgctgtggcagtgagaccgtgcgagcctcatccactctgcttttcacactctcctaccctgatggtagcaaaagtgataaaactgggaagaactatgactttgctcaggtgctgaagcgaagcatctgcctggaccagaatacacaggcctggtgtgacacctgtgaaaagtaccagcccacgattcagacccgcaacatccgccatctgccagatattcttgtcatcaattgtgaggtgaacagctcaaaagaggctgatttctggagaatgcaggctgaggttgccttcaagatggcagtaaagaaacacggtggggaaatctccaagaacaaggaatttgctttggctgattggaaggaactagggagtccagagggtgtgctggtgtgtccctccattgaggagttgaagaacgtctggcttcctttctccattcgcatgaagatgaccaaaaacaaagggctggatgtttgcaattggactgatggggatgagatgcagtggggcccagccagggcagaggaggagcatggtgtctatgtgtatgacctgatggctactgtggtacacatcctggactcacgcacagggggcagcctggtggctcacatcaaagttggagagacctaccaccagcgcaaggagggcgttactcaccagcagtggtatctgttcaatgactttcttattgaacctattgataagcatgaagctgtgcagtttgacatgaattggaaagtacctgcaatcctttattatgtcaaacggaatctcaattccagatacaacctgaacatcaagaaccctattgaggcaagtgtcttgctggctgaagcctcgctggcacggaagcagcggaaaacacatactacctttattccactgatgctgaatgagatgccacagattggggacctggtgggtctggatgctgagtttgtcacccttaatgaggaggaagcagagttacgcagtgatggtaccaagtctaccattaaaccaagccagatgtcagtagccaggattacctgtgttcggggccagggacccaatgagggtatccccttcattgatgactacatctctacccaggagcaggtggtggattacttgactcaatactcgggtataaagcctggtgacctcgatgccaaaatttcctccaagcacctaacaactctcaagtctacctacttaaagcttcgttttctcattgacattggagtcaagtttgtgggtcatggcctgcagaaggacttccgggtcatcaacctgatggtgcccaaggaccaagtccttgacactgtctacctgttccatatgccccgaaaacgaatgatttccctgcgattccttgcttggtactttctggacctgaagattcaaggggaaacccatgacagtattgaggatgcccgcacagcccttcagctgtaccgaaagtatctggagctaagcaaaaatggcactgagcctgagtctttccacaaggtgctcaagggtctttatgagaagggcagaaagatggactggaaggtgcctgagcctgagggccaaacaagtcccaagaatgcagctgtcttctcctcagtgctggcgctctgactacccttcccaaagaaccacggccctctccctttactgttctatagccccagaactgggagatggcttcctaagttggctataccttgtccacttccagtactggacgtgctcagggtctagggtcacagatggtgctattaattgaactggaacacagcagaattgttgcaaaggttctaggagccagattcattccttcttcattctttgcaaaacagtggtacagacatggagtctagaattgacccagatggaaagtaattggtattcttaatatcctgggtgactaatatccaggcagagaagctcctggaaccataactgtaagttcctagctggctagggattgaagtcctggacagtgacagaggataccacagtagttcaagacttagcacaagtcaccaactgcttcagggatacctggaggggccagcaagtagagtgttggtggcccaagcaaaccagtgttgccaataccattgccaaaagggcctttggatcctggacaaagcttggctgccggcttcatttattcctgctgatggctgagaagcatctgtcttccatcccacttgcctgtcccaagttttgttccattttttaaaaatttgttgtaaactgcatgttttataaaataaaaataaaatatcgtttgttatttatctc

SEQ ID NO: 163550 - DNA, 4576 bp, Homo sapiens
  Payload ID: 12202
  Gene Symbol: PAN2
  Gene Name: PAN2 poly(A) specific ribonuclease subunit
  Uniprot ID: Q504Q3
  ENST ID: ENST00000440411
  CDS Start-End: 307-3903
atgccccgagcccttcttgattggaagaagcgcctcggaccccggtccttggcgccgtagtggttaggttgagccctaggcgtgggggagaactggggaaactggaatttcccgcggagctgacagcgcttgcgctccccctactcgttctaattccacgcgctccaaaatatccgccatggagaaatcttggccaggatgtccattctaggcccatcggtgctgtcttgctgaaggttgggtcaggcatctaaagggactgtggtaagggagggtgtgacacaggtgtaagctgccatcgtcatcatgaactttgagggtctggaccctggactggcagaatatgccccagccatgcattctgccctggaccctgtcttggatgcccacctgaacccaagtctgctacagaatgtggagctggacccagagggagtggccttggaggctcttcccgtccaggaatcagtgcacataatggaaggtgtctactctgaattgcacagcgtggtggctgaagtgggtgtacctgtttccgtctcccactttgacttgcacgaggagatgctgtgggtggggagccacgggggccatgccacttcattttttggcccagccttggagcgctactcatcctttcaagtcaatggcagtgatgatattcggcagatccagagcctggagaatggtatcctttttctcaccaagaacaacctcaagtatatggcccgtgggggcctcattatatttgattacctgctggatgagaatgaggatatgcacagtctcctactgactgacagcagcactctactcgttggtgggctgcagaatcacataatagagattgatcttaacactgtccaggagactcagaagtatgcagtagagacgcctggagtcaccatcatgagacagacaaatcgcttcttcttctgcggccacacgtctggcaaggtttccctgagagacctccgtacttttaaggtggaacatgagtttgatgccttctcaggaagtctgtcagactttgatgtgcatggcaacctgctagctgcctgtggcttctccagccgcctcactggcctggcctgcgaccgtttcctcaaggtgtatgatttgcgcatgatgcgtgccatcacaccacttcaagtacatgtggatcctgccttcttgcgcttcattcctacatatacttctcgtcttgctatcatctctcagtcagggcagtgccaattctgtgaacccacaggcctggccaacccagccgatatctttcatgtgaatcctgtggggcctctgctaatgacatttgatgtgtcagccagcaagcaggctctggcctttggggattctgagggctgtgtgcacctctggactgattccccggagccttccttcaacccctactcccgtgagactgagtttgctttgccgtgtctcgtggactcactgcctcctctggactggagccaggacctgctgcctctttccctcatccctgtcccactcaccactgacacacttctctctgattggcctgctgccaactctgctccagctcccaggcgagcaccacccgtggatgcagagattctgcgcaccatgaagaaggtgggcttcattggctatgcgcccaatccccgcaccaggctgcgcaatcagataccctacagactcaaggagtcagacagtgaatttgacagcttcagccaggtcactgagtcaccagtaggacgagaagaggaaccacatctccacatggtttctaagaaataccgcaaggtgaccatcaaatattccaagctagggctggaggactttgacttcaaacactacaataagaccttgtttgctggattagagccccacattcccaacgcctactgtaactgcatgatccaggtgctctatttcctggagcctgtacgctgtctaattcaaaaccacctttgccagaaggagttctgtctggcatgtgagctgggcttcctgtttcacatgttggacctctctcgtggtgacccttgccagggcaataattttcttcgggcattccgtactattcctgaggcctcagccctcggtctaatcctggctgactcagatgaggcctcaggcaagggcaatctggccaggctcattcagaggtggaatcgcttcattctcactcaactgcatcaagatatgcaggagctggaaataccacaggcttatcgaggtgctggaggcagcagcttttgctcatcgggggactctgttattgggcagctcttcagctgtgagatggagaactgcagcctctgccgctgtggcagtgagaccgtgcgagcctcatccactctgcttttcacactctcctaccctgatgataaaactgggaagaactatgactttgctcaggtgctgaagcgaagcatctgcctggaccagaatacacaggcctggtgtgacacctgtgaaaagtaccagcccacgattcagacccgcaacatccgccatctgccagatattcttgtcatcaattgtgaggtgaacagctcaaaagaggctgatttctggagaatgcaggctgaggttgccttcaagatggcagtaaagaaacacggtggggaaatctccaagaacaaggaatttgctttggctgattggaaggaactagggagtccagagggtgtgctggtgtgtccctccattgaggagttgaagaacgtctggcttcctttctccattcgcatgaagatgaccaaaaacaaagggctggatgtttgcaattggactgatggggatgagatgcagtggggcccagccagggcagaggaggagcatggtgtctatgtgtatgacctgatggctactgtggtacacatcctggactcacgcacagggggcagcctggtggctcacatcaaagttggagagacctaccaccagcgcaaggagggcgttactcaccagcagtggtatctgttcaatgactttcttattgaacctattgataagcatgaagctgtgcagtttgacatgaattggaaagtacctgcaatcctttattatgtcaaacggaatctcaattccagatacaacctgaacatcaagaaccctattgaggcaagtgtcttgctggctgaagcctcgctggcacggaagcagcggaaaacacatactacctttattccactgatgctgaatgagatgccacagattggggacctggtgggtctggatgctgagtttgtcacccttaatgaggaggaagcagagttacgcagtgatggtaccaagtctaccattaaaccaagccagatgtcagtagccaggattacctgtgttcggggccagggacccaatgagggtatccccttcattgatgactacatctctacccaggagcaggtggtggattacttgactcaatactcgggtataaagcctggtgacctcgatgccaaaatttcctccaagcacctaacaactctcaagtctacctacttaaagcttcgttttctcattgacattggagtcaagtttgtgggtcatggcctgcagaaggacttccgggtcatcaacctgatggtgcccaaggaccaagtccttgacactgtctacctgttccatatgccccgaaaacgaatgatttccctgcgattccttgcttggtactttctggacctgaagattcaaggggaaacccatgacagtattgaggatgcccgcacagcccttcagctgtaccgaaagtatctggagctaagcaaaaatggcactgagcctgagtctttccacaaggtgctcaagggtctttatgagaagggcagaaagatggactggaaggtgcctgagcctgagggccaaacaagtcccaagaatgcagctgtcttctcctcagtgctggcgctctgactacccttcccaaagaaccacggccctctccctttactgttctatagccccagaactgggagatggcttcctaagttggctataccttgtccacttccagtactggacgtgctcagggtctagggtcacagatggtgctattaattgaactggaacacagcagaattgttgcaaaggttctaggagccagattcattccttcttcattctttgcaaaacagtggtacagacatggagtctagaattgacccagatggaaagtaattggtattcttaatatcctgggtgactaatatccaggcagagaagctcctggaaccataactgtaagttcctagctggctagggattgaagtcctggacagtgacagaggataccacagtagttcaagacttagcacaagtcaccaactgcttcagggatacctggaggggccagcaagtagagtgttggtggcccaagcaaaccagtgttgccaataccattgccaaaagggcctttggatcctggacaaagcttggctgccggcttcatttattcctgctgatggctgagaagcatctgtcttccatcccacttgcctgtcccaagttttgttccattttttaaaaatttgttgtaaactgcatgttttataaaataaaaataaaatatcgtttgttatttatctca

SEQ ID NO: 163551 - DNA, 5372 bp, Homo sapiens
  Payload ID: 12202
  Gene Symbol: PAN2
  Gene Name: PAN2 poly(A) specific ribonuclease subunit
  Uniprot ID: Q504Q3
  ENST ID: ENST00000425394
  CDS Start-End: 378-3986
agagaattctgggtaactagccgtttccgtcaccttcccctgcccccgccccaattgtgggtaactggccattattgttttcctctagagaatcctgggtagctattggagaggattctaggaaactgacttctcgttctccccaccgtccaatccacccgttttcacccccaattctgggagaaagcaccttaaatccctctacctaactccaacccccgcaattctcgctcccttcacctgatgattcagggctgaacaaggccaggatgtccattctaggcccatcggtgctgtcttgctgaaggttgggtcaggcatctaaagggactgtggtaagggagggtgtgacacaggtgtaagctgccatcgtcatcatgaactttgagggtctggaccctggactggcagaatatgccccagccatgcattctgccctggaccctgtcttggatgcccacctgaacccaagtctgctacagaatgtggagctggacccagagggagtggccttggaggctcttcccgtccaggaatcagtgcacataatggaaggtgtctactctgaattgcacagcgtggtggctgaagtgggtgtacctgtttccgtctcccactttgacttgcacgaggagatgctgtgggtggggagccacgggggccatgccacttcattttttggcccagccttggagcgctactcatcctttcaagtcaatggcagtgatgatattcggcagatccagagcctggagaatggtatcctttttctcaccaagaacaacctcaagtatatggcccgtgggggcctcattatatttgattacctgctggatgagaatgaggatatgcacagtctcctactgactgacagcagcactctactcgttggtgggctgcagaatcacataatagagattgatcttaacactgtccaggagactcagaagtatgcagtagagacgcctggagtcaccatcatgagacagacaaatcgcttcttcttctgcggccacacgtctggcaaggtttccctgagagacctccgtacttttaaggtggaacatgagtttgatgccttctcaggaagtctgtcagactttgatgtgcatggcaacctgctagctgcctgtggcttctccagccgcctcactggcctggcctgcgaccgtttcctcaaggtgtatgatttgcgcatgatgcgtgccatcacaccacttcaagtacatgtggatcctgccttcttgcgcttcattcctacatatacttctcgtcttgctatcatctctcagtcagggcagtgccaattctgtgaacccacaggcctggccaacccagccgatatctttcatgtgaatcctgtggggcctctgctaatgacatttgatgtgtcagccagcaagcaggctctggcctttggggattctgagggctgtgtgcacctctggactgattccccggagccttccttcaacccctactcccgtgagactgagtttgctttgccgtgtctcgtggactcactgcctcctctggactggagccaggacctgctgcctctttccctcatccctgtcccactcaccactgacacacttctctctgattggcctgctgccaactctgctccagctcccaggcgagcaccacccgtggatgcagagattctgcgcaccatgaagaaggtgggcttcattggctatgcgcccaatccccgcaccaggctgcgcaatcagataccctacagactcaaggagtcagacagtgaatttgacagcttcagccaggtcactgagtcaccagtaggacgagaagaggaaccacatctccacatggtttctaagaaataccgcaaggtgaccatcaaatattccaagctagggctggaggactttgacttcaaacactacaataagaccttgtttgctggattagagccccacattcccaacgcctactgtaactgcatgatccaggtgctctatttcctggagcctgtacgctgtctaattcaaaaccacctttgccagaaggagttctgtctggcatgtgagctgggcttcctgtttcacatgttggacctctctcgtggtgacccttgccagggcaataattttcttcgggcattccgtactattcctgaggcctcagccctcggtctaatcctggctgactcagatgaggcctcaggcaagggcaatctggccaggctcattcagaggtggaatcgcttcattctcactcaactgcatcaagatatgcaggagctggaaataccacaggcttatcgaggtgctggaggcagcagcttttgctcatcgggggactctgttattgggcagctcttcagctgtgagatggagaactgcagcctctgccgctgtggcagtgagaccgtgcgagcctcatccactctgcttttcacactctcctaccctgatggtagcaaaagtgataaaactgggaagaactatgactttgctcaggtgctgaagcgaagcatctgcctggaccagaatacacaggcctggtgtgacacctgtgaaaagtaccagcccacgattcagacccgcaacatccgccatctgccagatattcttgtcatcaattgtgaggtgaacagctcaaaagaggctgatttctggagaatgcaggctgaggttgccttcaagatggcagtaaagaaacacggtggggaaatctccaagaacaaggaatttgctttggctgattggaaggaactagggagtccagagggtgtgctggtgtgtccctccattgaggagttgaagaacgtctggcttcctttctccattcgcatgaagatgaccaaaaacaaagggctggatgtttgcaattggactgatggggatgagatgcagtggggcccagccagggcagaggaggagcatggtgtctatgtgtatgacctgatggctactgtggtacacatcctggactcacgcacagggggcagcctggtggctcacatcaaagttggagagacctaccaccagcgcaaggagggcgttactcaccagcagtggtatctgttcaatgactttcttattgaacctattgataagcatgaagctgtgcagtttgacatgaattggaaagtacctgcaatcctttattatgtcaaacggaatctcaattccagatacaacctgaacatcaagaaccctattgaggcaagtgtcttgctggctgaagcctcgctggcacggaagcagcggaaaacacatactacctttattccactgatgctgaatgagatgccacagattggggacctggtgggtctggatgctgagtttgtcacccttaatgaggaggaagcagagttacgcagtgatggtaccaagtctaccattaaaccaagccagatgtcagtagccaggattacctgtgttcggggccagggacccaatgagggtatccccttcattgatgactacatctctacccaggagcaggtggtggattacttgactcaatactcgggtataaagcctggtgacctcgatgccaaaatttcctccaagcacctaacaactctcaagtctacctacttaaagcttcgttttctcattgacattggagtcaagtttgtgggtcatggcctgcagaaggacttccgggtcatcaacctgatggtgcccaaggaccaagtccttgacactgtctacctgttccatatgccccgaaaacgaatgatttccctgcgattccttgcttggtactttctggacctgaagattcaaggggaaacccatgacagtattgaggatgcccgcacagcccttcagctgtaccgaaagtatctggagctaagcaaaaatggcactgagcctgagtctttccacaaggtgctcaagggtctttatgagaagggcagaaagatggactggaaggtgcctgagcctgagggccaaacaagtcccaagaatgcagctgtcttctcctcagtgctggcgctctgactacccttcccaaagaaccacggccctctccctttactgttctatagccccagaactgggagatggcttcctaagttggctataccttgtccacttccagtactggacgtgctcagggtctagggtcacagatggtgctattaattgaactggaacacagcagaattgttgcaaaggttctaggagccagattcattccttcttcattctttgcaaaacagtggtacagacatggagtctagaattgacccagatggaaagtaattggtattcttaatatcctgggtgactaatatccaggcagagaagctcctggaaccataactgtaagttcctagctggctagggattgaagtcctggacagtgacagaggataccacagtagttcaagacttagcacaagtcaccaactgcttcagggatacctggaggggccagcaagtagagtgttggtggcccaagcaaaccagtgttgccaataccattgccaaaagggcctttggatcctggacaaagcttggctgccggcttcatttattcctgctgatggctgagaagcatctgtcttccatcccacttgcctgtcccaagttttgttccattttttaaaaatttgttgtaaactgcatgttttataaaataaaaataaaatatcgtttgttatttatctcattagagaactgctagtgtgggttctctggcttcagtcttcctctccttcctttgaaggtaaaggtccggaatccaaagttatggatatgaaagggtataattaggccgggcgcggtggctcacttctgtaatcctagcactttgggaggcagaggtgggtggaacacgaggtcaggagttaaagaccagcctgaccaagatggtgaaaccccgtctctactaaaaatacaaaaattagctgggagtggtggatggcgactgtaaccctagctgaggcagaaaattgcttcaacccgggaggcggaggttgcagtgagccgagatcacgccactgtatgccagcctgggcgatagggcgagactccgtctcaaaaaaaggggaaaaaggtataatttatgccttttctgggcaatgctgggtctttgctatagctgcccagtaccctaagtcagactgaagatgtacagtatggtttccgttaattgtgtaagccgacaaactacaggtcccaggatagcttgagacttgtagttgctcacaaagatgggtccggtgctgcggtgcttcctgggagatgtagtttcctgtgtattgaaacctggactgctcgctggccggcagcgcaccgttttgaaggtcctagcccacctgggctggctcacgcgcacgactagccgctcccatacagcacgcccggactctgtcgtcgctt

SEQ ID NO: 163552 - DNA, 585 bp, Homo sapiens
  Payload ID: 12202
  Gene Symbol: PAN2
  Gene Name: PAN2 poly(A) specific ribonuclease subunit
  ENST ID: ENST00000547572
  CDS Start-End: 251-585
aggcgtgggggagaactggggaaactggaatttcccgcggagctgacagcgcttgcgctccccctactcgttctaattccacgcgctccaaaatatccgccatggagaaatcttgggccatgccacttcattttttggcccagccttggagcgctactcatcctttcaagtcaatggcagtgatgatattcggcagatccagagcctggagaatggtatcctttttctcaccaagaacaacctcaagtatatggcccgtgggggcctcattatatttgattacctgctggatgagaatgaggatatgcacagtctcctactgactgacagcagcactctactcgttggtgggctgcagaatcacataatagagattgatcttaacactgtccaggagactcagaagtatgcagtagagacgcctggagtcaccatcatgagacagacaaatcgcttcttcttctgcggccacacgtctggcaaggtttccctgagagacctccgtacttttaaggtggaacatgagtttgatgccttctcaggaagtctgtcagactttgatgtgcatggcaacctgctagctgc

SEQ ID NO: 163553 - DNA, 4641 bp, Homo sapiens
  Payload ID: 12202
  Gene Symbol: PAN2
  Gene Name: PAN2 poly(A) specific ribonuclease subunit
  Uniprot ID: Q504Q3
  ENST ID: ENST00000548043
  CDS Start-End: 371-3979
ttctgggtaactagccgtttccgtcaccttcccctgcccccgccccaattgtgggtaactggccattattgttttcctctagagaatcctgggtagctattggagaggattctaggaaactgacttctcgttctccccaccgtccaatccacccgttttcacccccaattctgggagaaagcaccttaaatccctctacctaactccaacccccgcaattctcgctcccttcacctgatgattcagggctgaacaaggcaagatgtccattctaggcccatcggtgctgtcttgctgaaggttgggtcaggcatctaaagggactgtggtaagggagggtgtgacacaggtgtaagctgccatcgtcatcatgaactttgagggtctggaccctggactggcagaatatgccccagccatgcattctgccctggaccctgtcttggatgcccacctgaacccaagtctgctacagaatgtggagctggacccagagggagtggccttggaggctcttcccgtccaggaatcagtgcacataatggaaggtgtctactctgaattgcacagcgtggtggctgaagtgggtgtacctgtttccgtctcccactttgacttgcacgaggagatgctgtgggtggggagccacgggggccatgccacttcattttttggcccagccttggagcgctactcatcctttcaagtcaatggcagtgatgatattcggcagatccagagcctggagaatggtatcctttttctcaccaagaacaacctcaagtatatggcccgtgggggcctcattatatttgattacctgctggatgagaatgaggatatgcacagtctcctactgactgacagcagcactctactcgttggtgggctgcagaatcacataatagagattgatcttaacactgtccaggagactcagaagtatgcagtagagacgcctggagtcaccatcatgagacagacaaatcgcttcttcttctgcggccacacgtctggcaaggtttccctgagagacctccgtacttttaaggtggaacatgagtttgatgccttctcaggaagtctgtcagactttgatgtgcatggcaacctgctagctgcctgtggcttctccagccgcctcactggcctggcctgcgaccgtttcctcaaggtgtatgatttgcgcatgatgcgtgccatcacaccacttcaagtacatgtggatcctgccttcttgcgcttcattcctacatatacttctcgtcttgctatcatctctcagtcagggcagtgccaattctgtgaacccacaggcctggccaacccagccgatatctttcatgtgaatcctgtggggcctctgctaatgacatttgatgtgtcagccagcaagcaggctctggcctttggggattctgagggctgtgtgcacctctggactgattccccggagccttccttcaacccctactcccgtgagactgagtttgctttgccgtgtctcgtggactcactgcctcctctggactggagccaggacctgctgcctctttccctcatccctgtcccactcaccactgacacacttctctctgattggcctgctgccaactctgctccagctcccaggcgagcaccacccgtggatgcagagattctgcgcaccatgaagaaggtgggcttcattggctatgcgcccaatccccgcaccaggctgcgcaatcagataccctacagactcaaggagtcagacagtgaatttgacagcttcagccaggtcactgagtcaccagtaggacgagaagaggaaccacatctccacatggtttctaagaaataccgcaaggtgaccatcaaatattccaagctagggctggaggactttgacttcaaacactacaataagaccttgtttgctggattagagccccacattcccaacgcctactgtaactgcatgatccaggtgctctatttcctggagcctgtacgctgtctaattcaaaaccacctttgccagaaggagttctgtctggcatgtgagctgggcttcctgtttcacatgttggacctctctcgtggtgacccttgccagggcaataattttcttcgggcattccgtactattcctgaggcctcagccctcggtctaatcctggctgactcagatgaggcctcaggcaagggcaatctggccaggctcattcagaggtggaatcgcttcattctcactcaactgcatcaagatatgcaggagctggaaataccacaggcttatcgaggtgctggaggcagcagcttttgctcatcgggggactctgttattgggcagctcttcagctgtgagatggagaactgcagcctctgccgctgtggcagtgagaccgtgcgagcctcatccactctgcttttcacactctcctaccctgatggtagcaaaagtgataaaactgggaagaactatgactttgctcaggtgctgaagcgaagcatctgcctggaccagaatacacaggcctggtgtgacacctgtgaaaagtaccagcccacgattcagacccgcaacatccgccatctgccagatattcttgtcatcaattgtgaggtgaacagctcaaaagaggctgatttctggagaatgcaggctgaggttgccttcaagatggcagtaaagaaacacggtggggaaatctccaagaacaaggaatttgctttggctgattggaaggaactagggagtccagagggtgtgctggtgtgtccctccattgaggagttgaagaacgtctggcttcctttctccattcgcatgaagatgaccaaaaacaaagggctggatgtttgcaattggactgatggggatgagatgcagtggggcccagccagggcagaggaggagcatggtgtctatgtgtatgacctgatggctactgtggtacacatcctggactcacgcacagggggcagcctggtggctcacatcaaagttggagagacctaccaccagcgcaaggagggcgttactcaccagcagtggtatctgttcaatgactttcttattgaacctattgataagcatgaagctgtgcagtttgacatgaattggaaagtacctgcaatcctttattatgtcaaacggaatctcaattccagatacaacctgaacatcaagaaccctattgaggcaagtgtcttgctggctgaagcctcgctggcacggaagcagcggaaaacacatactacctttattccactgatgctgaatgagatgccacagattggggacctggtgggtctggatgctgagtttgtcacccttaatgaggaggaagcagagttacgcagtgatggtaccaagtctaccattaaaccaagccagatgtcagtagccaggattacctgtgttcggggccagggacccaatgagggtatccccttcattgatgactacatctctacccaggagcaggtggtggattacttgactcaatactcgggtataaagcctggtgacctcgatgccaaaatttcctccaagcacctaacaactctcaagtctacctacttaaagcttcgttttctcattgacattggagtcaagtttgtgggtcatggcctgcagaaggacttccgggtcatcaacctgatggtgcccaaggaccaagtccttgacactgtctacctgttccatatgccccgaaaacgaatgatttccctgcgattccttgcttggtactttctggacctgaagattcaaggggaaacccatgacagtattgaggatgcccgcacagcccttcagctgtaccgaaagtatctggagctaagcaaaaatggcactgagcctgagtctttccacaaggtgctcaagggtctttatgagaagggcagaaagatggactggaaggtgcctgagcctgagggccaaacaagtcccaagaatgcagctgtcttctcctcagtgctggcgctctgactacccttcccaaagaaccacggccctctccctttactgttctatagccccagaactgggagatggcttcctaagttggctataccttgtccacttccagtactggacgtgctcagggtctagggtcacagatggtgctattaattgaactggaacacagcagaattgttgcaaaggttctaggagccagattcattccttcttcattctttgcaaaacagtggtacagacatggagtctagaattgacccagatggaaagtaattggtattcttaatatcctgggtgactaatatccaggcagagaagctcctggaaccataactgtaagttcctagctggctagggattgaagtcctggacagtgacagaggataccacagtagttcaagacttagcacaagtcaccaactgcttcagggatacctggaggggccagcaagtagagtgttggtggcccaagcaaaccagtgttgccaataccattgccaaaagggcctttggatcctggacaaagcttggctgccggcttcatttattcctgctgatggctgagaagcatctgtcttccatcccacttgcctgtcccaagttttgttccattttttaaaaatttgttgtaaactgcatgttttataaaataaaaataaaatatcgtttgt

SEQ ID NO: 163554 - DNA, 5301 bp, Homo sapiens
  Payload ID: 12202
  Gene Symbol: PAN2
  Gene Name: PAN2 poly(A) specific ribonuclease subunit
  Uniprot ID: Q504Q3
  ENST ID: ENST00000610546
  CDS Start-End: 307-3915
atgccccgagcccttcttgattggaagaagcgcctcggaccccggtccttggcgccgtagtggttaggttgagccctaggcgtgggggagaactggggaaactggaatttcccgcggagctgacagcgcttgcgctccccctactcgttctaattccacgcgctccaaaatatccgccatggagaaatcttggccaggatgtccattctaggcccatcggtgctgtcttgctgaaggttgggtcaggcatctaaagggactgtggtaagggagggtgtgacacaggtgtaagctgccatcgtcatcatgaactttgagggtctggaccctggactggcagaatatgccccagccatgcattctgccctggaccctgtcttggatgcccacctgaacccaagtctgctacagaatgtggagctggacccagagggagtggccttggaggctcttcccgtccaggaatcagtgcacataatggaaggtgtctactctgaattgcacagcgtggtggctgaagtgggtgtacctgtttccgtctcccactttgacttgcacgaggagatgctgtgggtggggagccacgggggccatgccacttcattttttggcccagccttggagcgctactcatcctttcaagtcaatggcagtgatgatattcggcagatccagagcctggagaatggtatcctttttctcaccaagaacaacctcaagtatatggcccgtgggggcctcattatatttgattacctgctggatgagaatgaggatatgcacagtctcctactgactgacagcagcactctactcgttggtgggctgcagaatcacataatagagattgatcttaacactgtccaggagactcagaagtatgcagtagagacgcctggagtcaccatcatgagacagacaaatcgcttcttcttctgcggccacacgtctggcaaggtttccctgagagacctccgtacttttaaggtggaacatgagtttgatgccttctcaggaagtctgtcagactttgatgtgcatggcaacctgctagctgcctgtggcttctccagccgcctcactggcctggcctgcgaccgtttcctcaaggtgtatgatttgcgcatgatgcgtgccatcacaccacttcaagtacatgtggatcctgccttcttgcgcttcattcctacatatacttctcgtcttgctatcatctctcagtcagggcagtgccaattctgtgaacccacaggcctggccaacccagccgatatctttcatgtgaatcctgtggggcctctgctaatgacatttgatgtgtcagccagcaagcaggctctggcctttggggattctgagggctgtgtgcacctctggactgattccccggagccttccttcaacccctactcccgtgagactgagtttgctttgccgtgtctcgtggactcactgcctcctctggactggagccaggacctgctgcctctttccctcatccctgtcccactcaccactgacacacttctctctgattggcctgctgccaactctgctccagctcccaggcgagcaccacccgtggatgcagagattctgcgcaccatgaagaaggtgggcttcattggctatgcgcccaatccccgcaccaggctgcgcaatcagataccctacagactcaaggagtcagacagtgaatttgacagcttcagccaggtcactgagtcaccagtaggacgagaagaggaaccacatctccacatggtttctaagaaataccgcaaggtgaccatcaaatattccaagctagggctggaggactttgacttcaaacactacaataagaccttgtttgctggattagagccccacattcccaacgcctactgtaactgcatgatccaggtgctctatttcctggagcctgtacgctgtctaattcaaaaccacctttgccagaaggagttctgtctggcatgtgagctgggcttcctgtttcacatgttggacctctctcgtggtgacccttgccagggcaataattttcttcgggcattccgtactattcctgaggcctcagccctcggtctaatcctggctgactcagatgaggcctcaggcaagggcaatctggccaggctcattcagaggtggaatcgcttcattctcactcaactgcatcaagatatgcaggagctggaaataccacaggcttatcgaggtgctggaggcagcagcttttgctcatcgggggactctgttattgggcagctcttcagctgtgagatggagaactgcagcctctgccgctgtggcagtgagaccgtgcgagcctcatccactctgcttttcacactctcctaccctgatggtagcaaaagtgataaaactgggaagaactatgactttgctcaggtgctgaagcgaagcatctgcctggaccagaatacacaggcctggtgtgacacctgtgaaaagtaccagcccacgattcagacccgcaacatccgccatctgccagatattcttgtcatcaattgtgaggtgaacagctcaaaagaggctgatttctggagaatgcaggctgaggttgccttcaagatggcagtaaagaaacacggtggggaaatctccaagaacaaggaatttgctttggctgattggaaggaactagggagtccagagggtgtgctggtgtgtccctccattgaggagttgaagaacgtctggcttcctttctccattcgcatgaagatgaccaaaaacaaagggctggatgtttgcaattggactgatggggatgagatgcagtggggcccagccagggcagaggaggagcatggtgtctatgtgtatgacctgatggctactgtggtacacatcctggactcacgcacagggggcagcctggtggctcacatcaaagttggagagacctaccaccagcgcaaggagggcgttactcaccagcagtggtatctgttcaatgactttcttattgaacctattgataagcatgaagctgtgcagtttgacatgaattggaaagtacctgcaatcctttattatgtcaaacggaatctcaattccagatacaacctgaacatcaagaaccctattgaggcaagtgtcttgctggctgaagcctcgctggcacggaagcagcggaaaacacatactacctttattccactgatgctgaatgagatgccacagattggggacctggtgggtctggatgctgagtttgtcacccttaatgaggaggaagcagagttacgcagtgatggtaccaagtctaccattaaaccaagccagatgtcagtagccaggattacctgtgttcggggccagggacccaatgagggtatccccttcattgatgactacatctctacccaggagcaggtggtggattacttgactcaatactcgggtataaagcctggtgacctcgatgccaaaatttcctccaagcacctaacaactctcaagtctacctacttaaagcttcgttttctcattgacattggagtcaagtttgtgggtcatggcctgcagaaggacttccgggtcatcaacctgatggtgcccaaggaccaagtccttgacactgtctacctgttccatatgccccgaaaacgaatgatttccctgcgattccttgcttggtactttctggacctgaagattcaaggggaaacccatgacagtattgaggatgcccgcacagcccttcagctgtaccgaaagtatctggagctaagcaaaaatggcactgagcctgagtctttccacaaggtgctcaagggtctttatgagaagggcagaaagatggactggaaggtgcctgagcctgagggccaaacaagtcccaagaatgcagctgtcttctcctcagtgctggcgctctgactacccttcccaaagaaccacggccctctccctttactgttctatagccccagaactgggagatggcttcctaagttggctataccttgtccacttccagtactggacgtgctcagggtctagggtcacagatggtgctattaattgaactggaacacagcagaattgttgcaaaggttctaggagccagattcattccttcttcattctttgcaaaacagtggtacagacatggagtctagaattgacccagatggaaagtaattggtattcttaatatcctgggtgactaatatccaggcagagaagctcctggaaccataactgtaagttcctagctggctagggattgaagtcctggacagtgacagaggataccacagtagttcaagacttagcacaagtcaccaactgcttcagggatacctggaggggccagcaagtagagtgttggtggcccaagcaaaccagtgttgccaataccattgccaaaagggcctttggatcctggacaaagcttggctgccggcttcatttattcctgctgatggctgagaagcatctgtcttccatcccacttgcctgtcccaagttttgttccattttttaaaaatttgttgtaaactgcatgttttataaaataaaaataaaatatcgtttgttatttatctcattagagaactgctagtgtgggttctctggcttcagtcttcctctccttcctttgaaggtaaaggtccggaatccaaagttatggatatgaaagggtataattaggccgggcgcggtggctcacttctgtaatcctagcactttgggaggcagaggtgggtggaacacgaggtcaggagttaaagaccagcctgaccaagatggtgaaaccccgtctctactaaaaatacaaaaattagctgggagtggtggatggcgactgtaaccctagctgaggcagaaaattgcttcaacccgggaggcggaggttgcagtgagccgagatcacgccactgtatgccagcctgggcgatagggcgagactccgtctcaaaaaaaggggaaaaaggtataatttatgccttttctgggcaatgctgggtctttgctatagctgcccagtaccctaagtcagactgaagatgtacagtatggtttccgttaattgtgtaagccgacaaactacaggtcccaggatagcttgagacttgtagttgctcacaaagatgggtccggtgctgcggtgcttcctgggagatgtagtttcctgtgtattgaaacctggactgctcgctggccggcagcgcaccgttttgaaggtcctagcccacctgggctggctcacgcgcacgactagccgctcccatacagcacgcccggactctgtcgtcgctt

SEQ ID NO: 163555 - DNA, 2833 bp, Homo sapiens
  Payload ID: 12203
  Gene Symbol: PAN3
  Gene Name: PAN3 poly(A) specific ribonuclease subunit
  Uniprot ID: Q58A45
  ENST ID: ENST00000380958
  CDS Start-End: 153-2816
ctccccgggcggctccggctcccgcagcgggacagacccacccgcccaggcttttatccggcaccggcagcgtcttcctttcctcccccgtctatggtggtggcggcggcggctcctcgggcggcggcggaagacgaggctgcggcgttgccatgaacagtggcggcggcctcccgcccccctcggccgccgcctccccttcctcctcctcgctggcggcggcggtggcggtggtggccccgccgggggtcgggggtgtccccggcggggcggcggtaggagtgaagctgaagtactgccgctactacgctaaggataagacttgcttctacggggaggagtgtcagttcctgcatgaggaccctgccgccggggctgccccgggcctcggcctccatagcaacagcgtccccctggctctggctggtgcacccgtggccggctttccgccgggagccgtcgcgggcgggggagctgggccgccccccgggcccaagaagccggacctgggggacccggggaccggagccgcagccggcggaggaggcagtagcgggggactcgatggaccgcggctggcaattccaggaatggatggaggtgctttaactgatacaagtctcacagattcctattttagcaccagctttattggagtcaatggatttggaagccctgtagaaacaaaatatcccctgatgcagagaatgactaatagtagcagctccccaagccttctaaatgacagtgccaagccatattcagcccatgatcctctaacatcacctgcttcatccttgtttaatgactttggtgccctcaacatctctcagagacgaaagccaaggaagtatcgcctggggatgctggaggagaggctagttccgatgggatcaaaggcacgaaaagcaaagaaccctattggctgccttgctgacaggtgtaaatcaggagtacccatcaatatggtttggtggaacagagtcacagaaaacaatttacagacaccaaatcctactgcaagcgagtttattcctaaaggaggatcaacctccaggctgagtaacgtgtcccagtcaaatatgtctgccttctctcaagttttctctcacccatccatgggaagccctgctactgctggattagcgccaggaatgtcgttgtctgctgggtcttcccctcttcattcccccaagattactccacatacttctcctgctcccagaagaagaagtcacactccaaatccagcaagttacatggtgccttctagtgcctctacatctgttaataatcctgtttctcagactccgtcttctggtcaggtgatccaaaaggaaactgttggtgggacgacttacttctatacagacacaactccagcacctttgactggaatggtgtttccaaactatcatatttatcctccaactgcacctcacgttgcttatatgcaaccgaaagcaaacgcaccttccttcttcatggctgatgaactccgacaggagctgatcaacagacatttaataacaatggctcaaattgatcaagcagatatgccagcagttcctacagaggttgacagctaccatagcctattccctctagaaccactgccacctcccaaccggatacagaaatcaagtaattttggatatattacatcttgctacaaagctgtaaacagcaaagatgatctgccatattgccttcggaggatacatggttttcgtcttgttaacacaaagtgcatggtgttggtcgacatgtggaagaaaattcaacactcaaatatcgtaactttgcgtgaagtatttaccactaaagcatttgctgagccctctcttgtgtttgcatatgatttccatgctggaggagaaactatgatgagcagacactttaatgaccctaatgctgatgcctacttcaccaagagaaagtggggtcagcacgagggaccattgcccaggcagcatgctggattattgccagaatctcttatttgggcatatattgtccaactaagttctgcattgcgtaccattcatacagcaggtttggcatgtcgagttatggatccaacaaagattctgataactggcaaaacaaggttgcgagtaaattgtgttggagtttttgatgttttaacatttgataacagtcaaaataataatccattggcattaatggcccagtaccagcaagcagatctgatatcattaggaaaagttgtgttggctttggcttgcaactctttggcaggaattcagcgagagaatttacagaaagccatggaactggtgacaatcaactattcctctgacctgaagaatctgattttgtatttgttgactgaccaaaacaggatgcgaagtgtaaatgacatcatgcccatgattggtgctcgattttatactcaattggatgctgctcaaatgagaaatgatgtcatagaggaagaccttgcaaaggaggttcaaaatggaagactgtttaggctcctagcaaaattgggaacaatcaatgagaggccggagtttcagaaggatcccacttggtcagagactggagaccgttatctgttgaaactctttagggatcatctttttcatcaggtgacagaagcaggtgctccctggattgacctcagtcatataatttcttgtcttaacaagctagatgctggtgtgccagaaaaaataagcctgatttccagagatgagaagagtgtacttgtggtgacctacagtgacttaaagcgctgctttgaaaatacttttcaagaactgattgcagctgcaaatggtcagttgtagtatttgctaaaaaagca

SEQ ID NO: 163556 - DNA, 4940 bp, Homo sapiens
  Payload ID: 12203
  Gene Symbol: PAN3
  Gene Name: PAN3 poly(A) specific ribonuclease subunit
  ENST ID: ENST00000399613
  CDS Start-End: 64-2127
gccgcagccggcggaggaggcagtagcgggggactcgatggaccgcggctggcaattccaggaatggatggaggtgctttaactgatacaagtctcacagattcctattttagcaccagctttattggagtcaatggatttggaagccctgtagaaacaaaatatcccctgatgcagagaatgactaatagtagcagctccccaagccttctaaatgacagtgccaagccatattcagcccatgatcctctaacatcacctgcttcatccttgtttaatgactttggtgccctcaacatctctcagagacgaaagacaccaaatcctactgcaagcgagtttattcctaaaggaggatcaacctccaggctgagtaacgtgtcccagtcaaatatgtctgccttctctcaagttttctctcacccatccatgggaagccctgctactgctggattagcgccaggaatgtcgttgtctgctgggtcttcccctcttcattcccccaagattactccacatacttctcctgctcccagaagaagaagtcacactccaaatccagcaagttacatggtgccttctagtgcctctacatctgttaataatcctgtttctcagactccgtcttctggtcaggtgatccaaaaggaaactgttggtgggacgacttacttctatacagacacaactccagcacctttgactggaatggtgtttccaaactatcatatttatcctccaactgcacctcacgttgcttatatgcaaccgaaagcaaacgcaccttccttcttcatggctgatgaactccgacaggagctgatcaacagacatttaataacaatggctcaaattgatcaagcagatatgccagcagttcctacagaggttgacagctaccatagcctattccctctagaaccactgccacctcccaaccggatacagaaatcaagtaattttggatatattacatcttgctacaaagctgtaaacagcaaagatgatctgccatattgccttcggaggatacatggttttcgtcttgttaacacaaagtgcatggtgttggtcgacatgtggaagaaaattcaacactcaaatatcgtaactttgcgtgaagtatttaccactaaagcatttgctgagccctctcttgtgtttgcatatgatttccatgctggaggagaaactatgatgagcagacactttaatgaccctaatgctgatgcctacttcaccaagagaaagtggggtcagcacgagggaccattgcccaggcagcatgctggattattgccagaatctcttatttgggcatatattgtccaactaagttctgcattgcgtaccattcatacagcaggtttggcatgtcgagttatggatccaacaaagattctgataactggcaaaacaaggttgcgagtaaattgtgttggagtttttgatgttttaacatttgataacagtcaaaataataatccattggcattaatggcccagtaccagcaagcagatctgatatcattaggaaaagttgtgttggctttggcttgcaactctttggcaggaattcagcgagagaatttacagaaagccatggaactggtgacaatcaactattcctctgacctgaagaatctgattttgtatttgttgactgaccaaaacaggatgcgaagtgtaaatgacatcatgcccatgattggtgctcgattttatactcaattggatgctgctcaaatgagaaatgatgtcatagaggaagaccttgcaaaggaggttcaaaatggaagactgtttaggctcctagcaaaattgggaacaatcaatgagaggccggagtttcagaaggatcccacttggtcagagactggagaccgttatctgttgaaactctttagggatcatctttttcatcaggtgacagaagcaggtgctccctggattgacctcagtcatataatttcttgtcttaacaagctagatgctggtgtgccagaaaaaataagcctgatttccagagatgagaagagtgtacttgtggtgacctacagtgacttaaagcgctgctttgaaaatacttttcaagaactgattgcagctgcaaatggtcagttgtagtatttgctaaaaaagcacgcaggacatggctaaagaccttaaccaatagcaaattgcactacagctgaacttttcatcatctcattcacatttgggaaacgaacaggagatgagcaaagctgcttgcacttcagtcaggtacactgttacttgaaaggaagaatgtttcacttacccaagagctatggctgccattggaggctgttatctgtgaagaatttattttagatttaggagcaccatcaggtgaatgatgttcctgcttttgttttttccacttgtatatgcactaattttaattttttaaagactttttctgatctttgaacttttgccacattgtatacttataatgggaaactttgcaaggacatttttgggaagcaatgctgggcagcgtttttgccattgagggttgcagaatttgctctttttgggatgggttgccctgaataacattacggaccaggtaaataatttcatagaagttcagtatagtacgtaattcttgtaagagtatcgtatgcaagctctctgtatgccacccactgttagttcaaattgagatttttgttttgttttgttcttaagaacataccaagaaaataccagtgaattgttggatatgaattccctgttagttgatttaaatcctttctgaataaagatcagataaacagtaactgaaggagcatgtatagctctttccttcaaattcaactagagcctttttaaaaagacatttgcctgctagtcagatacatttacatttatgcaaattttttaaataggagaaaattaagaaattgtgttaaaggcctaaagttcaggagtgtattactttaggttctttccagtttgctggtttttttttttttttttttttttttttttgggcgggggggaggtttatgaagttttgctctttgaaccacagctttattatggtcctttacactggagacagacacagagacactgttcagaagatgaactaaactcagcagtggtctggtatcaagagctttctgatgttttacagcctgaatttggagggataacgatctgctgtgcctttgcagtcactgcttagcccaaagtaatagtacttttgataataactcactctgtgcgatattcctgaataagtccatctcaaaagtttgggattttcctcctcttaactttcttaatatttggacatgcagttgtcgccaaacttgggtattcatggaatttctagtaaatgaaatacctatactttgatactgaagactgccaaatacataggaattttctttcttaaaaaacagtaatgaagactatatctcctttcccagcactgaatgttttactagcactgggtgctcaccatgcaactgaagaaaatgtggaaactcaaaaggtcaggacagacttccaagcacttgcaactgatgttactgtcttcaattttaataattacacatatttgtatatttcagagaagtttttaatatttctctgtccactttttataagctttaaaatgattttctctgccttgagatttgcatcaagaaaaagcacctctcttcacctgaaagctttgaagactagagacacgctttacacgttttaacaagtatattgagtccacgtttggtagcatcagttgttgagttaaaaagaaaattattgcatttgatctggatggattttaaaagaatataatgttcaatattaaaaggataattcacatttgccaccataatgttcttttttatgtaaaaagaagaacttggagacattaacatgaaaaagtcttttatcattagctcatgtatttgaggaagagcagctgtctttttatatgttttttgacaaatcatattgtattcttttgtacaaaaaagaactacttgtattctagaagaaatatgaaatgcttaatttataagcgggctggagattttttccaatattgttttctttgaaaatgaaaggggatcatctattttagttttggggtctgggaactttttgaaaatttaatttgtggaccaatgttttgtgaaagctaaagagggcaggggttaaaatagggcttgaatttctcattctgtatagaccagcaaacttccctgtgcaaggcaagtttacatcacaaatccaagaatgtttgcatcctaaatgctagtttgcttcagcccctagttaacctcaggacttggtttgcatataaaaggtagacagctgatatgttttcatgaataaatattgtcagccagaaaaggttggtgtcaggtaatgcatatttttttaagctttgttttatatttatttttcatttagtttttattgggaatggttttcaaagaactctcagttctgcctaggtgtttttgggggagccctgttttccatagtgtaattccatttaagaggttgtctaaaagtctttttaattaatagaaagattttaatatccaagagtagtcaaattaaggatataaactttccacaccttcctgtcgtgacagataaaagcacagaaaggacaacccttgaaatcatgtaacgttggtcatttcaatattttgtacctgttttaaattctgttagtgtatttacttcattgtaaatatttttgagggtacctttgtattttgcttttgaccttggttctgtgatttggatgtcaacaacttccctaaaaagcaccagtgtgttaggttctaatgtcatgacccaatttgtgttattcatctttaatcctgttttcagtctctatgtgtacagcagtatttttaataaagaattacagagataaa

SEQ ID NO: 163557 - DNA, 1537 bp, Homo sapiens
  Payload ID: 12204
  Gene Symbol: PTF1A
  Gene Name: pancreas specific transcription factor, 1a
  Uniprot ID: Q7RTS3
  ENST ID: ENST00000376504
  CDS Start-End: 205-1191
cagccctccccagcgcagcgcgagcgcgggccagagcgcagcggccgcgggcactccagggaggcccgggggcgggcagcccggcggccgcctagctgcccccagccagggccccgggagggaggggctcggacgggccttagaaactcaccaagaactaacacgcgcagcccggcagtcccgctgcccactgcggcggcgagcatggacgcggtgttgctggagcacttccccgggggcctagacgcctttccttcttcgtacttcgacgaggacgacttcttcaccgaccagtcttcacgggaccccctggaggacggcgatgagctgctggcggacgagcaggccgaggtggagttccttagccaccagctccacgagtactgctaccgcgacggggcgtgcctgctgctgcagcccgcgcccccggccgccccgctagcgctcgccccgccgtcctcggggggcctcggtgagccagacgacggcggcggcggcggctactgctgcgagacgggggcgcccccaggcggcttcccctactcgcccggctcgccgccctcgtgcctggcctacccgtgcgccggggcggcagtactgtctcccggggcgcggctgcgcggcctgagcggagcggcggctgcggcggcgcggcgccggcggcgggtgcgctccgaggcggagctgcagcagctgcggcaggcggccaacgtgcgcgagcggcggcgcatgcagtccatcaacgacgccttcgaggggctgcgctcgcacatccccacgctgccctacgagaagcgcctctccaaggtggacacgctgcgcctggccatcggctacatcaacttcctcagcgagctcgtgcaggccgacctgcccttgcgcggcggtggcgcgggcggctgcggggggccgggcggcggcgggcgcctgggcggggacagcccgggcagccaggcccagaaggtcatcatctgccatcggggcacccggtccccctcccccagcgaccctgattatggcctccctcccctagcaggacactctctctcatggactgatgaaaaacaactcaaggaacaaaatattatccgaacagccaaagtctggaccccagaggaccccagaaaactcaacagcaaatcttccttcaacaacatagaaaacgaaccaccatttgagtttgtgtcctgagaagtcccagactcggctgaagatctgattatgtctctgtgcatattgtacatgtaaatatctataatgtaaatgtaatttaagaatcaaatttttcgaatggcaatcaactgtttattatttatctatttattatcctgttgagttgatgaaatagatgatttctttttaaatatataatttatataacttatcctgattttctgaaaatatgcaatagcctatgattttcctgaactctgtgttgttgggagaactctggccagaaaacgtcctgcttatttattgccagatatggtttatttctaagcgttgtcaataaatgctatttacaccttttcctgaa

SEQ ID NO: 163558 - DNA, 2501 bp, Homo sapiens
  Payload ID: 12205
  Gene Symbol: PDX1
  Gene Name: pancreatic and duodenal homeobox 1
  Uniprot ID: P52945
  ENST ID: ENST00000381033
  CDS Start-End: 120-971
aaagcgagcaggggtggcgccgggagtgggaacgccacacagtgccaaatccccggctccagctcccgactcccggctcccggctcccggctcccggtgcccaatcccgggccgcagccatgaacggcgaggagcagtactacgcggccacgcagctttacaaggacccatgcgcgttccagcgaggcccggcgccggagttcagcgccagcccccctgcgtgcctgtacatgggccgccagcccccgccgccgccgccgcacccgttccctggcgccctgggcgcgctggagcagggcagccccccggacatctccccgtacgaggtgccccccctcgccgacgaccccgcggtggcgcaccttcaccaccacctcccggctcagctcgcgctcccccacccgcccgccgggcccttcccggagggagccgagccgggcgtcctggaggagcccaaccgcgtccagctgcctttcccatggatgaagtctaccaaagctcacgcgtggaaaggccagtgggcaggcggcgcctacgctgcggagccggaggagaacaagcggacgcgcacggcctacacgcgcgcacagctgctagagctggagaaggagttcctattcaacaagtacatctcacggccgcgccgggtggagctggctgtcatgttgaacttgaccgagagacacatcaagatctggttccaaaaccgccgcatgaagtggaaaaaggaggaggacaagaagcgcggcggcgggacagctgtcgggggtggcggggtcgcggagcctgagcaggactgcgccgtgacctccggcgaggagcttctggcgctgccgccgccgccgccccccggaggtgctgtgccgcccgctgcccccgttgccgcccgagagggccgcctgccgcctggccttagcgcgtcgccacagccctccagcgtcgcgcctcggcggccgcaggaaccacgatgagaggcaggagctgctcctggctgaggggcttcaaccactcgccgaggaggagcagagggcctaggaggaccccgggcgtggaccacccgccctggcagttgaatggggcggcaattgcggggcccaccttagaccgaaggggaaaacccgctctctcaggcgcatgtgccagttggggccccgcgggtagatgccggcaggccttccggaagaaaaagagccattggtttttgtagtattggggccctcttttagtgatactggattggcgttgtttgtggctgttgcgcacatccctgccctcctacagcactccaccttgggacctgtttagagaagccggctcttcaaagacaatggaaactgtaccatacacattggaaggctccctaacacacacagcggggaagctgggccgagtaccttaatctgccataaagccattcttactcgggcgacccctttaagtttagaaataattgaaaggaaatgtttgagttttcaaagatcccgtgaaattgatgccagtggaatacagtgagtcctcctcttcctcctcctcctcttccccctccccttcctcctcctcctcttcttttccctcctcttcctcttcctcctgctctcctttcctccccctcctcttttccctcctcttcctcttcctcctgctctcctttcctccccctcctctttctcctcctcctcctcttcttccccctcctctccctcctcctcttcttccccctcctctccctcctcctcttcttctccctcctcttcctcttcctcctcttccacgtgctctcctttcctccccctcctcttgctccccttcttccccgtcctcttcctcctcctcctcttcttctccctcctcttcctcctcctctttcttcctgacctctttctttctcctcctcctccttctacctccccttctcatccctcctcttcctcttctctagctgcacacttcactactgcacatcttataacttgcacccctttcttctgaggaagagaacatcttgcaaggcagggcgagcagcggcagggctggcttaggagcagtgcaagagtccctgtgctccagttccacactgctggcagggaaggcaaggggggacgggcctggatctgggggtgagggagaaagatggacccctgggtgaccactaaaccaaagatattcggaactttctatttaggatgtggacgtaattcctgttccgaggtagaggctgtgctgaagacaagcacagtggcctggtgcgccttggaaaccaacaactattcacgagccagtatgaccttcacatctttagaaattatgaaaacgtatgtgattggagggtttggaaaaccagttatcttatttaacattttaaaaattacctaacagttatttacaaacaggtctgtgcatcccaggtctgtcttcttttcaaggtctgggccttgtgctcgggttatgtttgtgggaaatgcttaataaatactgataatatgggaagagatgaaaactga

SEQ ID NO: 163559 - DNA, 1483 bp, Homo sapiens
  Payload ID: 12206
  Gene Symbol: PNLIP
  Gene Name: pancreatic lipase
  Uniprot ID: P16233
  ENST ID: ENST00000369221
  CDS Start-End: 29-1426
gcgtgtggaacctgacggaactgccacgatgctgccactttggactctttcactgctgctgggagcagtagcaggaaaagaagtttgctacgaaagactcggctgcttcagtgatgactccccatggtcaggaattacggaaagacccctccatatattgccttggtctccaaaagatgtcaacacccgcttcctcctatatactaatgagaacccaaacaactttcaagaagttgccgcagattcatcaagcatcagtggctccaatttcaaaacaaatagaaaaactcgctttattattcatggattcatagacaagggagaagaaaactggctggccaatgtgtgcaagaatctgttcaaggtggaaagtgtgaactgtatctgtgtggactggaaaggtggctcccgaactggatacacacaagcctcgcagaacatcaggatcgtgggagcagaagtggcatattttgttgaatttcttcagtcggcgttcggttactcaccttccaatgtgcatgtcattggccacagcctgggtgcccacgctgctggggaggctggaaggagaaccaatgggaccattggacgcatcacagggttggacccagcagaaccttgctttcagggcacacctgaattagtccgattggaccccagcgatgccaaatttgtggatgtaattcacacggatggtgcccccatagtccccaatttggggtttggaatgagccaagtcgtgggccacctagatttctttccaaatggaggagtggaaatgcctggatgtaaaaagaacattctctctcagattgtggacatagacggaatctgggaagggactcgagactttgcggcctgtaatcacttaagaagctacaaatattacactgatagcatcgtcaaccctgatggctttgctggattcccctgtgcctcttacaacgtcttcactgcaaacaagtgtttcccttgtccaagtggaggctgcccacagatgggtcactatgctgatagatatcctgggaaaacaaatgatgtgggccagaaattttatctagacactggtgatgccagtaattttgcacgttggaggtataaggtatctgtcacactgtctggaaaaaaggttacaggacacatactagtttctttgttcggaaataaaggaaactctaagcagtatgaaattttcaagggcactctcaaaccagatagtactcattccaatgaatttgactcagatgtggatgttggggacttgcagatggttaaatttatttggtataacaatgtgatcaacccaactttacctagagtgggagcatccaagattatagtggagacaaatgttggaaaacagttcaacttctgtagtccagaaaccgtcagggaggaagttctgctcaccctcacaccgtgttaggagactactgttatttgaccaatgaattgacttctaataaaatctagtggtgatgca

SEQ ID NO: 163560 - DNA, 1497 bp, Homo sapiens
  Payload ID: 12207
  Gene Symbol: PNLIPRP1
  Gene Name: pancreatic lipase-related protein 1
  Uniprot ID: P54315
  ENST ID: ENST00000358834
  CDS Start-End: 35-1438
ccggtgggagggaacatctggaacattagacaggatgctgatcttctggacaatcacacttttcctgctgggagcagccaaaggaaaagaagtttgctatgaggacctcgggtgcttttctgacactgagccctggggcgggacagcaatcaggcccctgaaaattctcccctggagccctgagaagatcggcacccgcttcctgctgtacaccaatgaaaacccaaacaactttcaaattctcctcctctctgatccatcaacaattgaggcatcaaattttcaaatggacagaaagacccggttcatcatccatggcttcatagacaaaggagatgagagctgggtgacagacatgtgcaagaaactgttcgaggtggaggaggtgaactgcatctgcgtggactggaagaagggctcccaagccacctacacacaggctgccaacaacgtgcgagtggtgggcgcccaggtggcccagatgctcgacatcctcttgacagagtatagctaccccccttccaaagttcacctcattggccacagcctgggagcccacgtggctggagaggcaggaagcaagactccaggcctgagcaggattacagggttggatcctgtagaagcaagtttcgagagtactcctgaagaggtgcgacttgatccctctgatgctgactttgttgatgtgattcacacggatgcagctcccctgatcccattcttgggttttggaacgaaccaacagatgggtcatcttgacttcttccccaatggaggagagagcatgccgggatgcaagaagaatgccctgtctcagatcgtggatctagatggcatctgggcgggaacccgggactttgtggcttgcaatcacctaagaagctacaagtattacttggaaagcatcctcaatcccgatgggtttgctgcatatccctgcacttcctacaagtcctttgagtctgacaagtgcttcccgtgtccagatcaaggatgcccacagatgggtcactatgctgataaatttgctggcaggacaagtgaagagcagcagaaattcttcttgaacacaggagaggctagcaatttcgctcgctggagatatggggtttccatcacactgtctggaagaacagccactggtcagatcaaagttgctttgtttggaaataagggaaacactcaccagtacagtatcttcagggggattctcaaaccaggctcaacccattcctatgagtttgatgcaaagctggatgttggaacaattgagaaagtcaagtttctttggaataacaatgtgataaatccaaccctccccaaagtgggtgccaccaagatcactgtgcaaaagggagaagagaagacagtgtacaacttctgtagcgaagacacagtgcgggaagacacgctgctcaccctcacgccctgctaagctcccggggcgacgaggctgctgcgttcacactaataaaatccactggtgcatctgta

SEQ ID NO: 163561 - DNA, 445 bp, Homo sapiens
  Payload ID: 12207
  Gene Symbol: PNLIPRP1
  Gene Name: pancreatic lipase-related protein 1
  ENST ID: ENST00000471549
  CDS Start-End: 51-445
ctgctctggcaatgcccggtgagactgaattatgtttaaatttattgtagatgctgatcttctggacaatcacacttttcctgctgggagcagccaaaggaaaagaagtttgctatgaggacctcgggtgcttttctgacactgagccctggggcgggacagcaatcaggcccctgaaaattctcccctggagccctgagaagatcggcacccgcttcctgctgtacaccaatgaaaacccaaacaactttcaaattctcctcctctctgatccatcaacaattgaggcatcaaattttcaaatggacagaaagacccggttcatcatccatggcttcatagacaaaggagatgagagctgggtgacagacatgtgcaagaaactgttcgaggtggaggaggtgaactgcatctgcgtggactggaagaagggctcccaagccac

SEQ ID NO: 163562 - DNA, 1012 bp, Homo sapiens
  Payload ID: 12207
  Gene Symbol: PNLIPRP1
  Gene Name: pancreatic lipase-related protein 1
  ENST ID: ENST00000497792
  CDS Start-End: 25-381
ctttccccctgctgtgacgtacagatgctgatcttctggacaatcacacttttcctgctgggagcagccaaaggaaaagaagtttgctatgaggacctcgggtgcttttctgacactgagccctggggcgggacagcaatcaggcccctgaaaattctcccctggagccctgagaagatcggcacccgcttcctgctgtacaccaatgaaaacccaaacaactttcaaattctcctcctctctgatccatcaacaattgaggcatcaaattttcaaatggacagaaagacccggttcatcatccatggcttcatagacaaaggagatgagagctgggtgacagacatgtgcaagcagcctggggcatcgccaagagcctgaaaggaccccttacagtcaaatccacaaggtcatttagacactggccaccggagattgcacctaagacttttccttttcaaaacaggactcttttcatgatgcaattgtttttcccttactaaccaaccttactgaatttggttgaaggaaaccagagagtagccagcttccaattaatctgcaagctggagggggaatcagtttgcctttctcatagcattcaccctgaaggataactcctaattaccaacaggattccctaacagagtctagtttatctcatgccctagctaggagaagagagaagtggccatttctgagccctggctggataaggtttcccctgctcccattatctccccaaccccactatctccccaacaccagaaactgttcgaggtggaggaggtgaactgcatctgcgtggactggaagaagggctcccaagccacctacacacaggctgccaacaacgtgcgagtggtgggcgcccaggtggcccagatgctcgacatcctcttgacagagtatagctaccccccttccaaagttcacctcattggccacagcctgggagcccacgtggctggagaggcaggaagcaagactccaggcctgagcaggattacag

SEQ ID NO: 163563 - DNA, 579 bp, Homo sapiens
  Payload ID: 12207
  Gene Symbol: PNLIPRP1
  Gene Name: pancreatic lipase-related protein 1
  ENST ID: ENST00000527980
  CDS Start-End: 89-579
gaggtaaacagtactgaagtccagggcgtcggtgctcactgctctggcaatgcccggtgagactgaattatgtttaaatttattgtagatgctgatcttctggacaatcacacttttcctgctgggagcagccaaaggaaaagaagtttgctatgaggacctcgggtgcttttctgacactgagccctggggcgggacagcaatcaggcccctgaaaattctcccctggagccctgagaagatcggcacccgcttcctgctgtacaccaatgaaaacccaaacaactttcaaattctcctcctctctgatccatcaacaattgaggcatcaaattttcaaatggacagaaagacccggttcatcatccatggcttcatagacaaaggagatgagagctgggtgacagacatgtgcaagactccaggcctgagcaggattacagggttggatcctgtagaagcaagtttcgagagtactcctgaagaggtgcgacttgatccctctgatgctgactttgttgatgtgattcacacggatgcagctcccctgatcccattcttgggttttggaacgaacca

SEQ ID NO: 163564 - DNA, 1533 bp, Homo sapiens
  Payload ID: 12207
  Gene Symbol: PNLIPRP1
  Gene Name: pancreatic lipase-related protein 1
  Uniprot ID: P54315
  ENST ID: ENST00000528052
  CDS Start-End: 72-1475
gagggaacatctggaacattagacagggtaagccacctttgcaactcctttccccctgctgtgacgtacagatgctgatcttctggacaatcacacttttcctgctgggagcagccaaaggaaaagaagtttgctatgaggacctcgggtgcttttctgacactgagccctggggcgggacagcaatcaggcccctgaaaattctcccctggagccctgagaagatcggcacccgcttcctgctgtacaccaatgaaaacccaaacaactttcaaattctcctcctctctgatccatcaacaattgaggcatcaaattttcaaatggacagaaagacccggttcatcatccatggcttcatagacaaaggagatgagagctgggtgacagacatgtgcaagaaactgttcgaggtggaggaggtgaactgcatctgcgtggactggaagaagggctcccaagccacctacacacaggctgccaacaacgtgcgagtggtgggcgcccaggtggcccagatgctcgacatcctcttgacagagtatagctaccccccttccaaagttcacctcattggccacagcctgggagcccacgtggctggagaggcaggaagcaagactccaggcctgagcaggattacagggttggatcctgtagaagcaagtttcgagagtactcctgaagaggtgcgacttgatccctctgatgctgactttgttgatgtgattcacacggatgcagctcccctgatcccattcttgggttttggaacgaaccaacagatgggtcatcttgacttcttccccaatggaggagagagcatgccgggatgcaagaagaatgccctgtctcagatcgtggatctagatggcatctgggcgggaacccgggactttgtggcttgcaatcacctaagaagctacaagtattacttggaaagcatcctcaatcccgatgggtttgctgcatatccctgcacttcctacaagtcctttgagtctgacaagtgcttcccgtgtccagatcaaggatgcccacagatgggtcactatgctgataaatttgctggcaggacaagtgaagagcagcagaaattcttcttgaacacaggagaggctagcaatttcgctcgctggagatatggggtttccatcacactgtctggaagaacagccactggtcagatcaaagttgctttgtttggaaataagggaaacactcaccagtacagtatcttcagggggattctcaaaccaggctcaacccattcctatgagtttgatgcaaagctggatgttggaacaattgagaaagtcaagtttctttggaataacaatgtgataaatccaaccctccccaaagtgggtgccaccaagatcactgtgcaaaagggagaagagaagacagtgtacaacttctgtagcgaagacacagtgcgggaagacacgctgctcaccctcacgccctgctaagctcccggggcgacgaggctgctgcgttcacactaataaaatccactggtgcatctgt

SEQ ID NO: 163565 - DNA, 1459 bp, Homo sapiens
  Payload ID: 12207
  Gene Symbol: PNLIPRP1
  Gene Name: pancreatic lipase-related protein 1
  ENST ID: ENST00000534537
  CDS Start-End: 1-1404
atgctgatcttctggacaatcacacttttcctgctgggagcagccaaaggaaaagaagtttgctatgaggacctcgggtgcttttctgacactgagccctggggcgggacagcaatcaggcccctgaaaattctcccctggagccctgagaagatcggcacccgcttcctgctgtacaccaatgaaaacccaaacaactttcaaattctcctcctctctgatccatcaacaattgaggcatcaaattttcaaatggacagaaagacccggttcatcatccatggcttcatagacaaaggagatgagagctgggtgacagacatgtgcaagaaactgttcgaggtggaggaggtgaactgcatctgcgtggactggaagaagggctcccaagccacctacacacaggctgccaacaacgtgcgagtggtgggcgcccaggtggcccagatgctcgacatcctcttggtgaagtatagctaccccccttccaaagttcacctcattggccacagcctgggagcccacgtggctggagaggcaggaagcaagactccaggcctgagcaggattacagggttggatcctgtagaagcaagtttcgagagtactcctgaagaggtgcgacttgatccctctgatgctgactttgttgatgtgattcacacggatgcagctcccctgatcccattcttgggttttggaacgaaccaacagatgggtcatcttgacttcttccccaatggaggagagagcatgccgggatgcaagaagaatgccctgtctcagatcgtggatctagatggcatctgggcgggaacccgggactttgtggcttgcaatcacctaagaagctacaagtattacttggaaagcatcctcaatcccgatgggtttgctgcatatccctgcacttcctacaagtcctttgagtctgacaagtgcttcccgtgtccagatcaaggatgcccacagatgggtcactatgctgataaatttgctggcaggacaagtgaagagcagcagaaattcttcttgaacacaggagaggctagcaatttcgctcgctggagatatggggtttccatcacactgtctggaagaacagccactggtcagatcaaagttgctttgtttggaaataagggaaacactcaccagtacagtatcttcagggggattctcaaaccaggctcaacccattcctatgagtttgatgcaaagctggatgttggaacaattgagaaagtcaagtttctttggaataacaatgtgataaatccaaccctccccaaagtgggtgccaccaagatcactgtgcaaaagggagaagagaagacagtgtacaacttctgtagcgaagacacagtgcgggaagacacgctgctcaccctcacgccctgctaagctcccggggcgacgaggctgctgcgttcacactaataaaatccactggtgcatc

SEQ ID NO: 163566 - DNA, 1014 bp, Homo sapiens
  Payload ID: 12207
  Gene Symbol: PNLIPRP1
  Gene Name: pancreatic lipase-related protein 1
  ENST ID: ENST00000482833
  CDS Start-End: 1-540
aaactgttcgaggtggaggaggtgaactgcatctgcgtggactggaagaagggctcccaagccacctacacacaggctgccaacaacgtgcgagtggtgggcgcccaggtggcccagatgctcgacatcctcttgacagagtatagctaccccccttccaaagttcacctcattggccacagcctgggagcccacgtggctggagaggcaggaagcaagactccaggcctgagcaggattacagggttggatcctgtagaagcaagtttcgagagtactcctgaagaggtgcgacttgatccctctgatgctgactttgttgatgtgattcacacggatgcagctcccctgatcccattcttgggttttggaacgaaccaacagatgggtcatcttgacttcttccccaatggaggagagagcatgccgggatgcaagaagaatgccctgtctcagatcgtggatctagatggcatctgggcgggacaagtgcttcccgtgtccagatcaaggatgcccacagatgggtcactatgctgataaatttgctggcaggacaagtgaagagcagcagaaattcttcttgaacacaggagaggctagcaatttcgctcgctggagatatggggtttccatcacactgtctggaagaacagccactggtcagatcaaagttgctttgtttggaaataagggaaacactcaccagtacagtatcttcagggggattctcaaaccaggctcaacccattcctatgagtttgatgcaaagctggatgttggaacaattgagaaagtcaagtttctttggaataacaatgtgataaatccaaccctccccaaagtgggtgccaccaagatcactgtgcaaaagggagaagagaagacagtgtacaacttctgtagcgaagacacagtgcgggaagacacgctgctcaccctcacgccctgctaagctcccggggcgacgaggctgctgcgttcacactaataaaatccactggtgcatctgta

SEQ ID NO: 163567 - DNA, 734 bp, Homo sapiens
  Payload ID: 12207
  Gene Symbol: PNLIPRP1
  Gene Name: pancreatic lipase-related protein 1
  ENST ID: ENST00000531984
  CDS Start-End: 161-734
agctactgtgagggctgttgaatttttctccaaagctcagatgcccagtattcctagtcttcgaaagagagagaggaagattgagagagagagagagagagagagagagagaagaagttttcttaatcagagatttctctttactttcaactaattgcagatgctgatcttctggacaatcacacttttcctgctgggagcagccaaaggaaaagaagtttgctatgaggacctcgggtgcttttctgacactgagccctggggcgggacagcaatcaggcccctgaaaattctcccctggagccctgagaagatcggcacccgcttcctgctgtacaccaatgaaaacccaaacaactttcaaattctcctcctctctgatccatcaacaattgaggcatcaaattttcaaatggacagaaagacccggttcatcatccatggcttcatagacaaaggagatgagagctgggtgacagacatgtgcaagaaactgttcgaggtggaggaggtgaactgcatctgcgtggactggaagaagggctcccaagccacctacacacaggctgccaacaacgtgcgagtggtgggcgcccaggtggcccagatgctcgacatcctcttgacagagtatagctaccccccttccaaagttcacctcattggccacagcctgggagcccacgtggctggagaggcaggaagcaagactccaggcctgagcaggattacag

SEQ ID NO: 163568 - DNA, 581 bp, Homo sapiens
  Payload ID: 12207
  Gene Symbol: PNLIPRP1
  Gene Name: pancreatic lipase-related protein 1
  ENST ID: ENST00000530319
  CDS Start-End: 25-581
ctttccccctgctgtgacgtacagatgctgatcttctggacaatcacacttttcctgctgggagcagccaaaggaaaagaagtttgctatgaggacctcgggtgcttttctgacactgagccctggggcgggacagcaatcaggcccctgaaaattctcccctggagccctgagaagatcggcacccgcttcctgctgtacaccaatgaaaacccaaacaactttcaaattctcctcctctctgatccatcaacaattgaggcatcaaattttcaaatggacagaaagacccggttcatcatccatggcttcatagacaaaggagatgagagctgggtgacagacatgtgcaagacagagtatagctaccccccttccaaagttcacctcattggccacagcctgggagcccacgtggctggagaggcaggaagcaagactccaggcctgagcaggattacagggttggatcctgtagaagcaagtttcgagagtactcctgaagaggtgcgacttgatccctctgatgctgactttgttgatgtgattcacacggatgcagctcccctgatcccattctt

SEQ ID NO: 163569 - DNA, 1482 bp, Homo sapiens
  Payload ID: 12208
  Gene Symbol: PNLIPRP2
  Gene Name: pancreatic lipase-related protein 2
  ENST ID: ENST00000579578
  CDS Start-End: 27-1436
gtgagtggaagctctggtgcagcatgatgctgcccccttggaccctcggccttctcctgctggccacagtcagaggaaaagaggtctgctacggacaacttggctgcttttctgatgaaaaaccatgggcaggaacccttcagcgacctgtaaaattacttccctggtcccccgaggacattgacacccgctttcttctgtacacaaatgaaaatccaaacaacttccaactaatcactggcacggaaccagacaccattgaggcttcaaacttccaactggaccgcaagacacgcttcatcatccatggcttcttagacaaggcggaggacagctggccatcggacatgtgcaagaaaatgtttgaagtggagaaggtgaactgcatctgtgtggactggaggcacgggtcccgggcaatgtacacccaagccgtgcaaaacattcgggttgttggggcggagacagctttcttaatacaagcactgtcgacgcagctagggtacagccttgaggacgtgcatgtcatcggccacagcctgggcgcgcacacggccgcggaggcgggcaggaggctggggggccgcgtgggcaggatcacagggctggatccagcagggccgtgcttccaggatgaacctgaggaggttcggttggatccatctgacgccgtgtttgtggatgtgattcacacagattcttctcccatagttccttccctaggtttcggaatgagccaaaaggtgggccatctggatttctttccaaatggaggaaaggaaatgcccggatgtaagaaaaatgtcctttcaaccattactgatattgatggaatatgggaaggaattggtggctttgtgtcttgcaatcacctaagaagcttcgagtattactcaagcagcgtcctcaaccctgatggcttcctgggctatccctgtgcctcctacgatgagtttcaggagagtaagtgtttcccttgtccagctgaaggatgccccaaaatggggcactatgctgaccaatttaaggggaaaacaagtgctgtggaacaaacctttttcctgaacacaggagagagtggtaactttactagttgaagatataagatatcagtcacactttctggaaaagagaaagtgaatgggtacatcaggattgctttgtatggaagtaatgaaaactcaaaacaatatgagattttcaaaggatccctcaaaccagatgcaagtcacacgtgtgctattgatgtggattttaatgttggaaaaatacagaaagttaaattcctctggaacaaacgtgggataaatctatctgagcccaaactgggggcttcccaaatcacagtgcaaagtggtgaagatgggactgagtataatttttgtagcagcgacactgtggaagaaaacgtcttgcaatctctttacccttgttaaaaacgtggtgcagctattgcggtaataaaatctttaatgcactcgg

SEQ ID NO: 163570 - DNA, 1456 bp, Homo sapiens
  Payload ID: 12208
  Gene Symbol: PNLIPRP2
  Gene Name: pancreatic lipase-related protein 2
  ENST ID: ENST00000591655
  CDS Start-End: 1-1410
atgctgcccccttggaccctcggccttctcctgctggccacagtcagaggaaaagaggtctgctacggacaacttggctgcttttctgatgaaaaaccatgggcaggaacccttcagcgacctgtaaaattacttccctggtcccccgaggacattgacacccgctttcttctgtacacaaatgaaaatccaaacaacttccaactaatcactggcacggaaccagacaccattgaggcttcaaacttccaactggaccgcaagacacgcttcatcatccatggcttcttagacaaggcggaggacagctggccatcggacatgtgcaagaaaatgtttgaagtggagaaggtgaactgcatctgtgtggactggaggcacgggtcccgggcaatgtacacccaagccgtgcaaaacattcgggttgttggggcggagacagctttcttaatacaagcactgtcgacgcagctagggtacagccttgaggacgtgcatgtcatcggccacagcctgggcgcgcacacggccgcggaggcgggcaggaggctggggggccgcgtgggcaggatcacagggctggatccagcagggccgtgcttccaggatgaacctgaggaggttcggttggatccatctgacgccgtgtttgtggatgtgattcacacagattcttctcccatagttccttccctaggtttcggaatgagccaaaaggtgggccatctggatttctttccaaatggaggaaaggaaatgcccggatgtaagaaaaatgtcctttcaaccattactgatattgatggaatatgggaaggaattggtggctttgtgtcttgcaatcacctaagaagcttcgagtattactcaagcagcgtcctcaaccctgatggcttcctgggctatccctgtgcctcctacgatgagtttcaggagagtaagtgtttcccttgtccagctgaaggatgccccaaaatggggcactatgctgaccaatttaaggggaaaacaagtgctgtggaacaaacctttttcctgaacacaggagagagtggtaactttactagctggagatataagatatcagtcacactttctggaaaagagaaagtgaatgggtacatcaggattgctttgtatggaagtaatgaaaactcaaaacaatatgagattttcaaaggatccctcaaaccagatgcaagtcacacgtgtgctattgatgtggattttaatgttggaaaaatacagaaagttaaattcctctggaacaaacgtgggataaatctatctgagcccaaactgggggcttcccaaatcacagtgcaaagtggtgaagatgggactgagtataatttttgtagcagcgacactgtggaagaaaacgtcttgcaatctctttacccttgttaaaaacgtggtgcagctattgcggtaataaaatctttaatgcactcgg

SEQ ID NO: 163571 - DNA, 1407 bp, Homo sapiens
  Payload ID: 12208
  Gene Symbol: PNLIPRP2
  Gene Name: pancreatic lipase-related protein 2
  ENST ID: ENST00000611850
  CDS Start-End: 1-1407
atgctgcccccttggaccctcggccttctcctgctggccacagtcagaggaaaagaggtctgctacggacaacttggctgcttttctgatgaaaaaccatgggcaggaacccttcagcgacctgtaaaattacttccctggtcccccgaggacattgacacccgctttcttctgtacacaaatgaaaatccaaacaacttccaactaatcactggcacggaaccagacaccattgaggcttcaaacttccaactggaccgcaagacacgcttcatcatccatggcttcttagacaaggcggaggacagctggccatcggacatgtgcaagaaaatgtttgaagtggagaaggtgaactgcatctgtgtggactggaggcacgggtcccgggcaatgtacacccaagccgtgcaaaacattcgggttgttggggcggagacagctttcttaatacaagcactgtcgacgcagctagggtacagccttgaggacgtgcatgtcatcggccacagcctgggcgcgcacacggccgcggaggcgggcaggaggctggggggccgcgtgggcaggatcacagggctggatccagcagggccgtgcttccaggatgaacctgaggaggttcggttggatccatctgacgccgtgtttgtggatgtgattcacacagattcttctcccatagttccttccctaggtttcggaatgagccaaaaggtgggccatctggatttctttccaaatggaggaaaggaaatgcccggatgtaagaaaaatgtcctttcaaccattactgatattgatggaatatgggaaggaattggtggctttgtgtcttgcaatcacctaagaagcttcgagtattactcaagcagcgtcctcaaccctgatggcttcctgggctatccctgtgcctcctacgatgagtttcaggagagtaagtgtttcccttgtccagctgaaggatgccccaaaatggggcactatgctgaccaatttaaggggaaaacaagtgctgtggaacaaacctttttcctgaacacaggagagagtggtaactttactagtagatataagatatcagtcacactttctggaaaagagaaagtgaatgggtacatcaggattgctttgtatggaagtaatgaaaactcaaaacaatatgagattttcaaaggatccctcaaaccagatgcaagtcacacgtgtgctattgatgtggattttaatgttggaaaaatacagaaagttaaattcctctggaacaaacgtgggataaatctatctgagcccaaactgggggcttcccaaatcacagtgcaaagtggtgaagatgggactgagtataatttttgtagcagcgacactgtggaagaaaacgtcttgcaatctctttacccttgttaa

SEQ ID NO: 163572 - DNA, 2354 bp, Homo sapiens
  Payload ID: 12209
  Gene Symbol: PNLIPRP3
  Gene Name: pancreatic lipase-related protein 3
  Uniprot ID: Q17RR3
  ENST ID: ENST00000369230
  CDS Start-End: 147-1550
ggtggaataacatgttcttttaaacgtagagtttaaacattgagttgcatcattgtgaggaaaaccacttagtattttatagtgaggtgactttacaagtaaagatcttcaagaagatttttatgtgatttaaaaaatcagcttagatgcttggaatttggattgttgcattcttgttctttggcacatcaagaggaaaagaagtttgctatgaaaggttagggtgtttcaaagatggtttaccatggaccaggactttctcaacagagttggtaggtttaccctggtctccagagaagataaacactcgtttcctgctctacactatacacaatcccaatgcctatcaggagatcagtgcggttaattcttcaactatccaagcctcatattttggaacagacaagatcacccgtatcaacatagctggatggaaaacagatggcaaatggcagagagacatgtgcaatgtgttgctacagctggaagatataaattgcattaatttagattggatcaacggttcacgggaatacatccatgctgtaaacaatctccgtgttgttggtgctgaggtggcttattttattgatgttctcatgaaaaaatttgaatattccccttctaaagtgcacttgattggccacagcttgggagcacacctggctggggaagctgggtcaaggataccaggccttggaagaataactgggttggacccagctgggccatttttccacaacactccaaaggaagtcaggctagacccctcggatgccaactttgttgacgttattcatacaaatgcagctcgcatcctctttgagcttggtgttggaaccattgatgcttgtggtcatcttgacttttacccaaatggagggaagcacatgccaggatgtgaagacttaattacacctttactgaaatttaacttcaatgcttacaaaaaagaaatggcttccttctttgactgtaaccatgcccgaagttatcaattttatgctgaaagcattcttaatcctgatgcatttattgcttatccttgtagatcctacacatcttttaaagcaggaaattgcttcttttgttccaaagaaggttgcccaacaatgggtcattttgctgatagatttcacttcaaaaatatgaagactaatggatcacattattttttaaacacagggtccctttccccatttgcccgttggaggcacaaattgtctgttaaactcagtggaagcgaagtcactcaaggaactgtctttcttcgtgtaggcggggcagttaggaaaactggggagtttgccattgtcagtggaaaacttgagccaggcatgacttacacaaaattaatcgatgcagatgttaacgttggaaacattacaagtgttcagttcatctggaaaaaacatttgtttgaagattctcagaataagttgggagcagaaatggtgataaatacatctgggaaatatggatataaatctaccttctgtagccaagacattatgggacctaatattctccagaacctgaaaccatgctaatctcagatacagtcttgatggatttctttagtaggagcaatgaagaaaagtgtctccttccacctggcatccagaccaaatttgacccttgtaaatgacttagtcatttacaagggtcttactcagagtcaagtacgggtttgctttttttctgtgtagaatgttcatctaactgcaccttaaaaacacactgaaccctgggacaaaagataattactatgatctgtaggaatctggatatcattgacaaaatagagctgttttggaattttcctgaataagaggaggtgatgcaaatgtatgttgagtgtataaactcactggacaaaagtaagcctctggcttgctgagtttttgaagtatattttcaggtataataatcattgttctaaaattatataaaactatttgttatgttgttaaatcttgctgagacaaattatgactatagtgcatgatatatagtagattataaccttgtgggttgatgtgtctatctagtaataataaaaactaatgagatggcactagtatttccaaggtgttccttggtgttcagggtgtgcacaagagagattttggagcttatctgttatgtgttcatcagttagcaatgggacctgaagttcaacaacccagggtatagcccccttcctccaaagtccctgccacaggagaattactcctctccctgggtcttgaatgctctatggtgaatttgtatttagcctcaaggcagcatttcatttgtaaagcacttgggtaaccctttgttcttgcaataacaatattataatatttaaa

SEQ ID NO: 163573 - DNA, 460 bp, Homo sapiens
  Payload ID: 12210
  Gene Symbol: PPY
  Gene Name: pancreatic polypeptide
  Uniprot ID: P01298
  ENST ID: ENST00000225992
  CDS Start-End: 49-336
tgaggcaggtgctcgcttggtctagtgcccatttactctggactccggatggctgccgcacgcctctgcctctccctgctgctcctgtccacctgcgtggctctgttactacagccactgctgggtgcccagggagccccactggagccagtgtacccaggggacaatgccacaccagagcagatggcccagtatgcagctgatctccgtagatacatcaacatgctgaccaggcctaggtatgggaaaagacacaaagaggacacgctggccttctcggagtgggggtccccgcatgctgctgtccccagggagctcagcccgctggacttataatgccaccttctgtctcctacgactccatgagcagcgccagcccagctctcccctctgcacccttggctctggccaaagcttgctccctgctcccacacaggctcaataaagcaagtcaaagcca

SEQ ID NO: 163574 - DNA, 431 bp, Homo sapiens
  Payload ID: 12210
  Gene Symbol: PPY
  Gene Name: pancreatic polypeptide
  ENST ID: ENST00000587006
  CDS Start-End: 1-318
atggctgccgcacgcctctgcctctccctgctgctcctgtccacctgcgtggctctgttactacagccactgctgggtgcccagggagccccactggagccagtgtacccaggggacaatgccacaccagagcagatggcccagtatgcagctgatctccgtagatacatcaacatgctgaccaggcctagtgcttgcccctgctgcctcttccctcccaggtatgggaaaagacacaaagaggacacgctggccttctcggagtgggggtccccgcatgctgctgtccccagggagctcagcccgctggacttataatgccaccttctgtctcctacgactccatgagcagcgccagcccagctctcccctctgcacccttggctctggccaaagcttgctccctgctcccacacaggctcaataaagca

SEQ ID NO: 163575 - DNA, 499 bp, Homo sapiens
  Payload ID: 12210
  Gene Symbol: PPY
  Gene Name: pancreatic polypeptide
  Uniprot ID: P01298
  ENST ID: ENST00000591228
  CDS Start-End: 89-376
gtcacgctagaagagccgtctgctgactgcacgtgtgtgtgcacactcgtgtgcatggctgtgaactggaatgtgtgactgtgaccttatggctgccgcacgcctctgcctctccctgctgctcctgtccacctgcgtggctctgttactacagccactgctgggtgcccagggagccccactggagccagtgtacccaggggacaatgccacaccagagcagatggcccagtatgcagctgatctccgtagatacatcaacatgctgaccaggcctaggtatgggaaaagacacaaagaggacacgctggccttctcggagtgggggtccccgcatgctgctgtccccagggagctcagcccgctggacttataatgccaccttctgtctcctacgactccatgagcagcgccagcccagctctcccctctgcacccttggctctggccaaagcttgctccctgctcccacacaggctcaataaagcaagtcaaagcc

SEQ ID NO: 163576 - DNA, 563 bp, Homo sapiens
  Payload ID: 12210
  Gene Symbol: PPY
  Gene Name: pancreatic polypeptide
  ENST ID: ENST00000591703
  CDS Start-End: 46-285
ggcaggtgctcgcttggtctagtgcccatttactctggactccggatggctgccgcacgcctctgcctctccctgctgctcctgtccacctgcgtggctctgttactacagccactgctgggtgcccagggagccccactggagccagtgtacccaggggacaatgccacaccagagcagatggcccagtatgcagctgatctccgtagatacatcaacatgctgaccaggcctaggcctagaccaatgtgccctgggcaagatggtgcctacaggcagatatgaaacaggtgggctggcacctgggcacagtgcttgcccctgctgcctcttccctcccaggtatgggaaaagacacaaagaggacacgctggccttctcggagtgggggtccccgcatgctgctgtccccagggagctcagcccgctggacttataatgccaccttctgtctcctacgactccatgagcagcgccagcccagctctcccctctgcacccttggctctggccaaagcttgctccctgctcccacacaggctcaataaagcaagtcaaagcca

SEQ ID NO: 163577 - DNA, 521 bp, Homo sapiens
  Payload ID: 12210
  Gene Symbol: PPY
  Gene Name: pancreatic polypeptide
  ENST ID: ENST00000587070
  CDS Start-End: 1-397
ccagtatgcagctgatctccgtagatacatcaacatgctgaccaggcctaggtgtgtgccacagttggggagagagatcccagcccctgggaccctgggcccactccacattcctggccacaccctatccccagccccagccccagccccttccaggcctgctcttgggaaaacagggcatctgtgctcaacaggcctagaccaatgtgccctgggcaagatggtgcctacaggcagatatgaaacaggtgggctggcacctgggcacagtgcttgcccctgctgcctcttccctcccaggtatgggaaaagacacaaagaggacacgctggccttctcggagtgggggtccccgcatgctgctgtccccagggagctcagcccgctggacttataatgccaccttctgtctcctacgactccatgagcagcgccagcccagctctcccctctgcacccttggctctggccaaagcttgctccctgctcccacacaggctcaataaagcaagtcaaagcca

SEQ ID NO: 163578 - DNA, 627 bp, Homo sapiens
  Payload ID: 12211
  Gene Symbol: PPDPF
  Gene Name: pancreatic progenitor cell differentiation and proliferation factor
  ENST ID: ENST00000370177
  CDS Start-End: 146-568
cgcctctctgtcgtggcgcggcttcccgcggtcttctctgcaaatgggctccgtggcctagcgcccccgtccccgccacccgtgatcgtgcgccgaggcccgcgaggggtcgccgcccagatcccaccagccagcaagctaaagcatggcggccatcccctccagcggctcgctcgtggccacccacgactactaccggcgccgcctgggttccacttccagcaacagctcctgcagcagtaccgagtgccccggggaagccattccccaccccccaggtgagtgcaggatcgcccctttctccccccgctcctccaggagctggcagcatcaagaccccacttcgcttctctcaggtctccccaaggctgacccgggtcattggtgggccagcttctttttcgggaagtccaccctcccgttcatggccacggtgttggagtccgcagagcactcggaacctccccaggcctccagcagcatgaccgcctgtggcctggctcgggacgccccgaggaagcagcccggcggtcagtccagcacagccagcgctgggcccccgtcctgacctgagcggttaccaccagccccaggcctgcggaggcgctagtccaccagagcccctcc

SEQ ID NO: 163579 - DNA, 868 bp, Homo sapiens
  Payload ID: 12211
  Gene Symbol: PPDPF
  Gene Name: pancreatic progenitor cell differentiation and proliferation factor
  Uniprot ID: Q9H3Y8
  ENST ID: ENST00000370179
  CDS Start-End: 197-541
gcggcccccgcgcatataagtgggcgcgtccgcgcgtgcgcaccccgcgcgcgcctctctgtcgtggcgcggcttcccgcggtcttctctgcaaatgggctccgtggcctagcgcccccgtccccgccacccgtgatcgtgcgccgaggcccgcgaggggtcgccgcccagatcccaccagccagcaagctaaagcatggcggccatcccctccagcggctcgctcgtggccacccacgactactaccggcgccgcctgggttccacttccagcaacagctcctgcagcagtaccgagtgccccggggaagccattccccaccccccaggtctccccaaggctgacccgggtcattggtgggccagcttctttttcgggaagtccaccctcccgttcatggccacggtgttggagtccgcagagcactcggaacctccccaggcctccagcagcatgaccgcctgtggcctggctcgggacgccccgaggaagcagcccggcggtcagtccagcacagccagcgctgggcccccgtcctgacctgagcggttaccaccagccccaggcctgcggaggcgctagtccaccagagcccctccccgcccctctccccactccgcatccctcgcccccctccccacctcccaccccccaccctgtaaactaggcggctgcagcaagcagaccttcgcatcaacacagcagacaccaaaaaccagtgagagccccgctctctaccgcccggccccagcactcgctagctttcctgacacctggaactgtgcacctggcaccaagcggaaaataaactccaagcagccagtagccccgatggtgtgtgcctgagctgtgtggcccgaggttcca

SEQ ID NO: 163580 - DNA, 2769 bp, Homo sapiens
  Payload ID: 12212
  Gene Symbol: PANX1
  Gene Name: pannexin 1
  Uniprot ID: Q96RD7
  ENST ID: ENST00000227638
  CDS Start-End: 386-1666
gggcggcgcggaggggcagggccagagggaagcgctttgttccgcgcgtggttcccgcgcctgggggtgcgcgggagaggcgcgaatccgagtgccgcgcgcggcccggggacttgcacgggcgtgcggggtggaaccgcaggaagcggagctctcgggttcccgccccgccccgccccgccggcggcggaggcagcgagcgcgagagcccagcggagtcgctgggagcctgaggcaccgagacacaaaggcaggcgggatgcgggagcaggcaaagggaaagcgaaagccgcgcgcccggccggtgactgggtgaaggcgccgcgcagctttcccgacgccggctgtacccggacctcctggtcgagcctggcgcgccgcagccatggccatcgctcaactggccacggagtacgtgttctcggatttcttgctgaaggagcccacggagcccaagttcaaggggctgcgactggagctggctgtggacaagatggtcacgtgcattgcggtggggctgcccctgctgctcatctcgctggccttcgcgcaggagatctcgattggtacacagataagctgtttctctccaagttctttctcctggcgtcaggctgcctttgtggattcatattgctgggcggctgttcagcagaagaactcactgcagagcgagtctggaaacctcccactgtggctgcataagtttttcccctacatcctgctgctctttgcgatcctcctgtacctgcccccgctgttctggcgtttcgcagctgctcctcatatttgctcagacttgaagtttatcatggaagaacttgacaaagtttacaaccgtgcaattaaggctgcaaagagtgcgcgtgaccttgacatgagagatggagcctgctcagttccaggtgttaccgagaacttagggcaaagtttgtgggaggtatctgaaagccacttcaagtacccaattgtggagcagtacttgaagacaaagaaaaattctaataatttaatcatcaagtacattagctgccgcctgctgacactcatcattatactgttagcgtgtatctacctgggctattacttcagcctctcctcactctcagacgagtttgtgtgcagcatcaaatcagggatcctgagaaacgacagcaccgtgcccgatcagtttcagtgcaaactcattgccgtgggcatcttccagttgctcagtgtcattaaccttgtggtttatgtcctgctggctcccgtggttgtctacacgctgtttgttccattccgacagaagacagatgttctcaaagtgtacgaaatcctccccacttttgatgttctgcatttcaaatctgaagggtacaacgatttgagcctctacaatctcttcttggaggaaaatataagtgaggtcaagtcatacaagtgtcttaaggtactggagaatattaagagcagtggtcaggggatcgacccaatgctactcctgacaaaccttggcatgatcaagatggatgttgttgatggcaaaactcccatgtctgcagagatgagagaggagcaggggaaccagacggcagagctccaaggtatgaacatagacagtgaaactaaagcaaataatggagagaagaatgcccgacagagacttctggattcttcttgctgatgatttttttccttgagctgtaaatctgtgacttctgcgacatgggatttaatttggctaaagcacccctgttggtttcacagctggtttgcaataaatggttcttggtggagatactgagcatgtcttattgagtccctaatggaaatggtgatcaacaaaaggttatggaagaatggtttatgaacttcccataggaagcacctgagagatagtaaactgcagcaagtaactatgtgtaagtcctcatcaaatgaaaagcagaaagacaagaacaattagtcaagagcagtagccctgtcagagcctcggagcaatacctttctgtacccgtggtgagacaagacccagagctactggaaaacaagcactttggaagatttgttttgttttcatggaataataatatgtcagggtataatttaacgtgagtttcttatgtgcccttaaagactgttagacaagaaaagcattcactggctaataatccataggtcgacctatgtcctaagttaggtgtaaggtccgatgccttggcccacactcgagctctctttacattgttagttgtcaaccttggctgatggaaatcccgtaaccactatttgttgcactgtgccttgaagggcagcaggcccaagtgctgctctgactgaaaactgagttaacaagatgaaatctaaaggatattcacagtgacttcaattcaggaagaatgcttccaaaagagcccagtggggaaatctgacatcacagaagacattaattcagtcactttcaaagagtttgtctacaggcggtttctctgttatcaaaggcatttgaaataggattttacttaaacaataatggaacacaggagtatttaaagtgaagaacactttgcctgaatgtgatcagggcacataagtgacattggcatgcttcatatggcgtgcttggagccagaaaaacttagcggtttattttgtttatatttaagcacagctttaaaaaattcattatcgtttattcagtgtccgaattgaggccatttgggaagaaaattctagcactggtggagaattatagaataaagattataaatggttggataagacaaa

SEQ ID NO: 163581 - DNA, 2750 bp, Homo sapiens
  Payload ID: 12212
  Gene Symbol: PANX1
  Gene Name: pannexin 1
  Uniprot ID: Q96RD7
  ENST ID: ENST00000436171
  CDS Start-End: 385-1653
ggcggcgcggaggggcagggccagagggaagcgctttgttccgcgcgtggttcccgcgcctgggggtgcgcgggagaggcgcgaatccgagtgccgcgcgcggcccggggacttgcacgggcgtgcggggtggaaccgcaggaagcggagctctcgggttcccgccccgccccgccccgccggcggcggaggcagcgagcgcgagagcccagcggagtcgctgggagcctgaggcaccgagacacaaaggcaggcgggatgcgggagcaggcaaagggaaagcgaaagccgcgcgcccggccggtgactgggtgaaggcgccgcgcagctttcccgacgccggctgtacccggacctcctggtcgagcctggcgcgccgcagccatggccatcgctcaactggccacggagtacgtgttctcggatttcttgctgaaggagcccacggagcccaagttcaaggggctgcgactggagctggctgtggacaagatggtcacgtgcattgcggtggggctgcccctgctgctcatctcgctggccttcgcgcaggagatctcgattggtacacagataagctgtttctctccaagttctttctcctggcgtcaggctgcctttgtggattcatattgctgggcggctgttcagcagaagaactcactgcagagcgagtctggaaacctcccactgtggctgcataagtttttcccctacatcctgctgctctttgcgatcctcctgtacctgcccccgctgttctggcgtttcgcagctgctcctcatatttgctcagacttgaagtttatcatggaagaacttgacaaagtttacaaccgtgcaattaaggctgcaaagagtgcgcgtgaccttgacatgagagatggagcctgctcagttccaggtgttaccgagaacttagggcaaagtttgtgggaggtatctgaaagccacttcaagtacccaattgtggagcagtacttgaagacaaagaaaaattctaataatttaatcatcaagtacattagctgccgcctgctgacactcatcattatactgttagcgtgtatctacctgggctattacttcagcctctcctcactctcagacgagtttgtgtgcagcatcaaatcagggatcctgagaaacgacagcaccgtgcccgatcagtttcagtgcaaactcattgccgtgggcatcttccagttgctcagtgtcattaaccttgtggtttatgtcctgctggctcccgtggttgtctacacgctgtttgttccattccgacagaagacagatgttctcaaagtgtacgaaatcctccccacttttgatgttctgcatttcaaatctgaagggtacaacgatttgagcctctacaatctcttcttggaggaaaatataagtgaggtcaagtcatacaagtgtcttaaggtactggagaatattaagagcagtggtcaggggatcgacccaatgctactcctgacaaaccttggcatgatcaagatggatgttgttgatggcaaaactcccatgtctgcagagatgagagaggagcaggggaaccagacggcagagctccaagacagtgaaactaaagcaaataatggagagaagaatgcccgacagagacttctggattcttcttgctgatgatttttttccttgagctgtaaatctgtgacttctgcgacatgggatttaatttggctaaagcacccctgttggtttcacagctggtttgcaataaatggttcttggtggagatactgagcatgtcttattgagtccctaatggaaatggtgatcaacaaaaggttatggaagaatggtttatgaacttcccataggaagcacctgagagatagtaaactgcagcaagtaactatgtgtaagtcctcatcaaatgaaaagcagaaagacaagaacaattagtcaagagcagtagccctgtcagagcctcggagcaatacctttctgtacccgtggtgagacaagacccagagctactggaaaacaagcactttggaagatttgttttgttttcatggaataataatatgtcagggtataatttaacgtgagtttcttatgtgcccttaaagactgttagacaagaaaagcattcactggctaataatccataggtcgacctatgtcctaagttaggtgtaaggtccgatgccttggcccacactcgagctctctttacattgttagttgtcaaccttggctgatggaaatcccgtaaccactatttgttgcactgtgccttgaagggcagcaggcccaagtgctgctctgactgaaaactgagttaacaagatgaaatctaaaggatattcacagtgacttcaattcaggaagaatgcttccaaaagagcccagtggggaaatctgacatcacagaagacattaattcagtcactttcaaagagtttgtctacaggcggtttctctgttatcaaaggcatttgaaataggattttacttaaacaataatggaacacaggagtatttaaagtgaagaacactttgcctgaatgtgatcagggcacataagtgacattggcatgcttcatatggcgtgcttggagccagaaaaacttagcggtttattttgtttatatttaagcacagctttaaaaaattcattatcgtttattcagtgtccgaattgaggccatttgggaagaaaattctagcactggtggagaattatagaataaagattataaatggttggataa

SEQ ID NO: 163582 - DNA, 2964 bp, Homo sapiens
  Payload ID: 12213
  Gene Symbol: PANX2
  Gene Name: pannexin 2
  Uniprot ID: Q96RD6
  ENST ID: ENST00000159647
  CDS Start-End: 1-1932
atgcaccacctcctggagcagtcggcggacatggcgaccgcgctgctggcgggagagaagctgcgggagctgatcctgccgggcgcgcaggacgacaaggcgggcgcgctggccgcgctgcttctgcagctgaagctggagctgccgttcgaccgggtggtcaccatcggcaccgtgctggtgcccatcctgctggtcaccctggtcttcaccaagaacttcgcagaggaacccatttactgttacaccccgcacaacttcacgcgcgaccaggcgctgtacgcccgcggctactgctggacggagctgcgggacgcgctgcccggcgtggacgccagcctgtggccgtcgctgtttgagcacaagttcctgccctacgcgctgctggccttcgccgccatcatgtacgtgcccgcgctgggctgggagttcctggcctccacgcgcctcacctccgagctcaacttcctgctgcaggagatcgacaactgttaccaccgggcggccgagggccgcgcgcccaagatcgagaagcagatccagtccaagggcccgggcatcacggagcgcgagaagcgcgagatcatcgagaacgcggagaaggagaagagcccggagcagaacctgttcgagaagtacctggagcgccgcggccgcagcaacttcctggccaagctgtacctggcgcggcacgtgctgatcctgctgctgagcgccgtgcccatctcctacctgtgcacctactacgccacgcagaagcagaacgagttcacctgcgcgctgggcgcgtccccggacggggcggcaggtgcggggcccgcggtgcgcgtgagctgcaagctcccgtccgtgcaactgcagcgcatcatcgcgggcgtggacatcgtgctgctgtgcgtcatgaacctcatcatcctcgtcaacctcatccacctcttcatcttccgcaagagcaacttcatcttcgacaagctgcacaaggtgggcatcaagacgcgccggcagtggcgccgctcgcagttctgcgacatcaacatcctggccatgttctgcaacgagaaccgcgaccacatcaagtcgctcaaccggctggacttcatcaccaacgagagcgacctcatgtacgacaacgtggtccggcagctgctggcggcgctggcgcagtccaaccacgacgccacccccacggtgcgcgactcgggggtgcagaccgtggaccccagcgccaaccccgccgagcccgacggcgccgccgagccgcccgtggtcaagcggccgcgcaagaagatgaagtggatccccaccagcaacccgcttccgcagcccttcaaggagccgctggccatcatgcgcgtggagaacagcaaggcggagaagccgaagcccgcgcgcaggaagacggccacggacacgctgatcgcgccgctgctggaccgctccgcccaccactacaagggcggagggggcgacccgggccccggccccgcccctgcccccgccccgccgcccgcccctgacaagaagcacgcgcgccacttctccctggacgtgcacccctacatcctcggcaccaagaaggccaaggccgaggcggtgcccgccgccctgcccgcctcccggagccaggaggggggcttcctgtcccaggcggaggactgtgggctaggcctggccccggcgcccatcaaagatgctccgctccccgagaaggaaatcccgtaccccacagagccagcccgggcagggcttccctcggggggcccgttccacgtccgctcacctcccgccgcccctgctgtggcccctctgacaccagccagcctgggcaaggcggagcccctcaccatcctgagccgaaacgccacacacccgctgctgcacatcaacacgctatcctcatcgccaccttcgacgagccgagaacggtcgtgagtactgtggagttttgagggatggcaccgtccaggccgccgagagcccctctgcctgtgtcgtgtggcctggccagcctcccggtggacaccagccctgcgtggacgtggcctgtgcttcgcccgcactgcgcgcatccccaacctctgtccgcatgcctggggccttcgcccccacgtgctcgacaggggaacccgcccggacggcatcgccaggcactggctggggtggggaaaggtggcccagtggagccggtggccaggaaggctgaagcccgcttcccatgctcctgcatcaggtgcccagccgtgggtgggggccctgaggtgaagagtttatttttttagtccgtttcgtcctggccccgggctgtggcgagacagcccaactcccccagcccagctcccccagcccagagccagggaagaggaaggtggggccagtcccaccagtggggtggccacgcccatggggtcacatgctcaggggtcaccccctgcagggacctgatgccctcgggtgggagggaccgaggtccaccctcgggtcaaaggtcaacgtgcactttctccttgtcgcctgacagacattttattttactaagactgctgtaccgaacaagcatatttatcatcaggagacaggatgggtttaaagcaggatggtgtgtgtgtgaacgggcatgagcagaggtgagcgtgagcgagcgggtgtgtatgtacgagtgtgcacgtgtgtgcgtgtgcacagagggtgtggtgccagcttgagtgggagtgtgtgagtgtgagcaggcgggcgagtgcgtgagtgcacgccagcgcgtggcccatgtatgaggagtgaaggggcccaacgcaataaccacgtcccccacccgggccccccgccgcggctgaggccacatggcttcctgtgggagccccggccggcacccggctggtcccaccccaaatacctcagccatggagaccatgtcatgcagaattaacaaggtagcaccgagcatatcaataaatattattctgataa

SEQ ID NO: 163583 - DNA, 3051 bp, Homo sapiens
  Payload ID: 12213
  Gene Symbol: PANX2
  Gene Name: pannexin 2
  Uniprot ID: Q96RD6
  ENST ID: ENST00000395842
  CDS Start-End: 1-2034
atgcaccacctcctggagcagtcggcggacatggcgaccgcgctgctggcgggagagaagctgcgggagctgatcctgccgggcgcgcaggacgacaaggcgggcgcgctggccgcgctgcttctgcagctgaagctggagctgccgttcgaccgggtggtcaccatcggcaccgtgctggtgcccatcctgctggtcaccctggtcttcaccaagaacttcgcagaggaacccatttactgttacaccccgcacaacttcacgcgcgaccaggcgctgtacgcccgcggctactgctggacggagctgcgggacgcgctgcccggcgtggacgccagcctgtggccgtcgctgtttgagcacaagttcctgccctacgcgctgctggccttcgccgccatcatgtacgtgcccgcgctgggctgggagttcctggcctccacgcgcctcacctccgagctcaacttcctgctgcaggagatcgacaactgttaccaccgggcggccgagggccgcgcgcccaagatcgagaagcagatccagtccaagggcccgggcatcacggagcgcgagaagcgcgagatcatcgagaacgcggagaaggagaagagcccggagcagaacctgttcgagaagtacctggagcgccgcggccgcagcaacttcctggccaagctgtacctggcgcggcacgtgctgatcctgctgctgagcgccgtgcccatctcctacctgtgcacctactacgccacgcagaagcagaacgagttcacctgcgcgctgggcgcgtccccggacggggcggcaggtgcggggcccgcggtgcgcgtgagctgcaagctcccgtccgtgcaactgcagcgcatcatcgcgggcgtggacatcgtgctgctgtgcgtcatgaacctcatcatcctcgtcaacctcatccacctcttcatcttccgcaagagcaacttcatcttcgacaagctgcacaaggtgggcatcaagacgcgccggcagtggcgccgctcgcagttctgcgacatcaacatcctggccatgttctgcaacgagaaccgcgaccacatcaagtcgctcaaccggctggacttcatcaccaacgagagcgacctcatgtacgacaacgtggtccggcagctgctggcggcgctggcgcagtccaaccacgacgccacccccacggtgcgcgactcgggggtgcagaccgtggaccccagcgccaaccccgccgagcccgacggcgccgccgagccgcccgtggtcaagcggccgcgcaagaagatgaagtggatccccaccagcaacccgcttccgcagcccttcaaggagccgctggccatcatgcgcgtggagaacagcaaggcggagaagccgaagcccgcgcgcaggaagacggccacggacacgctgatcgcgccgctgctggaccgctccgcccaccactacaagggcggagggggcgacccgggccccggccccgcccctgcccccgccccgccgcccgcccctgacaagaagcacgcgcgccacttctccctggacgtgcacccctacatcctcggcaccaagaaggccaaggccgaggcggtgcccgccgccctgcccgcctcccggagccaggaggggggcttcctgtcccaggcggaggactgtgggctaggcctggccccggcgcccatcaaagatgctccgctccccgagaaggaaatcccgtaccccacagagccagcccgggcagggcttccctcggggggcccgttccacgtccgctcacctcccgccgcccctgctgtggcccctctgacaccagccagcctgggcaaggcggagcccctcaccatcctgagccgaaacgccacacacccgctgctgcacatcaacacgctgtacgaggcccgggaggaggaggacgggggcccccgcctgccgcaggacgtgggggacctcatcgccatccctgccccacagcagatcctcatcgccaccttcgacgagccgagaacggtcgtgagtactgtggagttttgagggatggcaccgtccaggccgccgagagcccctctgcctgtgtcgtgtggcctggccagcctcccggtggacaccagccctgcgtggacgtggcctgtgcttcgcccgcactgcgcgcatccccaacctctgtccgcatgcctggggccttcgcccccacgtgctcgacaggggaacccgcccggacggcatcgccaggcactggctggggtggggaaaggtggcccagtggagccggtggccaggaaggctgaagcccgcttcccatgctcctgcatcaggtgcccagccgtgggtgggggccctgaggtgaagagtttatttttttagtccgtttcgtcctggccccgggctgtggcgagacagcccaactcccccagcccagctcccccagcccagagccagggaagaggaaggtggggccagtcccaccagtggggtggccacgcccatggggtcacatgctcaggggtcaccccctgcagggacctgatgccctcgggtgggagggaccgaggtccaccctcgggtcaaaggtcaacgtgcactttctccttgtcgcctgacagacattttattttactaagactgctgtaccgaacaagcatatttatcatcaggagacaggatgggtttaaagcaggatggtgtgtgtgtgaacgggcatgagcagaggtgagcgtgagcgagcgggtgtgtatgtacgagtgtgcacgtgtgtgcgtgtgcacagagggtgtggtgccagcttgagtgggagtgtgtgagtgtgagcaggcgggcgagtgcgtgagtgcacgccagcgcgtggcccatgtatgaggagtgaaggggcccaacgcaataaccacgtcccccacccgggccccccgccgcggctgaggccacatggcttcctgtgggagccccggccggcacccggctggtcccaccccaaatacctcagccatggagaccatgtcatgcagaattaacaaggtagcaccgagcatatcaataaatattattctgataatc

SEQ ID NO: 163584 - DNA, 2291 bp, Homo sapiens
  Payload ID: 12213
  Gene Symbol: PANX2
  Gene Name: pannexin 2
  ENST ID: ENST00000402472
  CDS Start-End: 1-234
atggcgaccgcgctgctggcgggagagaagctgcgggagctgatcctgccgggcgcgcaggacgacaaggcgggcgcgctggccgcgctgcttctgcagctgaagctggagctgccgttcgaccgggtggtcaccatcggcaccgtgctggtgcccatcctgctggtcaccctggtcttcaccaagaacttcgcagggtggacgctcttctctggctcctgggattggctgtgaggacaaaacataaaggaacccatttactgttacaccccgcacaacttcacgcgcgaccaggcgctgtacgcccgcggctactgctggacggagctgcgggacgcgctgcccggcgtggacgccagcctgtggccgtcgctgtttgagcacaagttcctgccctacgcgctgctggccttcgccgccatcatgtacgtgcccgcgctgggctgggagttcctggcctccacgcgcctcacctccgagctcaacttcctgctgcaggagatcgacaactgttaccaccgggcggccgagggccgcgcgcccaagatcgagaagcagatccagtccaagggcccgggcatcacggagcgcgagaagcgcgagatcatcgagaacgcggagaaggagaagagcccggagcagaacctgttcgagaagtacctggagcgccgcggccgcagcaacttcctggccaagctgtacctggcgcggcacgtgctgatcctgctgctgagcgccgtgcccatctcctacctgtgcacctactacgccacgcagaagcagaacgagttcacctgcgcgctgggcgcgtccccggacggggcggcaggtgcggggcccgcggtgcgcgtgagctgcaagctcccgtccgtgcaactgcagcgcatcatcgcgggcgtggacatcgtgctgctgtgcgtcatgaacctcatcatcctcgtcaacctcatccacctcttcatcttccgcaagagcaacttcatcttcgacaagctgcacaaggtgggcatcaagacgcgccggcagtggcgccgctcgcagttctgcgacatcaacatcctggccatgttctgcaacgagaaccgcgaccacatcaagtcgctcaaccggctggacttcatcaccaacgagagcgacctcatgtacgacaacgtggtccggcagctgctggcggcgctggcgcagtccaaccacgacgccacccccacggtgcgcgactcgggggtgcagaccgtggaccccagcgccaaccccgccgagcccgacggcgccgccgagccgcccgtggtcaagcggccgcgcaagaagatgaagtggatccccaccagcaacccgcttccgcagcccttcaaggagccgctggccatcatgcgcgtggagaacagcaaggcggagaagccgaagcccgcgcgcaggaagacggccacggacacgctgatcgcgccgctgctggaccgctccgcccaccactacaagggcggagggggcgacccgggccccggccccgcccctgcccccgccccgccgcccgcccctgacaagaagcacgcgcgccacttctccctggacgtgcacccctacatcctcggcaccaagaaggccaaggccgaggcggtgcccgccgccctgcccgcctcccggagccaggaggggggcttcctgtcccaggcggaggactgtgggctaggcctggccccggcgcccatcaaagatgctccgctccccgagaaggaaatcccgtaccccacagagccagcccgggcagggcttccctcggggggcccgttccacgtccgctcacctcccgccgcccctgctgtggcccctctgacaccagccagcctgggcaaggcggagcccctcaccatcctgagccgaaacgccacacacccgctgctgcacatcaacacgctatcctcatcgccaccttcgacgagccgagaacggtcgtgagtactgtggagttttgagggatggcaccgtccaggccgccgagagcccctctgcctgtgtcgtgtggcctggccagcctcccggtggacaccagccctgcgtggacgtggcctgtgcttcgcccgcactgcgcgcatccccaacctctgtccgcatgcctggggccttcgcccccacgtgctcgacaggggaacccgcccggacggcatcgccaggcactggctggggtggggaaaggtggcccagtggagccggtggccaggaaggctgaagcccgcttcccatgctcctgcatcaggtgcccagccgtgggtgggggccctgaggtgaagagttta

SEQ ID NO: 163585 - DNA, 1667 bp, Homo sapiens
  Payload ID: 12214
  Gene Symbol: PANX3
  Gene Name: pannexin 3
  Uniprot ID: Q96QZ0
  ENST ID: ENST00000284288
  CDS Start-End: 68-1246
ccgtctcctcattccaccatcccaggacccctgctgccacctctgcacccccaagctcagcagcatcatgtcacttgcacacacagctgcagagtacatgctctcagatgccctgctgcctgaccgcaggggaccccgcctcaaaggactgcgtctggaactgcccctggaccggatagtcaagttcgtagctgtgggctcccccttgttgctgatgtccctggcattcgcccaggagttctcctctgggtctccgatcagctgcttctctcccagtaacttcagcatccggcaggcagcctacgtggacagctcctgctgggactcactgcttcaccataagcaggacgggcctggccaggacaaaatgaaatctctctggccccacaaggccctcccctactccctgctggccctggccttgctcatgtacctgccggtgctgctgtggcagtatgcagctgtgccagccctcagctccgatctgctgttcatcatcagcgaactggacaaatcttataatcgctccatccgcctcgtgcagcacatgctgaagatccggcagaagagttccgacccctatgtgttctggaatgagctggagaaggctcggaaagaacgatactttgaattccctttgctagagcggtacctggcatgtaagcagcgttcacattcgctagtggctacctacctcctgaggaactccctcttgctcatcttcacctccgccacttacctataccttggtcatttccatctggatgtcttcttccaggaagaattcagctgctccatcaagacagggctgctaagtgatgagacccatgtccccaatctgatcacatgcaggctgacatcactgtccattttccagattgttagcctctccagtgtagcaatatacaccatattggttccagtgataatatacaacctcacacggctatgtcggtgggacaaacgacttttatctgtctatgagatgctcccagcttttgatctcctcagcagaaagatgctaggatgtcccatcaatgacctcaatgtgatccttcttttcctccgagctaacatctctgagctcatctcttttagctggctgagtgtcttatgtgtgttgaaggatacaaccacccagaagcacaatattgacacagtagttgattttatgactttattggctggcttagaaccctcaaaacccaaacacctcaccaactcggcatgtgatgaacacccatagttaagaaaccatggagcaagaaagcttgtggaaagtctctctccttcctcataagacatgcacactaatacacatacacaccaaaaaattacacattttaaaactgctaagcttggatttaactgaatcatatatcttttatcatgttatcctaaaagtgagaagacataaccaagacatggaaataaatgtgaaagctggagccgaagagtcaaagagctaaaaaattaagtctagaacattctatgaggatagtataaataaaaagaaatacagtctagacatgctgcaaggaaagaagattctaaagtccgtttatggaggcaattccatatcctttcttgaacgcacattcagcttaccccagagagcaagtgaggcaatctggcaaaagattaataaagatgtaaacccctggaaa

SEQ ID NO: 163586 - DNA, 6976 bp, Homo sapiens
  Payload ID: 12215
  Gene Symbol: PANK1
  Gene Name: pantothenate kinase 1
  Uniprot ID: Q8TE04
  ENST ID: ENST00000307534
  CDS Start-End: 271-2067
accaaacgcacaggcacacacgcgcgcgcgcgtaagcacacactcacaaagcggggagggtaacgtgaatgaccttgcaaaggtatcttgctcactggggacaggattagcaaacctgacacctctgcaaataattgtcttcctcccgtattcctcctgaaacggttcgctcctttcgctgtctctcccagacccatctggttttcacatcgccatacaaagcccaacccgcccatctcctctctgcaagcccagagaacttgattccccatgttgaaactcgtcggtggcggtggcgggcaggactgggcatgctcagtggcggggaccagtctgggaggcgaggaagccgcgtttgaagtcgcgcggcctggggatcaggggaaggcgggcggcgggagccccggctgggggtgcgcggggatccccgattccgcgcccggggctggcgtgctccaggccggcgccgtggggccggcgcgcggggggcagggcgcagaggaggtgggggagtcggcaggaggaggggaggagcgccgggttcgccatccccaggcgccggctctgcggctgctgaatcggaagccgcagggaggatccggggaaataaagacgccggagaatgacctccagcgaggccgcctgagccggggcccgcgcacagccccgccagcccccggcatgggcgaccgcagcgggcagcaggagcgctcggtcccgcactctccaggggcccccgtgggcaccagcgccgccgctgtgaacgggctgctgcacaacggcttccatccgccgccagtccagccgccgcacgtctgcagccggggtccagtgggcggcagcgacgcggcgccccagcgcctcccgctcctgccggagctgcagccgcagccactgctccctcagcatgactccccggccaagaaatgccggctgcggaggaggatggactcggggagaaagaacaggccgccattcccatggtttggcatggacatcggtggaacgctggttaaattggtgtatttcgagccgaaggatattacagccgaagaggagcaagaggaagtggagaacctgaagagcatccggaagtatttgacttctaatactgcttatgggaaaactgggatccgagacgtccacctggaactgaaaaacctgaccatgtgtggacgcaaagggaacctgcacttcatccgctttcccagctgtgctatgcacaggttcattcagatgggcagcgagaagaacttctctagccttcacaccaccctctgtgccacaggaggcggggctttcaaattcgaagaggacttcagaatgattgctgacctgcagctgcataaactggatgaactggactgtctgattcagggcctgctttatgtcgactctgttggcttcaacggcaagccagaatgttactattttgaaaatcccacaaatcctgaattgtgtcaaaaaaagccgtactgccttgataacccataccctatgttgctggttaacatgggctcaggtgtcagcattctagccgtgtactccaaggacaactataaaagagttacagggaccagtcttggaggtggaacattcctaggcctatgttgcttgctgactggttgtgagacctttgaagaagctctggaaatggcagctaaaggcgacagcaccaatgttgataaactggtgaaggacatttacggaggagactatgaacgatttggccttcaaggatctgctgtagcatcaagctttggcaacatgatgagtaaagaaaagcgagattccatcagcaaggaagacctcgcccgggccacattggtcaccatcaccaacaacattggctccattgctcggatgtgcgcgttgaatgagaacatagacagagttgtgtttgttggaaattttctcagaatcaatatggtctccatgaagctgctggcatatgccatggatttttggtccaaaggacaactgaaagctctgtttttggaacatgagggttattttggagccgttggggcactgttggaactgttcaaaatgactgatgacaagtagagacgagcagtggaggaaacagcctcccaaaaggacagagaactaaaaaattgctgctggagaaggtgaaagtcgctttgggacggaagccaagccattatggcagatgaacctgctggatttgtaaataatttaaaatccttccagatgatcttttactcttaggttttgagctaatgattcaaaacgggggaatataaaaggttttttttctgtatactgtatttttttaaaaaaatggtgcagcgtggccaaacctaccaattgtatgcattaactttgaaaagttgtttgatgtttaagaaggacctgatatgtaagcgctggtcatttttcttctggggtttactgatcagtgtggtgattttaacttcatttagtaattactctaggagattttaccttgacttatatttttcatgacgtttcatgatttgctgttggtttcaaatgaaactacaaatctggcatgttttactgtgaacacttttgttatttgttttgtacccttttttgtcttgtttttctgttttagttgtcttctgaaaaaagagtcgttccctctgtttctgtcctcagatgatgtccctccccctacctgtaacctttctttgacataattgttcatatcaatgaaggtgctgaccagctcaatacaaagttaagcacaagatctaaagctcttgaaaatgcccgtgaagagaagactgaatgtgttaatgaatttaatgagtctggcaaaagttgcaaattatatgcaagtttgtcctatcgcttataaatgtagtgtttcattggatttattttatgctaggttatattaagttgaaatagtctgtgattaaatgtcctcatccatgcacagaatatgaatggcagcaaatctttgtgcaagaaatttgaaacttattgggaaaagcctcccagtagattaattgttcatatcaggagatttagggtaagtcatgggttgaggtgtcagatagtaatatctatttgttttgtacatgtatatatctaggaactttgtaacaacacatctttaataatgttaaaggttttttcatttttaatattttaaactaaaaactgtacttcaatctcagtttctaaaattaaaaataatttatactgatctatatattttttctttttgaaagatttcattaagactgatgggtaactttcaaatgagggtcatgtacaaatattgggatgcatgagatcccatgatcttgtgtattgagcttattgttgaaagggatttttgaaggacagaacaattactccatgatgaatcttcctttctctgccttctgagcaccgtctttaatttccatatcttcaagtcttgaagaagttgatgttaattgaagaattcacttgtctggttgaaataaagcctgtttctgttgtgatgtttttagtgtatatgttattttcatttcttaattctcatgtttatagtatctgctttgtaccatgaaatgactgtctgttgtgtttttgctactctacatttcaaaattggaggctttcccatgagtgtggtatggtccaaaacactgtcttcaggtgaagctgtagccctatgcatagatttttaaaatagagctttattgtttctatacaagtgactccttaatgccaactacctctgctatatttggtaattccaaaggagtttcaaaatttggtcatcacagatacattttaccaacttctatctggctttaaaaaaattcagacagctaaagtgttcttgaaaaggataagttaaaaatctacatattatttataattagtgccttttgatggcctcttctattcctattctcatctatcaggtaacagcagaccttgattccgcagatcatggttctacaaaggaaatcagggcaagttagtgtgactgtattttttttaattatctgaaatcacttgatctctcattacaaacatttaaaatattggtgtagctgagaaaatacattattccattatacaaatatcagttaaatgttgactacatatagccagcctgttttttacaaaagagatcttgtagcctgaggattttcacattcacttgaattacagaaacttttcttagaatcaacatcacaaagaaactgggaagactaaagaattttgaccttgtgcaatatgaagtaagagcatggctttttatcgtgaggcagcttcagtctgggtccagcttagtcagttaccagttcaaagatatgctaagcctctttctaaaccatagtttcctcacctataaaatgggacaaataattgttttacatacatatttaaagagctcagcacaggggttgacacaaagtaaatgcttcattaatgatagctacaatgaaaaaataaattatttaaactaatttattaaatcagtaattcttaactttctggattgtgggaaacccatgttagtatggagatgtttcaccaatctccgtatgctaatacatatccacagctccttgtccacacttccaaaatcccatacttaagaaatctatcttgacagctcacttggcagcaaaagctgacttgagcattatttctcacatgtagtagggctcttcacatgttttgttgcaaagctcgtcatgagttagataacaggatactgactctgacaggggtgttaagtaataaacgattttgaattggctgggtgtggtggctcacgcctgtaatcccagcactttgggaggccgaggcaggcggatcatgaggtcaggagatcgagaccatcctggctaatacggtgaaaccccgtctctactgaaaatacaaaaagctaggcatggtggtgggcacctgtagtcccagctacttgggaggctgaggcgggagaatggcgtgaacctgggaggcagagcttgcggtgagccgagatcacaccaatgcactccagcctgggagacagagtgagactgtctcaaaaaaataaaataaataaataaataaatgattctgaattttgaaacacatctgatcccgagttttagacaaagggattgtggaaatatagttgtgttcttcaccttatgcagtatacatggattcagagtctctttgttgggaacaattgttataggtaatgtatacttgatgtcgttcagtcatagaaggaatattaagaagttactctgtgccaggaaggaactggagactaagatgcataggatacagcccctgcagagaaagacagcaaaatctcaagccaacatcagtcatcaagtgccacaagtgccattcaatcatttattcattcacattcacagcagtaaacagaacaaagatccaccatcacagagcttatattctagaagggaagacaggtacattactaaatatataatgttagatcagtactacaaagaaaaagtaagctggtgtaaaggctaaataaggggtagttctattcagaaaaatgagaaggggaggaatatctcagggtggtctaagacagcctttcctaggaagtgacctttgagcagagagttgaatggaggtgagaacacattgtgtaaatgtctgagaaaatatttttcactcctggcaaatgaaaatagggatttgaggaactgcaaagaggccagtgtctggagttaaaaatagaaagtggtgggagatgcagtgttgggagtaaacttgagccaggtcctataagaaatctgtgagggtagtggcctctacccagaagagaggttggtcatttgtcttccagaaggtgctagagaaggttttgtgaagtcttaaccaaagaataggaatcactaagtggagaggaagggagggctttccaagcagagggagctgggtgagcagaagcgctgagggaagaaaccacttggcttattcagggactggaagctctttgctatagctggagcctggttcatgagacagaaaccaggtagtgagaaagaggaagctggcccaactgtggaaggacttgtcttccatgctaacattgcggacttttccgtagtcactgtggagccatcaaagagtttcaaggaaagtgaaactagaaataatcaggtttcaaagtggtaaagcaaaatgctctgttgaagtaaatgagtaaacaagttacgtacttttgaatacctaacattattccatttttttccctattgtgccagacctcatgcagtagctacagagtgaaccatgctttcgctgtaagtaggatggctataaaaattattgagaactttctcagaggacacaggctactaatagctacagccccactatgagtctattcattgagcaagaaggtttcaatactgggagcatcgtaaactatcactcacaagaattgttagaaagcagttttcctcccagtgatcagaagatgacgccacatttgtgaaaaagatttcattagtgtacatcgtttattaggtctaccagctgcccattcttttgctcatctgtttaatttttaataaatatcaatgatctgagaggcattgggtagcactgaggatgcaatccgatgtgaacaagacttcaggagctctgctttcattaggcttacatttggttaatggagataaacttgaagcatataaaccaataaataaacaagaaaatatcagggagtgacaattgctattaaggaaagaaacagggtgataggatagagagggaggagagagacttcttcagtcagatgatcataaaatgcaagtatgattaagtcatggcctcaacttttaaggaatgatgggctcaccttgctttcattcttgccacctcctcaatgaaaatgaaagatgtttttgggaaactgatagctaattttctttttcttagaatatttgatttagataatatgtatttaaaataaagttatcacgtaaaataa

SEQ ID NO: 163587 - DNA, 2513 bp, Homo sapiens
  Payload ID: 12215
  Gene Symbol: PANK1
  Gene Name: pantothenate kinase 1
  Uniprot ID: Q8TE04
  ENST ID: ENST00000322191
  CDS Start-End: 151-1095
cacaatctaaagcttgtatatataatggtagtttgtaaagtgtaccttccccacaggacgctgtgggatgtaaatttgtaggtcgagtttacagctggtttttcttgactgaagctcattcaactggttacttctttgtgggtgtctttaatgaagcttataaatggcaaaaagcaaacattcccatggtttggcatggacatcggtggaacgctggttaaattggtgtatttcgagccgaaggatattacagccgaagaggagcaagaggaagtggagaacctgaagagcatccggaagtatttgacttctaatactgcttatgggaaaactgggatccgagacgtccacctggaactgaaaaacctgaccatgtgtggacgcaaagggaacctgcacttcatccgctttcccagctgtgctatgcacaggttcattcagatgggcagcgagaagaacttctctagccttcacaccaccctctgtgccacaggaggcggggctttcaaattcgaagaggacttcagaatgattgctgacctgcagctgcataaactggatgaactggactgtctgattcagggcctgctttatgtcgactctgttggcttcaacggcaagccagaatgttactattttgaaaatcccacaaatcctgaattgtgtcaaaaaaagccgtactgccttgataacccataccctatgttgctggttaacatgggctcaggtgtcagcattctagccgtgtactccaaggacaactataaaagagttacagggaccagctttggcaacatgatgagtaaagaaaagcgagattccatcagcaaggaagacctcgcccgggccacattggtcaccatcaccaacaacattggctccattgctcggatgtgcgcgttgaatgagaacatagacagagttgtgtttgttggaaattttctcagaatcaatatggtctccatgaagctgctggcatatgccatggatttttggtccaaaggacaactgaaagctctgtttttggaacatgagggttattttggagccgttggggcactgttggaactgttcaaaatgactgatgacaagtagagacgagcagtggaggaaacagcctcccaaaaggacagagaactaaaaaattgctgctggagaaggtgaaagtcgctttgggacggaagccaagccattatggcagatgaacctgctggatttgtaaataatttaaaatccttccagatgatcttttactcttaggttttgagctaatgattcaaaacgggggaatataaaaggttttttttctgtatactgtatttttttaaaaaaatggtgcagcgtggccaaacctaccaattgtatgcattaactttgaaaagttgtttgatgtttaagaaggacctgatatgtaagcgctggtcatttttcttctggggtttactgatcagtgtggtgattttaacttcatttagtaattactctaggagattttaccttgacttatatttttcatgacgtttcatgatttgctgttggtttcaaatgaaactacaaatctggcatgttttactgtgaacacttttgttatttgttttgtacccttttttgtcttgtttttctgttttagttgtcttctgaaaaaagagtcgttccctctgtttctgtcctcagatgatgtccctccccctacctgtaacctttctttgacataattgttcatatcaatgaaggtgctgaccagctcaatacaaagttaagcacaagatctaaagctcttgaaaatgcccgtgaagagaagactgaatgtgttaatgaatttaatgagtctggcaaaagttgcaaattatatgcaagtttgtcctatcgcttataaatgtagtgtttcattggatttattttatgctaggttatattaagttgaaatagtctgtgattaaatgtcctcatccatgcacagaatatgaatggcagcaaatctttgtgcaagaaatttgaaacttattgggaaaagcctcccagtagattaattgttcatatcaggagatttagggtaagtcatgggttgaggtgtcagatagtaatatctatttgttttgtacatgtatatatctaggaactttgtaacaacacatctttaataatgttaaaggttttttcatttttaatattttaaactaaaaactgtacttcaatctcagtttctaaaattaaaaataatttatactgatctatatattttttctttttgaaagatttcattaagactgatgggtaactttcaaatgagggtcatgtacaaatattgggatgcatgagatcccatgatcttgtgtattgagcttattgttgaaagggatttttgaaggacagaacaattactccatgatgaatcttcctttctctgccttctgagcaccgtctttaatttccatatcttcaagtcttgaagaagttgatgttaattgaagaattcacttgtctggttgaaataaagcctgtttctgttgtga

SEQ ID NO: 163588 - DNA, 2703 bp, Homo sapiens
  Payload ID: 12215
  Gene Symbol: PANK1
  Gene Name: pantothenate kinase 1
  Uniprot ID: Q8TE04
  ENST ID: ENST00000342512
  CDS Start-End: 164-1285
aagtgcattatttcacaatctaaagcttgtatatataatggtagtttgtaaagtgtaccttccccacaggacgctgtgggatgtaaatttgtaggtcgagtttacagctggtttttcttgactgaagctcattcaactggttacttctttgtgggtgtctttaatgaagcttataaatggcaaaaagcaaacattcccatggtttggcatggacatcggtggaacgctggttaaattggtgtatttcgagccgaaggatattacagccgaagaggagcaagaggaagtggagaacctgaagagcatccggaagtatttgacttctaatactgcttatgggaaaactgggatccgagacgtccacctggaactgaaaaacctgaccatgtgtggacgcaaagggaacctgcacttcatccgctttcccagctgtgctatgcacaggttcattcagatgggcagcgagaagaacttctctagccttcacaccaccctctgtgccacaggaggcggggctttcaaattcgaagaggacttcagaatgattgctgacctgcagctgcataaactggatgaactggactgtctgattcagggcctgctttatgtcgactctgttggcttcaacggcaagccagaatgttactattttgaaaatcccacaaatcctgaattgtgtcaaaaaaagccgtactgccttgataacccataccctatgttgctggttaacatgggctcaggtgtcagcattctagccgtgtactccaaggacaactataaaagagttacagggaccagtcttggaggtggaacattcctaggcctatgttgcttgctgactggttgtgagacctttgaagaagctctggaaatggcagctaaaggcgacagcaccaatgttgataaactggtgaaggacatttacggaggagactatgaacgatttggccttcaaggatctgctgtagcatcaagctttggcaacatgatgagtaaagaaaagcgagattccatcagcaaggaagacctcgcccgggccacattggtcaccatcaccaacaacattggctccattgctcggatgtgcgcgttgaatgagaacatagacagagttgtgtttgttggaaattttctcagaatcaatatggtctccatgaagctgctggcatatgccatggatttttggtccaaaggacaactgaaagctctgtttttggaacatgagggttattttggagccgttggggcactgttggaactgttcaaaatgactgatgacaagtagagacgagcagtggaggaaacagcctcccaaaaggacagagaactaaaaaattgctgctggagaaggtgaaagtcgctttgggacggaagccaagccattatggcagatgaacctgctggatttgtaaataatttaaaatccttccagatgatcttttactcttaggttttgagctaatgattcaaaacgggggaatataaaaggttttttttctgtatactgtatttttttaaaaaaatggtgcagcgtggccaaacctaccaattgtatgcattaactttgaaaagttgtttgatgtttaagaaggacctgatatgtaagcgctggtcatttttcttctggggtttactgatcagtgtggtgattttaacttcatttagtaattactctaggagattttaccttgacttatatttttcatgacgtttcatgatttgctgttggtttcaaatgaaactacaaatctggcatgttttactgtgaacacttttgttatttgttttgtacccttttttgtcttgtttttctgttttagttgtcttctgaaaaaagagtcgttccctctgtttctgtcctcagatgatgtccctccccctacctgtaacctttctttgacataattgttcatatcaatgaaggtgctgaccagctcaatacaaagttaagcacaagatctaaagctcttgaaaatgcccgtgaagagaagactgaatgtgttaatgaatttaatgagtctggcaaaagttgcaaattatatgcaagtttgtcctatcgcttataaatgtagtgtttcattggatttattttatgctaggttatattaagttgaaatagtctgtgattaaatgtcctcatccatgcacagaatatgaatggcagcaaatctttgtgcaagaaatttgaaacttattgggaaaagcctcccagtagattaattgttcatatcaggagatttagggtaagtcatgggttgaggtgtcagatagtaatatctatttgttttgtacatgtatatatctaggaactttgtaacaacacatctttaataatgttaaaggttttttcatttttaatattttaaactaaaaactgtacttcaatctcagtttctaaaattaaaaataatttatactgatctatatattttttctttttgaaagatttcattaagactgatgggtaactttcaaatgagggtcatgtacaaatattgggatgcatgagatcccatgatcttgtgtattgagcttattgttgaaagggatttttgaaggacagaacaattactccatgatgaatcttcctttctctgccttctgagcaccgtctttaatttccatatcttcaagtcttgaagaagttgatgttaattgaagaattcacttgtctggttgaaataaagcctgtttctgttgtga

SEQ ID NO: 163589 - DNA, 2280 bp, Homo sapiens
  Payload ID: 12216
  Gene Symbol: PANK2
  Gene Name: pantothenate kinase 2
  Uniprot ID: Q9BZ23
  ENST ID: ENST00000316562
  CDS Start-End: 7-1719
gggtggatgaggaggctcgggcccttccacccacgcgtccattgggcggcgccgccatcactctcttctgggctacaccgccttctcttcctccgcggaacccggatcccctcctccaccaccctctccccgccccgtcacgatagcctctcattggacggaggcacggtcaatcctcctcgagttagggagccgactggacgcgaggcctttgggccgtccccagcctcgtcggattggcttcctgcgcgttggcgcaacggaagaggcggccggccgagggcgcgcctctgctctggctggactgccgcggaggaggcgagaaggaatccgacgctggggggcttgctcgggcggcagcgactgctgctgcggatgggagggggccggctcggcgcgcccatggagcgccacggcagggcttccgccacctccgtctcgtcggctggggagcaggcggccggggaccccgaagggcggcggcaggagccactgcggcgccgggcgagcagcgcgtcggtgcccgcggtcggggcctcggctgagggcacgaggcgggatcgactgggctcttacagcggccccacctcggtctcccgccagcgcgtcgaaagcctgaggaaaaagcggccgctttttccatggtttggactggatatcggtggaactctggtcaagctggtatattttgaacccaaagacatcactgctgaagaagaagaggaagaagtggaaagtcttaaaagcattcggaagtacctgacctccaatgtggcttatgggtctacaggcattcgggacgtgcacctcgagctgaaggacctgactctgtgtggacgcaaaggcaatctgcactttatacgctttcccactcatgacatgcctgcttttattcaaatgggcagagataaaaacttctcgagtctccacactgtcttttgtgccactggaggtggagcgtacaaatttgagcaggattttctcacaataggtgatcttcagctttgcaaactggatgaactagattgcttgatcaaaggaattttatacattgactcagtcggattcaatggacggtcacagtgctattactttgaaaaccctgctgattctgaaaagtgtcagaagttaccatttgatttgaaaaatccgtatcctctgcttctggtgaacattggctcaggggttagcatcttagcagtatattccaaagataattacaaacgggtcacaggtactagtcttggaggaggaactttttttggtctctgctgtcttcttactggctgtaccacttttgaagaagctcttgaaatggcatctcgtggagatagcaccaaagtggataaactagtacgagatatttatggaggggactatgagaggtttggactgccaggctgggctgtggcttcaagctttggaaacatgatgagcaaggagaagcgagaggctgtcagtaaagaggacctggccagagcgactttgatcaccatcaccaacaacattggctcaatagcaagaatgtgtgcccttaatgaaaacattaaccaggtggtatttgttggaaatttcttgagaattaatacgatcgccatgcggcttttggcatatgctttggattattggtccaaggggcagttgaaagcacttttttcggaacacgagggttattttggagctgttggagcactccttgagctgttgaagatcccgtgatcattacctggggaggggttcctgaaaccttccacaatgggatctgtggactttcatttttttaagagacttactcaatttcatgactgtactacctgaaacaaagtgagaaaggacaggtgtatttttctaagtcatcaagataaatccttaagaattcagtctaaattagcaaccaggaaggaaaaatatattaaaaacaacaaaaaagtggcacatgtccaggcagtgtgaggatttgctgtatataagttgcctgctttgtatttttgaaatctctgcatcactcattggaagtgcttctgaagagagctgctctgtgttcagttgactggttttgtgtcctgtttgaacttgctgaatgtaaggcaggctactatgcgttataatctaatcacaatttgtcaatatggtcttggcaatcatctgtgcattactctggtttgcattaagcctgtgtgtgaacttactgtaaaacatgttttatttcaaggttctgcaaaattaattgggcaggttaattgtgtacctgaaacttaacaagcagtttttggaagggca

SEQ ID NO: 163590 - DNA, 4815 bp, Homo sapiens
  Payload ID: 12216
  Gene Symbol: PANK2
  Gene Name: pantothenate kinase 2
  Uniprot ID: Q9BZ23
  ENST ID: ENST00000497424
  CDS Start-End: 312-1151
atgctgggggaggggctggcggcctcgacggcagctgcggaactaggccgagggacaaaggctaagtttttccatggtttggactggatatcggtggaactctggtcaagctggtatattttgaacccaaagacatcactgctgaagaagaagaggaagaagtggaaagtcttaaaagcattcggaagtacctgacctccaatgtggcttatgggtctacaggcattcgggacgtgcacctcgagctgaaggacctgactctgtgtggacgcaaaggcaatctgcactttatacgctttcccactcatgacatgcctgcttttattcaaatgggcagagataaaaacttctcgagtctccacactgtcttttgtgccactggaggtggagcgtacaaatttgagcaggattttctcacaataggtgatcttcagctttgcaaactggatgaactagattgcttgatcaaaggaattttatacattgactcagtcggattcaatggacggtcacagtgctattactttgaaaaccctgctgattctgaaaagtgtcagaagttaccatttgatttgaaaaatccgtatcctctgcttctggtgaacattggctcaggggttagcatcttagcagtatattccaaagataattacaaacgggtcacaggtactagtcttggaggaggaactttttttggtctctgctgtcttcttactggctgtaccacttttgaagaagctcttgaaatggcatctcgtggagatagcaccaaagtggataaactagtacgagatatttatggaggggactatgagaggtttggactgccaggctgggctgtggcttcaagctttggaaacatgatgagcaaggagaagcgagaggctgtcagtaaagaggacctggccagagcgactttgatcaccatcaccaacaacattggctcaatagcaagaatgtgtgcccttaatgaaaacattaaccaggtggtatttgttggaaatttcttgagaattaatacgatcgccatgcggcttttggcatatgctttggattattggtccaaggggcagttgaaagcacttttttcggaacacgagggttattttggagctgttggagcactccttgagctgttgaagatcccgtgatcattacctggggaggggttcctgaaaccttccacaatgggatctgtggactttcatttttttaagagacttactcaatttcatgactgtactacctgaaacaaagtgagaaaggacaggtgtatttttctaagtcatcaagataaatccttaagaattcagtctaaattagcaaccaggaaggaaaaatatattaaaaacaacaaaaaagtggcacatgtccaggcagtgtgaggatttgctgtatataagttgcctgctttgtatttttgaaatctctgcatcactcattggaagtgcttctgaagagagctgctctgtgttcagttgactggttttgtgtcctgtttgaacttgctgaatgtaaggcaggctactatgcgttataatctaatcacaatttgtcaatatggtcttggcaatcatctgtgcattactctggtttgcattaagcctgtgtgtgaacttactgtaaaacatgttttatttcaaggttctgcaaaattaattgggcaggttaattgtgtacctgaaacttaacaagcagtttttggaagggcagttccacgttactttacactaaatcctgggaatgaatgtctggagagacagggcttcttttcttggcagaatttccttgggtagtgggcggactgttctgatgcaagtgggtacactggcagaagcagcacaatctggaggactaacatgagtcagcagggccactagaattgacaccccctcaggggatcagggagaatctggtttttctttcaggctaagtagaaaaggaagaactgaagtgtctgtcaaagaactcatggggagtggggggtccttcagggcactgtggcacttgggaggtgagtctcagaagactgcctgaggagagtgccaggctgcaggtgctcttggtaggggctgaagcttttctttctgctttgcagaataatttcaaaagcctttcccaaggagagaatgcaccttttatatctgaggtcttaagtggtgcccatattgctgttgaaggcaaggatgggcctgtacaaagcagccttggaccaggagggaaaaccccaaggctctgcagcctccctgctcccctccgtttaaggctgtggtcagggagggatgggcagggtgccagccgcatggaggcagcagagacacccgtgttccagctggggcaaggggaactgatatgtgggctgtgggctgttccactaggcgtggccacctctgcacatgggccttggcacttaggaaatatgggtgctgctgcattgggaccttgtgtgggtgcagagcaggatggctgctgcgtggagggtaattttgtcccctggagagtgattggtgaccctcttccctgctgctgctgtttgcaggctcctggcctatactacctctgacgccctgatcctgagttcctctgccctcctctgctgccagcagcgctgttggtggcctcaccctcctccagtacccaggcaccaaagatggcaccaccatcctcctgcttgtaccacagggtgctgctccctgggccaactcctgtgaacttgctcacttcccatggagaccgaggccagggcctgcccctctgaggcccctgttttgtggtcctgctgcctctgctgtgctgcgttcaggaggttgtccactgctcgacgtgggtcaccatgcagcccttgctgttcccacaatttaacagaaaaggaaactgaacggatgagtaaggctgcccagggtcactcagctggaaaagagtagagctggactcaaacccgggactgtctgtctctggtgcctgagttgggaagacgctgttgatgtccccttctgcctcgctttgagcttcctcctccgtgggccctccccctactctagagaaactagtccattccctcatgttccaccttgtgctcagtaaaccctgtcactccacagcagggtttttgagacagtctcgctgtgtcacccaggtggagtgcagtggggcgatctcagctcactgcaacctctgccttccaggctcaagcaattctcctgccttagcctcctgcgtagctgagactacaggcatgtgccaccatggctggctaatttttatatttttagtagagatggggtttcaccatgatggccaggctggtctcgaactccagaccccaggtgatccgcctgccttggcctcccaaagtgctgggaatacaggtgtgagcccctgcgcccggctcacagcagggttcttgataggccaccagtgaatcccatgccaccgaatctggcattcatttcacagcctcatctcagttctcactcagcagagccctcttgcctgtcctgccacccaggctactaatgttctggttcattctctgctgacagttagctgtggctgtcctcagcctcagtcctgggtctccccaagcagtcattagcatcaccttgactgatttccagggaacacttcaaccaccccttacctctgagctccagccccgagacactgccttctctctgcatttgttgatctctgtgcagcagtgcccacatcctcatcccagcttactgccgtctcaccaccttcaggttgtgaggtgcccataaactctgctgttaccattgccacttccctgtcttagcagctgtccctttcagtctgccctccactagtggccatgaagggggctgtgaccgtggtccaggtgagaaaggaaggcctgaactaagatgggaggtgggtggccagaatggagaggggagaagtggatggccagaatggagagatgcttagagggctgtgttgggaagtggtgactggatacaggggagggaggagagatacaagagggcacctgggctcatttgtggactacgtgattttgagactccaaataagcactgggtatttgggttggagatacagagctgagaatgatatgcatgtaggtgggcaaagcaagggggatttcatgagttctaaggtagggtgagaaaaataaccgagagttgagcagtgacggaggaagctgcaaagaaaacgactgctcagggagaggctggccaggggcctgtggctcaggggactgagaagaggagctctctaggcatctgaattgaggttgcccacaattggttgcaagatcgtggctggccttgatggaagctgggaagccactcggtcctagtgaggggtggtgaggagagcagcaacggccacacaggaaggctttggacgttttttctcctgacactagttatttccaggcctgggatatagctaggggcttggggtgggggcaactctttgcagggtggtgtggcctgtggaggaaacaggctcagttccactactttggccaggtgcaatggctcatgcctgtaatcccagcactttggaaggccaaggcgggtggatcacctgaggtcaggagttcaagaccagcctggacaacatggtgaaaccccgtctctactgaaaatacaaaaataattagccgggaatggtggtgcgtgcctgtaatcccaggtactcgagaggctgaggcagacagttgcttgaacctgggaggcagaggttgctgcagtgagccgagattgctgcactgcactccagcctgggtgacagcaagactgtctcaaaaaaaaaaaaaaaaaa

SEQ ID NO: 163591 - DNA, 967 bp, Homo sapiens
  Payload ID: 12216
  Gene Symbol: PANK2
  Gene Name: pantothenate kinase 2
  ENST ID: ENST00000495692
  CDS Start-End: 621-967
ccgacgaccagcggccagacgctgcgggagcactgctgggctggaggagggctcgagctgcgaggacggcacggagcagcgggtttttccatggtttggactggatatcggtggaactctggtcaagctggtatattttgaacccaaagacatcactgctgaagaagaagaggaagaagtggaaagtcttaaaagcattcggaagtacctgacctccaatgtggcttatgggtctacaggcattcgggacgtgcacctcgagctgaaggacctgactctgtgtggacgcaaagataggtgatcttcagctttgcaaactggatgaactagattgcttgatcaaaggaattttatacattgactcagtcggattcaatggacggtcacagtgctattactttgaaaaccctgctgattctgaaaagtgtcagaagttaccatttgatttgaaaaatccgtatcctctgcttctggtgaacattggctcaggggttagcatcttagcagtatattccaaagataattacaaacgggtcacaggtactagtcttggaggaggaactttttttggtctctgctgtcttcttactggctgtaccacttttgaagaagctcttgaaatggcatctcgtggagatagcaccaaagtggataaactagtacgagatatttatggaggggactatgagaggtttggactgccaggctgggctgtggcttcaagctttggaaacatgatgagcaaggagaagcgagaggctgtcagtaaagaggacctggccagagcgactttgatcaccatcaccaacaacattggctcaatagcaagaatgtgtgcccttaatgaaaacattaaccaggtggtatttgttggaaatttcttgagaattaatacgatcgccatgcggcttttggcatatgctttggattattggtccaaggggcagttgaaagcacttttttcgga

SEQ ID NO: 163592 - DNA, 1843 bp, Homo sapiens
  Payload ID: 12216
  Gene Symbol: PANK2
  Gene Name: pantothenate kinase 2
  ENST ID: ENST00000336066
  CDS Start-End: 82-558
tctggctggactgccgcggaggaggcgagaaggaatccgacgctggggggcttgctcgggcggcagcgactgctgctgcggatgggagggggccggctcggcgcgcccatggagcgccacggcagggcttccgccacctccgtctcgtcggctggggagcaggcggccggggaccccgaagggcggcggcaggagccactgcggcgccgggcgagcagcgcgtcggtgcccgcggtcggggcctcggctgagggcacgaggcgggatcgactgggctcttacagcggccccacctcggtctcccgccagcgcgtcgaaagcctgaggaaaaagcggccgctttttccatggtttggactggatatcggtggaactctggtcaagctggtatattttgaacccaaagacatcactgctgaagaagaagaggaagaagtggaaagtcttaaaagcattcggaagtacctgacctccaatgtggcttatgggtctacaggcattcgggacgtgcacctcgagctgaaggacctgactctgtgtggacgcaaagataggtgatcttcagctttgcaaactggatgaactagattgcttgatcaaaggaattttatacattgactcagtcggattcaatggacggtcacagtgctattactttgaaaaccctgctgattctgaaaagtgtcagaagttaccatttgatttgaaaaatccgtatcctctgcttctggtgaacattggctcaggggttagcatcttagcagtatattccaaagataattacaaacgggtcacaggtactagtcttggaggaggaactttttttggtctctgctgtcttcttactggctgtaccacttttgaagaagctcttgaaatggcatctcgtggagatagcaccaaagtggataaactagtacgagatatttatggaggggactatgagaggtttggactgccaggctgggctgtggcttcaagctttggaaacatgatgagcaaggagaagcgagaggctgtcagtaaagaggacctggccagagcgactttgatcaccatcaccaacaacattggctcaatagcaagaatgtgtgcccttaatgaaaacattaaccaggtggtatttgttggaaatttcttgagaattaatacgatcgccatgcggcttttggcatatgctttggattattggtccaaggggcagttgaaagcacttttttcggaacacgagggttattttggagctgttggagcactccttgagctgttgaagatcccgtgatcattacctggggaggggttcctgaaaccttccacaatgggatctgtggactttcatttttttaagagacttactcaatttcatgactgtactacctgaaacaaagtgagaaaggacaggtgtatttttctaagtcatcaagataaatccttaagaattcagtctaaattagcaaccaggaaggaaaaatatattaaaaacaacaaaaaagtggcacatgtccaggcagtgtgaggatttgctgtatataagttgcctgctttgtatttttgaaatctctgcatcactcattggaagtgcttctgaagagagctgctctgtgttcagttgactggttttgtgtcctgtttgaacttgctgaatgtaaggcaggctactatgcgttataatctaatcacaatttgtcaatatggtcttggcaatcatctgtgcattactctggtttgcattaagcctgtgtgtgaacttactgtaaaacatgttttatttcaaggttctgcaaaattaattgggcaggttaattgtgtacctgaaacttaacaagcagtttttggaagggca

SEQ ID NO: 163593 - DNA, 1807 bp, Homo sapiens
  Payload ID: 12216
  Gene Symbol: PANK2
  Gene Name: pantothenate kinase 2
  Uniprot ID: Q9BZ23
  ENST ID: ENST00000610179
  CDS Start-End: 56-1399
gagaaggaatccgacgctggggggcttgctcgggcggcagcgactgctgctgcggatgggagggggccggctcggcgcgcccatggagcgccacggcagggcttccgccacctccgtctcgtcggctggggagcaggcggccggggaccccgaagggcggcggcaggagccactgcggcgccgggcgagcagcgcgtcggtgcccgcggtcggggcctcggctgagggcacgaggcgggatcgactgggctcttacagcggccccacctcggtctcccgccagcgcgtcgaaagcctgaggaaaaagcggccgctttttccatggtttggactggatatcggtggaactctggtcaagctggtatattttgaacccaaagacatcactgctgaagaagaagaggaagaagtggaaagtcttaaaagcattcggaagtacctgacctccaatgtggcttatgggtctacaggcattcgggacgtgcacctcgagctgaaggacctgactctgtgtggacgcaaaggcaatctgcactttatacgctttcccactcatgacatgcctgcttttattcaaatgggcagagataaaaacttctcgagtctccacactgtcttttgtgccactggaggtggagcgtacaaatttgagcaggattttctcacaataggtgatcttcagctttgcaaactggatgaactagattgcttgatcaaaggaattttatacattgactcagtcggattcaatggacggtcacagtgctattactttgaaaaccctgctgattctgaaaagtgtcagaagttaccatttgatttgaaaaatccgtatcctctgcttctggtgaacattggctcaggggttagcatcttagcagtatattccaaagataattacaaacgggtcacaggtactagtcttggaggaggaactttttttggtctctgctgtcttcttactggctgtaccacttttgaagaagctcttgaaatggcatctcgtggagatagcaccaaagtggataaactagtacgagatatttatggaggggactatgagaggtttggactgccaggctgggctgtggcttcaagctttggaaacatgatgagcaaggagaagcgagaggctgtcagtaaagaggacctggccagagcgactttgatcaccatcaccaacaacattggctcaatagcaagaatgtgtgcccttaatgaaaacattaaccaggtggtatttgttggaaatttcttgagaattaatacgatcgccatgcggcttttggcatatgctttggattattggtccaaggggcagttgaaagcacttttttcggaacacgagggttattttggagctgttggagcactccttgagctgttgaagatcccgtgatcattacctggggaggggttcctgaaaccttccacaatgggatctgtggactttcatttttttaagagacttactcaatttcatgactgtactacctgaaacaaagtgagaaaggacaggtgtatttttctaagtcatcaagataaatccttaagaattcagtctaaattagcaaccaggaaggaaaaatatattaaaaacaacaaaaaagtggcacatgtccaggcagtgtgaggatttgctgtatataagttgcctgctttgtatttttgaaatctctgcatcactcattggaagtgcttctgaagagagctgctctgtgttcagttgactggttttgtgtcctgtttgaacttgctgaatgtaaggcaggctactatgcgttataatctaatcacaatttgtcaa

SEQ ID NO: 163594 - DNA, 1763 bp, Homo sapiens
  Payload ID: 12216
  Gene Symbol: PANK2
  Gene Name: pantothenate kinase 2
  Uniprot ID: Q9BZ23
  ENST ID: ENST00000621507
  CDS Start-End: 363-1202
ccgcgcgcggacactgtccccgcacggtggtccctcgttggtgcgtggcctgacatccggctggaggcctcgggtgctccgaaagcggtaccttcgggggcccccccgcacccattgtttttccatggtttggactggatatcggtggaactctggtcaagctggtatattttgaacccaaagacatcactgctgaagaagaagaggaagaagtggaaagtcttaaaagcattcggaagtacctgacctccaatgtggcttatgggtctacaggcattcgggacgtgcacctcgagctgaaggacctgactctgtgtggacgcaaaggcaatctgcactttatacgctttcccactcatgacatgcctgcttttattcaaatgggcagagataaaaacttctcgagtctccacactgtcttttgtgccactggaggtggagcgtacaaatttgagcaggattttctcacaataggtgatcttcagctttgcaaactggatgaactagattgcttgatcaaaggaattttatacattgactcagtcggattcaatggacggtcacagtgctattactttgaaaaccctgctgattctgaaaagtgtcagaagttaccatttgatttgaaaaatccgtatcctctgcttctggtgaacattggctcaggggttagcatcttagcagtatattccaaagataattacaaacgggtcacaggtactagtcttggaggaggaactttttttggtctctgctgtcttcttactggctgtaccacttttgaagaagctcttgaaatggcatctcgtggagatagcaccaaagtggataaactagtacgagatatttatggaggggactatgagaggtttggactgccaggctgggctgtggcttcaagctttggaaacatgatgagcaaggagaagcgagaggctgtcagtaaagaggacctggccagagcgactttgatcaccatcaccaacaacattggctcaatagcaagaatgtgtgcccttaatgaaaacattaaccaggtggtatttgttggaaatttcttgagaattaatacgatcgccatgcggcttttggcatatgctttggattattggtccaaggggcagttgaaagcacttttttcggaacacgagggttattttggagctgttggagcactccttgagctgttgaagatcccgtgatcattacctggggaggggttcctgaaaccttccacaatgggatctgtggactttcatttttttaagagacttactcaatttcatgactgtactacctgaaacaaagtgagaaaggacaggtgtatttttctaagtcatcaagataaatccttaagaattcagtctaaattagcaaccaggaaggaaaaatatattaaaaacaacaaaaaagtggcacatgtccaggcagtgtgaggatttgctgtatataagttgcctgctttgtatttttgaaatctctgcatcactcattggaagtgcttctgaagagagctgctctgtgttcagttgactggttttgtgtcctgtttgaacttgctgaatgtaaggcaggctactatgcgttataatctaatcacaatttgtcaatatggtcttggcaatcatctgtgcattactctggtttgcattaagcctgtgtgtgaacttactgtaaaacatgttttatttcaaggttctgcaaaattaattgggcaggttaattgtgtacctgaaacttaacaagcagtttttggaagggca

SEQ ID NO: 163595 - DNA, 10506 bp, Homo sapiens
  Payload ID: 12217
  Gene Symbol: PANK3
  Gene Name: pantothenate kinase 3
  Uniprot ID: Q9H999
  ENST ID: ENST00000239231
  CDS Start-End: 318-1430
gcggcggcggcggcggtggcggcggctccggggaccggggccttttgtttggagcggctgcgggggggccccggagcggcgaggccggcggccttccccagcttgctcggtcccggccacccctcgcgggggtggggggccgccccctgggccgggcatctcctcaggcgccgccgccccgccctaggccggccccgcccggcctgaggggaggaaccggccgggcctcgccgcgcggcccagccacctccggagtcgccgcctctgctctcagtgccccggatcggaggccgtccatcgcccctcgggccgacgccatgaagatcaaagatgccaagaaaccctctttcccatggtttggcatggacattgggggaactctagtaaagctctcgtactttgaacctattgatatcacagcagaggaagagcaagaagaagttgagagtttaaaaagtattcggaaatatttgacttctaacgtggcatatggatccaccggcattcgggatgtacaccttgaactgaaagatttaacactttttggccgaagagggaacttgcactttatcaggtttccaacccaggacctgcctacttttatccaaatgggaagagataaaaacttctcaacattgcagacggtgctatgtgctacaggaggtggtgcttacaagtttgaaaaagattttcgcacaattggaaacctccacctgcacaaactggatgaacttgactgccttgtaaagggcttgctgtatatagactctgtcagtttcaatggacaagccgagtgctattattttgctaatgcctcagaacctgagcgatgccaaaagatgccttttaacctggatgatccctatccactgcttgtagtgaacattggctcaggagtcagtattttagcagtccattccaaagacaactataaacgagtgactgggacaagccttggagggggtacctttctgggtttatgcagtttattgactggctgtgaaagttttgaagaggctcttgaaatggcatccaaaggtgatagcacacaagctgacaagctggtccgtgatatttatggaggagattatgaaagatttggtttgccaggttgggctgtagcatctagttttgggaatatgatttataaggagaagcgagaatctgttagtaaagaagatctggcaagagctactttagttactatcaccaataacattggttctgtggcacgaatgtgtgctgttaatgagaaaataaacagagttgtctttgttggaaactttttacgtgtcaataccctctcaatgaaacttttggcatatgcactggattactggtcaaaaggtcaactaaaagcattgtttctagaacatgagggttactttggagcagttggtgcacttcttgggctgccaaatttcagctaaagcatcaggtctctctctctgctaataaatgtcatccaagaggaactaaaaccagaggcattattactgcattgtttgtcactgggaaccaaaggataaaagagtagcataagctgctgaatgttgccatattaaaggagagaacttggtaacgtgaagtatttctcattgaaatgctttcccttttgtatatagccagtgttaaatccttaaatgcaatacagcctctgattattgagcttcctcttaaaaagatttttttattttatgtagccaacattgcagtactgtatgctcaaacacaaatcttaaagtatcggaactgtttagcttatgaaaataatcgactctgaatatttgttacaagtctgttttatgtgttttgattactagtgagcagaaaataacataccctgtattcaaaattactgaaatggcaatcaaagatgatcatttttatgtgattttagaaatgttaaggcaatactactaattattgtaggtttttttaacgtatcacccaaagcatgtatgtgatctttccccattagtatctttttctcaaatgccataattaactgaaatactattattaaattttcatgagaattctaaaatgaatcctgggaaatgcacgtttggtgatgttgcactttctgtattttacaggaattagtcaatacatgttgaaatgtttaacattttaagattggaggcttaattactgggagtctgtctaatgaagtcctgggactattgtaatggaatatgatttgagttcactgtgctctttttgtttgtttgttttggtcatatatacattcagaacttttattttaaaacaaccacaataacattaataatagaaaattcatctgtaaatattcacagtctagtcactgaaaaatgggaaaacctctaccatgccttattattaccctttgctgtttgaggagccagaaatagaggtgcagttagaggacggtcactttttccaacaaaacccactccatagccatgtggatttttatccaaaggctcaacaaccagagggaatggtgagacctgataactaaaatactgttattggcaagggtttgaaatgtgtaagaacctaggagggaaaggaagattgagcaacataggaaaaggggaagagaggctgagtgtcaccaaggtccaaactccatttataaaaatactgcaaaaccaggagttgatggtagaaatgcatatgatccatggcaggagtaaatctctccacctcctctaactctctgaaaactctagagttggagcaagtcttccatttgcttcttatccccttaaaagaatgccttccacttcccaacagcccccatcaagggaccccaagaggccaccatgctcttatctcgcactttctttcctattccccttgcctgaatctggagtggggttgagccctctgccttcaaccttaagatttaggaagttctttccccaactgtctaacttggaaaggtagatgagtctgaattttgaagtaacgaatgcaaattccactcagcagaggcaatgttatttatgtacatagggatagtggaatgagttttaatagattctgtccaaaaggggtttgttcctcttatttcctctatgtaggaagttgtgtcttaggcaactttatcagtatcaatggaaaaatgataggcactacaatgaaatggcaggatgccaatatgagatatttcaggaataataagaaatacagtttgtttgtataaaataaactatctcaagaaagttttcaacgacagtgatagtgttcatttgtaagagagagttctagaacttcgatgtccagtgcagtagccactacccatatgtagctgttgagcatttgaaatatggttagtccaaattgagatgtgctctaaaggacaataaaaggttaaatatctcctaattttttgtattgattacatgttgaaatgttaacattggaaatattgggttaaagaaaaatacacaattaaaatgaatcttggccaggcgcagtggctcacgcctctaatcccagcactttgagaggccagggtgggcaggtcacctgaggtcaggagttcgagaccagcctggccagtgtggcaaaaccctgcctactaaaaatacaaaaattagccaggcatggtggtgcgcacctgtagtcccagctacttgggaggctgaggcaggagaattgcttgaacccaggaggaggaggctgcagtgagctgagattgtgccactgcactccagcctgggcgacagagtgagactctgtctcaaaaaaaagaatcatctgtttccaattatttttaaatgtgcttactagaaaagataaaatcacacatggtttacattttatttctattaagacagcaccgttaagaacatagagctttgaggaattgtggtattagaaccaaatctatttaccacagtgagcttacagggagttactcgagatcttaataaaaaattataatctttggcagccttcattatgattttgtgttcttattattccagtacctctagattacatatgggaaaagctaaagagccacagtggtgagatggttgctcactctagcaggtaatttcagtttgaaaggataaaatatatgaatcatagttcacattaaccaaagtacagtgatgaaataacttagactctgaccattccattttttcttaaagattgccctaaatctatagatgctaatacagtatttgccacaggtataaaacttgtagttactgtcattcaattaagattcttatctgtacagatatacaaatcagaaacttttaaaataaattgaactaatggaattttggctccaatatttagtcactacaatggaaatattaaagcaaggaacatgaagtcattgtagggttttaaaatggctactgactgacatgaattcagagtttcaaacagtctaaattctaaaaacttaactttacacgcttttcctcctaaataaccactctaataattcatacattcatatcttcaggtaaagaaaactgaattttaaacaattgaggctgggtgcagtggctcatgcctgtaatcgaatataaggacttgagtataaaatttgaaaactacatggggaaatgtctttatcatgcatctcttgatagtctactgaaaactattaagtaaacctgcggtctgtaaacaaaaaaacccatagtgatacttaccttgtgtaatgtaaacaattttttaagctctttaaagtacatctagatttactggtaatgtatagaagtcaattttatccccaagcatttctacttcctaaaccattagcaagagtctcaaaacaacttcactaaactattggacctccagtgttaacttgccaacataaaaatctgaaaaactttgtaatcactatcaaaaatacaaaagagagaataaattcccaggtaaaaggctttacaaattttggaactattatgcttttgtttactaaacactgatccttttagtaattctgcagtattgcctcagactcccacaaagtttcaaaatagctcatctattagattcctgtaacatttatttgggataaacgtggttttgttgccgttgttcataatagaataaaatatttagctttgatggttcagatgtaatacaaagaaataactaagtttgggcctgagataaatgtggtaaagcaagaatgcagagatgctgtaatgatgagtgagttttatagcattactgaggacctgaaaacttgctgccaaggacactttgaaggttttgttggctggaagaagtgtctctggaatcccactcctagctcttcttgaatatttgaaaagaattagataagggccatggggacccaggtcaccccacctcttcttttcagtttggctacaacattggagtcatcagtgctcctgagacagtcatacaggactttctcagttacactttgaaagagaggtcagaagactctccctctgaggttttgctcatgtccccctggcccttgtctgtggccatcttccccaatggtgatatgattggctcctttctgttgcactctttgtcaaccactttggcaggtgcagttcaatgcttatcataatttgttggctattactggttgccttatgggattctgcagacaagctgagttggttgaaatgctgatcctgggccactagattactggcttgtaatgcggactctgcacaagttttgtgcccatgtacattggagagatctcgcctactcccctttggggtacctttagtgctctcaaccagctggacgtcgttggtattctggagatccagatctttggtctggagttcatcttggggtctgaagagctatgcccagtgatactgggctttaccatccttccagctgtcctataaagtgtagcccttccattttgccctggaagtcgtaagtttttgctcattaacagaaaggaagagtactaatgagatccttcagcaattgtaggggactcaggatgtgtcccaggacatctaggagataagagtgctaggatgatacaagaaaagcaagtcactacactggcgctctttagagtacccagctaccaacaacccactgtcatttccatcatgctccagctctctcagtagctctctggaatcaatgttgtcttctattactcaatgagaatcttcaaggatgcaggtgttgagaagccaatctatagattagtgcaggagtggttaatattatcttcttgactgtagtctctctgtttgtggttgaaagggcaggaaggactttacatatgataggtcttgaggcatggcgttttgttctgtcctcatgattgtttctttgttattaaaggatgagtatggtgggatgagctttgtctgtagtggggctatcttggtctttgtggccttctctgaagttggaccagactccgttccctggaatactgtggccacactcttcagtttgcaatagcagtggctggttgctccaactggacctccaactttctagttggattgctcttcctgaacaattattatctagtttaagtgtgttgttgctttagggtcatggcatgcttatgtatttctgttaccatctgaccatggtactatgccaagttctcttaggggacctgaatctttccagtagaccacatttgagagagtatgagtcaactgggcatagttcccaacaacccaaaatacatacgtacttcactgaagcagatctcatgattccattgacttcatttctaaaattggactttgagcagccaatttctaaggattaaaaagaaactttaatgcattgtagacctctgtacacagaaaaatctttgtaacttttgggcttaattttcattcttaaaaaatctggtaactttttcaaatgcaaccactgtcagtttgctgtgaggctaggcaaacaacacaaggtatagaatttcccatcaccaccaccctgaccccgcgagaagattgccttttaattagagacttgtagaactagtgccttttaagttctacactcatcttttccaaagactattagtaaacttgccatgtaatttgacatggcagttccttgctcagctactctaaataaagttggaaattaggtggtctcttagtttgggtaaagtcagtactattgccagtaatatacatggtaattgaaagcccttaaagtggttcagattatttgccaaatattagactctataaaaatttctgaggttttttttcttttacctttgagtgtacatgtgattgctataatgtaaataccagtcccttaaagactgtttctataagcagaatgatgcagcacaaagtggaaaggttttcctcttattccagcagtattcttgccttcaaagagtagtccatcttgccttgatttttaaggttgttttcttggatggaaagcttaactggatagtaatttccatatgttctttataaccactctgtatattataagcaaagttttttcatattgtatctttttctgttgagcactttatgcattttagtctattgcatttgagaatgtagtttagaaattcactgtttaaagccatgtgaaaactgatagaggataatgaaaatgagtgtacattattttgaatttaacttaactgttttgtggtgggtgtgaacaaaacattagaaatatattatctttttgtgataatactctctgacctcacttaaagtgatctgccatgaggtatccatgatcaagtttatgtttattctaatacctaaggaattcagccaactttgtttctatcatcagataatctcagaaaatagtgtgttttatctatattactgcctcttttcaatatttaagagaataattgtcttctggtttctactgagcctagtaataatcactaaagacctaaaaaaggaattccttctgttaagagtatttggatagcccattcacgataatggtggtgtgaaaatcaatcatcccagcttttctgacatatctaaattttgaataattaatttccacttccaaaaaattcaaatgttttctcaaagcagtcactacttatttgcattattcctgcatattcagtgaatgtgaggtcatatttggtattgtattagaagtagtgttggtcactggtcttgcctctttgaacattatttttatttgtaaaatgagggagttggtttgttatgatgggaaatgagtcagttttcagggtcctgagaaaattgcttcattcatggctgtgtttgagataactaaagtaaattttttttcaggtatttggtgtcatgttttggagttaatatttagtgcttatataattttaagttattacataatttttattggtatatatttgataggtactaggtattggattctcaccaaaccagtagaatggtattctctcttaatatgtgattgcctgtaatggccaggtagatataccttaaagtaatatgaaaggttttatatgtatattaaaatgtttgtacttttaaatctgtaaaggttatctggaatttttactgtgttaacttcagaattatatgggcattatgactttttcattgtacaaaaaattattcataaatgttagaatacagatgttccttgacttacaatagggttatgttccagtagacccattgtaaattgaaaataccgtaagttgaaaatacatttaatacgcctaacctactgaacatcccagcttagcctagcctatcttaaatgtgttctgaacacttaacgttggcctttagctgggcaaaatcatctaatacaaaacctattttataatgaagtgtttaatatctcaaataagagtattgtaccacatatcgttatcccaggataatatcagagtacaaaatttgaagtacagtttttaactgaatgtgtattgcttttgccccattataaagttgaaaaaccataagtcaaaccattgttaagtcggactgtttgtgttacatatatttgggattttttagtggccctttttaaaaagctgtttcttatttctgatcattgtgagtggggatagatgtgggaagaaccatgtctctactaaaaatacaaaaaatagccaggcttgttggcacacacctatagtcccagctactcgggagaccgaggcaggagaatcacttgaaccgggaggcagagggcagatcatgccactgtattccagcctgggcaacagagtaagactctgtctcaaaaatgaatgaatgaatgaatgaacgaatgaatgtactatgagctgatactgggatttcaggtaccgcagtttgtgctgaatgatatgtttggggtaaatcagtttttttcttatagaatttcggcgtttttgctgcaactgccactaattttgcatttaaaagaacaaaagaggaatgtatttttcaaaggagtgaatgaggttaaaatcaagattttgaatggtataaatatgcaactaattcagttgtaggatattattaaattttttattgctaaatatgtttctttcatacgttgcagtgcttacagttccaacagctttccaagaaaacatttccatatttgtgttatttgtaaagtatacataaataatgtaaaataatttgggattatttcaactttacattgtatgtctgaatttcatcgatgttgtacctggctcagtcaatagttgtcacaggtattaagccattttggaatttgccacttttttctgggtaacctgttttagtttagtttacagcatttagaaacagaaggtaactttatagaagtaacaccaatatcctagtctgcttgccccgaatataactaatagtattaggatgtaagcaatattaagatggtttttattattttttatacactgtgtgcttttactttttatttaaactacagcaaaaaactgattttttaactaaaattgaatggcgtttatcttaatgaccagttattgaccaaagtgtactcagaagatgttattatgtcccaatctaaggaatcctttaatttggggattaattttacttacacatgccatttcagtttcagttgcctcattctattacatcattcttgtcaagtctaagctttatcatgtctgaattcttttaacactgaatctgtgatgtaaaaatgtatgatgtgccataaattttattcataataaactaagttatagcctattgtaatctgtaaaacatttcttgtaaattacctaatttattttttcatttatgtacagtatcttatgtaaatttgaaaaatgtttgccatggcgcattctgtaaacattcccgtattcttttccttaatgcttatttgcatgaaggtaacttgggttttgcttgtttgtattggataaccattaagccaacttcagtttctctgcctttttttctgtagtttaaccatttctaattttgttcatattctaaatagatgttagaatcatactttttattttctactttctaaataaattatctaagttgtttacta

SEQ ID NO: 163596 - DNA, 552 bp, Homo sapiens
  Payload ID: 12217
  Gene Symbol: PANK3
  Gene Name: pantothenate kinase 3
  ENST ID: ENST00000522176
  CDS Start-End: 187-552
cggagtcgccgcctctgctctcagtgccccggatcggaggccgtccatcgcccctcgggccgacgccatgaagatcaaagatgccaagaaaccctaaaacgcagataaacaagaaagataaagtcacccgtattccccgcacccggagcgaaccgctattaatattatgctttcccatggtttggcatggacattgggggaactctagtaaagctctcgtactttgaacctattgatatcacagcagaggaagagcaagaagaagttgagagtttaaaaagtattcggaaatatttgacttctaacgtggcatatggatccaccggcattcgggatgtacaccttgaactgaaagatttaacactttttggccgaagagggaacttgcactttatcaggtttccaacccaggacctgcctacttttatccaaatgggaagagataaaaacttctcaacattgcagacggtgctatgtgctacaggaggtggtgcttacaagtttgaaaaagattttcgcacaattggaaacctccacctgcacaaactggat

SEQ ID NO: 163597 - DNA, 2677 bp, Homo sapiens
  Payload ID: 12218
  Gene Symbol: PANK4
  Gene Name: pantothenate kinase 4
  Uniprot ID: Q9NVE7
  ENST ID: ENST00000378466
  CDS Start-End: 18-2363
atatatctccatggctgatgagctggccgggcactttcaaaatggcggagtgtggagcgagcggcagcgggagcagcggggacagtctggacaagagcatcacgctgccccccgacgagatcttccgcaacctggagaacgccaagcgcttcgccatcgacataggcgggtcgttaaccaagctggcctactattcaacggtacagcacaaagtcgccaaggtgcggtctttcgaccactccggaaaggacacagaacgtgaacatgagccgccctatgagatttcagttcaagaagagatcactgctcgactgcacttcattaagtttgagaatacctacatcgaagcctgcctggacttcatcaaagaccatctcgtcaacacagagaccaaggtcatccaggcgaccgggggcggggcctacaagttcaaagacctcatcgaagagaagctgcggctgaaagtcgacaaggaggacgtgatgacgtgcctgattaaggggtgcaacttcgtgctcaagaacatcccccatgaggccttcgtgtaccagaaggattccgaccctgagttccggttccagaccaaccacccccacattttcccctatcttcttgtcaatatcggctctggagtctccatcgtgaaggtggagacggaggacaggttcgagtgggtcggcggcagctccattggaggcggcaccttctgggggcttggcgctctgctcaccaaaacgaagaagtttgacgagctcctgcacctggcctcgaggggccagcacagcaatgtggacatgctggtgcgggacgtctacggcggcgcccaccagactctcgggctgagcgggaacctcatcgccagcagcttcgggaagtcggccaccgccgaccaagagttctccaaagaagacatggcgaagagcctgctgcacatgatcagcaacgacattgggcagctggcctgcctccacgcacggctgcacagcctggaccgcgtgtactttggaggcttctttatccggggccaccccgtgaccatgcgcaccatcacctatagcatcaacttcttctccaagggggaagtgcaggcgctgtttctgaggcacgaaggctacctgggagccatcggagcgttcctgaaaggagctgagcaggacaatcctaaccagtacagctggggagagaactatgcaggcagctccgggctgatgagtgcatcacccgagctcggcccggcgcagcgggcgcggagtggcacttttgacttgctggaaatggaccggctggagaggccactggttgacctgccgctcctcctggacccgccctcctacgtgcccgacacggtggacctcaccgatgacgctctggcccgaaaatactggctcacctgctttgaggaggccctggacggggtagtgaagcgcgcagtggcgagccagccagactctgtggatgcagccgagagggcggagaagttccggcagaagtactggaacaagcttcagaccctgaggcagcagcccttcgcctatgggaccctgaccgtgcgcagcctgctggacaccagggagcactgtctgaacgagttcaacttcccggatccctactccaaagtgaagcagcgggagaatggcgtggcgctgaggtgcttccccggggtcgtgcgctccctggacgcgctgggctgggaggaacggcagctggcgctggtgaaaggcctcctggcggggaatgtcttcgactggggggccaaagccgtgtctgctgtccttgaatccgacccctactttgggtttgaagaagcaaagaggaagttacaagaaagaccctggctcgtggattcctacagcgagtggcttcagagattaaaggggccccctcataaatgtgccttaattttcgcagataacagtggaatagacatcattttgggagtcttcccctttgtcagggagctactccttagagggacagaggtcatcctggcgtgcaactcaggccccgccctgaacgacgtgacccacagcgagtccctcatcgtggcagagcgtattgcgggcatggaccctgtcgtgcactctgcgctccaggaagagaggctgctgctggtgcagacgggctccagctccccgtgcctcgacctcagccgcctggataaggggctggccgcactggtgcgggagcgtggcgcggatctggtggtcatcgagggcatgggccgtgctgtccacacaaactaccacgcagccctgcgctgcgagagcctcaagctggccgtcatcaagaacgcgtggctggccgagcggctgggcggccggctcttcagcgtcatcttcaagtacgaggtcccagccgagtgaggcgctgcagctgccggactcttctgcttgtcacttgtcaggaatgtgtttttaccaccacagggaaactgcgttcaaatcaacgtatttatatggtactgctgtgacgcggcacatacaccccagccgcacagatgcgtgtgacccagaggcgagacgcagctttgtcctgggagacgttcatattggaatctatttaactgctaaagaaccttttatatatatatatatataaatagagagatctatacaggtatgtctgacgggacgcagcaccgtgggcacgcaccaaatagagtttttaaaagaggccg

SEQ ID NO: 163598 - DNA, 2524 bp, Homo sapiens
  Payload ID: 12218
  Gene Symbol: PANK4
  Gene Name: pantothenate kinase 4
  ENST ID: ENST00000435556
  CDS Start-End: 1-2214
actttcaaaatggcggagtgtggagcgagcggcagcgggagcagcggggacagtctggacaagagcatcacgctgccccccgacgagatcttccgcaacctggagaacgccaagcgcttcgccatcgacataggcgggtcgttaaccaagctggcctactattcaacggtacagcacaaagtcgccaaggtgcggtctttcgaccactccggaaaggacacagaacgtgaacatgagccgccctatgagatttcagttcaagaagagatcactgctcgactgcacttcattaagtttgagaatacctacatcgaagcctgcctggacttcatcaaagaccatctcgtcaacacagagaccaaggtcatccaggcgaccgggggcggggccttcgtgtaccagaaggattccgaccctgagttccggttccagaccaaccacccccacattttcccctatcttcttgtcaatatcggctctggagtctccatcgtgaaggtggagacggaggacaggttcgagtgggtcggcggcagctccattggaggcggcaccttctgggggcttggcgctctgctcaccaaaacgaagaagtttgacgagctcctgcacctggcctcgaggggccagcacagcaatgtggacatgctggtgcgggacgtctacggcggcgcccaccagactctcgggctgagcgggaacctcatcgccagcagcttcgggaagtcggccaccgccgaccaagagttctccaaagaagacatggcgaagagcctgctgcacatgatcagcaacgacattgggcagctggcctgcctccacgcacggctgcacagcctggaccgcgtgtactttggaggcttctttatccggggccaccccgtgaccatgcgcaccatcacctatagcatcaacttcttctccaagggggaagtgcaggcgctgtttctgaggcacgaaggctacctgggagccatcggagcgttcctgaaaggagctgagcaggacaatcctaaccagtacagctggggagagaactatgcaggcagctccgggctgatgagtgcatcacccgagctcggcccggcgcagcgggcgcggagtggcacttttgacttgctggaaatggaccggctggagaggccactggttgacctgccgctcctcctggacccgccctcctacgtgcccgacacggtggacctcaccgatgacgctctggcccgaaaatactggctcacctgctttgaggaggccctggacggggtagtgaagcgcgcagtggcgagccagccagactctgtggatgcagccgagagggcggagaagttccggcagaagtactggaacaagcttcagaccctgaggcagcagcccttcgcctatgggaccctgaccgtgcgcagcctgctggacaccagggagcactgtctgaacgagttcaacttcccggatccctactccaaagtgaagcagcgggagaatggcgtggcgctgaggtgcttccccggggtcgtgcgctccctggacgcgctgggctgggaggaacggcagctggcgctggtgaaaggcctcctggcggggaatgtcttcgactggggggccaaagccgtgtctgctgtccttgaatccgacccctactttgggtttgaagaagcaaagaggaagttacaagaaagaccctggctcgtggattcctacagcgagtggcttcagagattaaaggggccccctcataaatgtgccttaattttcgcagataacagtggaatagacatcattttgggagtcttcccctttgtcagggagctactccttagagggacagaggtcatcctggcgtgcaactcaggccccgccctgaacgacgtgacccacagcgagtccctcatcgtggcagagcgtattgcgggcatggaccctgtcgtgcactctgcgctccaggaagagaggctgctgctggtgcagacgggctccagctccccgtgcctcgacctcagccgcctggataaggggctggccgcactggtgcgggagcgtggcgcggatctggtggtcatcgagggcatgggccgtgctgtccacacaaactaccacgcagccctgcgctgcgagagcctcaagctggccgtcatcaagaacgcgtggctggccgagcggctgggcggccggctcttcagcgtcatcttcaagtacgaggtcccagccgagtgaggcgctgcagctgccggactcttctgcttgtcacttgtcaggaatgtgtttttaccaccacagggaaactgcgttcaaatcaacgtatttatatggtactgctgtgacgcggcacatacaccccagccgcacagatgcgtgtgacccagaggcgagacgcagctttgtcctgggagacgttcatattggaatctatttaactgctaaagaaccttttatatatatatatatataaatagagagatctatacaggtatgtctgacgggacgcagcaccgtgggcacgcaccaaatagagtttttaaaagag

SEQ ID NO: 163599 - DNA, 706 bp, Homo sapiens
  Payload ID: 12218
  Gene Symbol: PANK4
  Gene Name: pantothenate kinase 4
  ENST ID: ENST00000502512
  CDS Start-End: 1-411
ttccggcagaagtactggaacaagcttcagaccctgaggcagcagcccttcgcctatgggaccctgaccgtgcgcagcctgctggacaccagggagcactgtctgaacgagttcaacttcccggatccctactccaaagtgaagcagcgggagaatggcgtggcgctgaggtgcttccccggggtcgtgcgctccctggacgcgctgggctgggaggaacggcagctggcgctggtgaaaggcctcctggcggggaatgtcttcgactggggggccaaagccgtgtctgctgtccttgaatccgacccctactttgggtttgaagaagcaaagaggaagttacaagaaagaccctggctcgtggattcctacagcgagtggcttcagagattaaagataacagtggaatagacatcattttgggagtcttcccctttgtcagggagctactccttagagggacagaggtcatcctggcgtgcaactcaggccccgccctgaacgacgtgacccacagcgagtccctcatcgtggcagagcgtattgcgggcatggaccctgtcgtgcactctgcgctccaggaagagaggctgctgctggtgcagacgggctccagctccccgtgcctcgacctcaggtaaccccgcaccctgcacctgttctctccctcctgggctctgtgccctctgtgccgtgcacctgcacc

SEQ ID NO: 163600 - DNA, 879 bp, Homo sapiens
  Payload ID: 12218
  Gene Symbol: PANK4
  Gene Name: pantothenate kinase 4
  ENST ID: ENST00000486396
  CDS Start-End: 1-126
ggagcgagcggcagcgggagcagcggggacagtctggacaagagcatcacgctgccccccgacgagatcttccgcaacctggagaacgccaagcgcttcgccatcgacataggacacagaacgtgaacatgagccgccctatgagatttcagttcaagaagagatcactgctcgactgcacttcattaagtttgagaatacctacatcgaagcctgcctggacttcatcaaagaccatctcgtcaacacagagaccaaggtcatccaggcgaccgggggcggggcctacaagttcaaagacctcatcgaagagaagctgcggctgaaagtcgacaaggaggacgtgatgacgtgcctgattaaggggtgcaacttcgtgctcaagaacatcccccatgaggccttcgtgtaccagaaggattccgaccctgagttccggttccagaccaaccacccccacattttcccctatcttcttgtcaatatcggctctggagtctccatcgtgaaggtggagacggaggacaggttcgagtgggtcggcggcagctccattggaggcggcaccttctgggggcttggcgctctgctcaccaaaacgaagaagtttgacgagctcctgcacctggcctcgaggggccagcacagcaatgtggacatgctggtgcgggacgtctacggcggcgcccaccagactctcgggctgagcgggaacctcatcgccagcagcttcgggaagtcggccaccgccgaccaagagttctccaaagaagacatggcgaagagcctgctgcacatgatcagcaacgacattgggcagctggcctgcctccacgcacggctgcacagcctggaccgcgtgtactttggaggcttctt

SEQ ID NO: 163601 - DNA, 1041 bp, Homo sapiens
  Payload ID: 12218
  Gene Symbol: PANK4
  Gene Name: pantothenate kinase 4
  ENST ID: ENST00000502770
  CDS Start-End: 1-465
actttcaaaatggcggagtgtggagcgagcggcagcgggagcagcggggacagtctggacaagagcatcacgctgccccccgacgagatcttccgcaacctggagaacgccaagcgcttcgccatcgacatagggtttttaagttccagtagccccaaacccctcatctacagagactttagtctccaggacacccagagagtgtggggcatggacccccaggccccgctgtgtcctggtcctgaatcctgcccggtttgtgtctcccctgcaggcgggtcgttaaccaagctggcctactattcaacggtacagcacaaagtcgccaaggtgcggtctttcgaccactccggaaaggtgagcctgcactgtggccacccggggcagggcagccgcttctctgtcgtcttggacctggcacttgtctcgcagtcatccctctgctgctgcagacctcgactttagtgtcctgggagtttctagcagggacagcctcccctgccttccgccgtgtcccttcaagaccctttgtaggaacctgcgcccgcctgtgctcccccgggagaggcttccgctcctgctgggtggccctgaggtcgccacggtcctaggctcctccctcttgcccaggattctgcctcagagcgccgcctggttgaaggctggcgcgaacagccagctccactagggcagggtgcgcacagcccagcccggcgcggtgtcccacacacatgcggcctcccctactctgttttccaggacacagaacgtgaacatgagccgccctatgagatttcagttcaagaagagatcactgctcgactgcacttcattaagtttgagaatacctacatcgaagcctgcctggacttcatcaaagaccatctcgtcaacacagagaccaaggtcatccaggcgaccgggggcggggcctacaagttcaaagacctcatcgaagagaagctgcggctgaaagtcgacaaggaggacgtgatgacgtgcctgattaaggggtgcaacttcgtgctcaagaacatcccc

SEQ ID NO: 163602 - DNA, 1913 bp, Homo sapiens
  Payload ID: 12218
  Gene Symbol: PANK4
  Gene Name: pantothenate kinase 4
  ENST ID: ENST00000505228
  CDS Start-End: 1-1421
acaaggaggacgtgatgacgtgcctgattaaggggtgcaacttcgtgctcaagaacatcccccatgaggccttcgtgtaccagaaggattccgaccctgagttccggttccagaccaaccacccccacattttcccctatcttcttgtcaatatcggctctggagtctccatcgtgaaggtggagacggaggacaggttcgagtgggtcggcggcagctccattggaggcggcaccttctgggggcttggcgctctgctcaccaaaacgaagaagtttgacgagctcctgcacctggcctcgaggggccagcacagcaatgtggacatgctggtgcgggacgtctacggcggcgcccaccagactctcgggctgagcgggaacctcatcgccagcagcttcgggaagtcggccaccgccgaccaagagttctccaaagaagacatggcgaagagcctgctgcacatgatcagcaacgacattgggcagctggcctgcctccacgcacggctgcacagcctggaccgcgtgtactttggaggcttctttatccggggccaccccgtgaccatgcgcaccatcacctatagcatcaacttcttctccaagggggaagtgcaggcgctgtttctgaggcacgaaggctacctgggagccatcggagcgttcctgaaaggagctgagcaggacaatcctaaccagtacagctggggagagaactatgcaggcagctccgggctgatgagtgcatcacccgagctcggcccggcgcagcgggcgcggagtggcacttttgacttgctggaaatggaccggctggagaggccactggttgacctgccgctcctcctggacccgccctcctacgtgcccgacacggtggacctcaccgatgacgctctggcccgaaaatactggctcacctgctttgaggaggccctggacggggtagtgaagcgcgcagtggcgagccagccagactctgtggatgcagccgagagggcggagaagttccggcagaagtactggaacaagcttcagaccctgaggcagcagcccttcgcctatgggaccctgaccgtgcgcagcctgctggacaccagggagcactgtctgaacgagttcaacttcccggatccctactccaaagtgaagcagcgggagaatggcgtggcgctgaggtgcttccccggggtcgtgcgctccctggacgcgctgggctgggaggaacggcagctggcgctggtgaaaggcctcctggcggggaatgtcttcgactggggggccaaagccgtgtctgctgtccttgaatccgacccctactttgggtttgaagaagcaaagaggaagttacaagaaagaccctggctcgtggattcctacagcgagtggcttcagagattaaagataacagtggaatagacatcattttgggagtcttcccctttgtcagggagctactccttagagggacagaggtcatcctggcgtgcaactcaggccccgccctgaacgacgtgacccacagcgagtccctcatcgtggcagagcgtattgcgggcatggaccctgtcgtgcactctgcgctccaggaagagaggctgctgctggtgcagacgggctccagctccccgtgcctcgacctcagccgcctggataaggggctggccgcactggtgcgggagcgtggcgcggatctggtggtcatcgagggcatgggccgtgctgtccacacaaactaccacgcagccctgcgctgcgagagcctcaagctggccgtcatcaagaacgcgtggctggccgagcggctgggcggccggctcttcagcgtcatcttcaagtacgaggtcccagccgagtgaggcgctgcagctgccggactcttctgcttgtcacttgtcaggaatgtgtttt

SEQ ID NO: 163603 - DNA, 670 bp, Homo sapiens
  Payload ID: 12218
  Gene Symbol: PANK4
  Gene Name: pantothenate kinase 4
  ENST ID: ENST00000468002
  CDS Start-End: 1-573
ctgctgcacatgatcagcaacgacattgggcagctggcctgcctccacgcacggctgcacagcctggaccgcgtgtactttggaggcttctttatccggggccaccccgtgaccatgcgcaccatcacctatagcatcaacttcttctccaagggggaagtgcaggcgctgtttctgaggcacgaaggctacctgggagccatcggagcgttcctgaaaggagctgagcaggacaatcctaaccagtacagctggggagagaactatgcaggcagctccgggctgatgagtgcatcacccgagctcggcccggcgcagcgggcgcggagtggcacttttgacttgctggaaatggaccggctggagaggccactggttgacctgccgctcctcctggacccgccctcctacgtgcccgacacggtggacctcaccgatgacgctctggcccgaaaatactggctcacctgctttgaggaggccctggacggggcaaaaataccgctcctggccacctggtgggtcagtgaggacgtggcgtctgcgaggcacgttgcttctaagggcagctgatagttctgctagctagcacattccttcaaaaagcaatttaggagacgtctctgctcttttgaggtagtgaagcgcgcagtggcgagccagccagact

SEQ ID NO: 163604 - DNA, 2649 bp, Homo sapiens
  Payload ID: 12218
  Gene Symbol: PANK4
  Gene Name: pantothenate kinase 4
  Uniprot ID: Q9NVE7
  ENST ID: ENST00000615291
  CDS Start-End: 14-2335
gggcactttcaaaatggcggagtgtggagcgagcggcagcgggagcagcggggacagtctggacaagagcatcacgctgccccccgacgagatcttccgcaacctggagaacgccaagcgcttcgccatcgacataggcgggtcgttaaccaagctggcctactattcaacggtacagcacaaagtcgccaaggtgcggtctttcgaccactccggaaaggacacagaacgtgaacatgagccgccctatgagatttcagttcaagaagagatcactgctcgactgcacttcattaagtttgagaatacctacatcgaagcctgcctggacttcatcaaagaccatctcgtcaacacagagaccaaggtcatccaggcgaccgggggcggggcctacaagttcaaagacctcatcgaagagaagctgcggctgaaagtcgacaaggaggacgtgatgacgtgcctgattaaggggtgcaacttcgtgctcaagaacatcccccatgaggccttcgtgtaccagaaggattccgaccctgagttccggttccagaccaaccacccccacattttcccctatcttcttgtcaatatcggctctggagtctccatcgtgaaggtggagacggaggacaggttcgagtgggtcggcggcagctccattggaggcggcaccttctgggggcttggcgctctgctcaccaaaacgaagaagtttgacgagctcctgcacctggcctcgaggggccagcacagcaatgtggacatgctggtgcgggacgtctacggcggcgcccaccagactctcgggctgagcgggaacctcatcgccagcagcttcgggaagtcggccaccgccgaccaagagttctccaaagaagacatggcgaagagcctgctgcacatgatcagcaacgacattgggcagctggcctgcctccacgcacggctgcacagcctggaccgcgtgtactttggaggcttctttatccggggccaccccgtgaccatgcgcaccatcacctatagcatcaacttcttctccaagggggaagtgcaggcgctgtttctgaggcacgaaggctacctgggagccatcggagcgttcctgaaaggagctgagcaggacaatcctaaccagtacagctggggagagaactatgcaggcagctccgggctgatgagtgcatcacccgagctcggcccggcgcagcgggcgcggagtggcacttttgacttgctggaaatggaccggctggagaggccactggttgacctgccgctcctcctggacccgccctcctacgtgcccgacacggtggacctcaccgatgacgctctggcccgaaaatactggctcacctgctttgaggaggccctggacggggtagtgaagcgcgcagtggcgagccagccagactctgtggatgcagccgagagggcggagaagttccggcagaagtactggaacaagcttcagaccctgaggcagcagcccttcgcctatgggaccctgaccgtgcgcagcctgctggacaccagggagcactgtctgaacgagttcaacttcccggatccctactccaaagtgaagcagcgggagaatggcgtggcgctgaggtgcttccccggggtcgtgcgctccctggacgcgctgggctgggaggaacggcagctggcgctggtgaaaggcctcctggcggggaatgtcttcgactggggggccaaagccgtgtctgctgtccttgaatccgacccctactttgggtttgaagaagcaaagaggaagttacaagaaagaccctggctcgtggattcctacagcgagtggcttcagagattaaaggggccccctcataaatgtgccttaattttcgcagataacagtggaatagacatcattttgggagtcttcccctttgtcagggagctactccttagagggacagaggtcatcctggcgtgcaactcaggccccgccctgaacgacgtgacccacagcgagtccctcatcgtggcagagcgtattgcgggcatggaccctgtcgtgcactctgcgctccaggaagagaggctgctgctggtgcagacgggctccagctccccgtgcctcgacctcagccgcctggataaggggctggccgcactggtgcgggagcgtggcgcggatctggtggtcatcgagggcatgggccgtgctgtccacacaaactaccacgcagccctgcgctgcgagagcctcaagctggccgtcatcaagaacgcgtggctggccgagcggctgggcggccggctcttcagcgtcatcttcaagtacgaggtcccagccgagtgaggcgctgcagctgccggactcttctgcttgtcacttgtcaggaatgtgtttttaccaccacagggaaactgcgttcaaatcaacgtatttatatggtactgctgtgacgcggcacatacaccccagccgcacagatgcgtgtgacccagaggcgagacgcagctttgtcctgggagacgttcatattggaatctatttaactgctaaagaaccttttatatatatatatatataaatagagagatctatacaggtatgtctgacgggacgcagcaccgtgggcacgcaccaaatagagtttttaaaagaggccg

SEQ ID NO: 163605 - DNA, 1041 bp, Homo sapiens; identical to SEQ ID NO: 163601
  Payload ID: 12218
  Gene Symbol: PANK4
  Gene Name: pantothenate kinase 4
  ENST ID: ENST00000628687
  CDS Start-End: 10-465

SEQ ID NO: 163606 - DNA, 706 bp, Homo sapiens; identical to SEQ ID NO: 163599
  Payload ID: 12218
  Gene Symbol: PANK4
  Gene Name: pantothenate kinase 4
  ENST ID: ENST00000625442
  CDS Start-End: 1-411

SEQ ID NO: 163607 - DNA, 2524 bp, Homo sapiens; identical to SEQ ID NO: 163598
  Payload ID: 12218
  Gene Symbol: PANK4
  Gene Name: pantothenate kinase 4
  ENST ID: ENST00000630982
  CDS Start-End: 10-2214

SEQ ID NO: 163608 - DNA, 1913 bp, Homo sapiens; identical to SEQ ID NO: 163602
  Payload ID: 12218
  Gene Symbol: PANK4
  Gene Name: pantothenate kinase 4
  ENST ID: ENST00000626423
  CDS Start-End: 1-1421

SEQ ID NO: 163609 - DNA, 879 bp, Homo sapiens; identical to SEQ ID NO: 163600
  Payload ID: 12218
  Gene Symbol: PANK4
  Gene Name: pantothenate kinase 4
  ENST ID: ENST00000627774
  CDS Start-End: 1-126

SEQ ID NO: 163610 - DNA, 670 bp, Homo sapiens; identical to SEQ ID NO: 163603
  Payload ID: 12218
  Gene Symbol: PANK4
  Gene Name: pantothenate kinase 4
  ENST ID: ENST00000628406
  CDS Start-End: 1-573

SEQ ID NO: 163611 - DNA, 3129 bp, Homo sapiens
  Payload ID: 12219
  Gene Symbol: PAPD4
  Gene Name: PAP associated domain containing 4
  Uniprot ID: Q6PIY7
  ENST ID: ENST00000296783
  CDS Start-End: 300-1754
gtgttgctcctcccctggcagccgtgaggggggttagatctcagccggagccggagctgggcctagctgtcccacgggccaccactacctcctttggttcgggagaaagctacgaccaagtacgcccagctcgggccttagaacttctgaacgggcagtgcgggtaggccctgcttagcccttcccggaggacacctgaccaaaagaggaagatagtcttgggacccttgcatggtgtttcaaagggtggtgaagaactaaggtagaagaatacatgttcacttccagtgaacaagagcatgttcccaaactcaattttgggtcgcccacccttcactccaaatcatcaacaacataataacttctttaccctgtcacctactgtttattcacaccagcagcttatagatgcacaattcaactttcagaatgcagacttgtctagagctgtgtcattacagcagctgacatatggaaatgtcagtccaatacagacctcagcttccccattatttcgaggaaggaagagattaagcgatgaaaaaaaccttcctcttgacggtaaacggcaacgtttccattcaccccaccaagagccaactgtagttaaccagatagtgcctttatcaggtgaacgaagatactcaatgccaccattgtttcatacacattatgtaccagatatagtcagatgtgttccaccttttcgagaaattgcatttttagaacctagagaaatcacactgcctgaggccaaagataagttgagtcagcagatactggagttatttgaaacatgtcagcagcaaataagtgatttaaagaagaaagaactctgtcgaacacagctgcagagagaaattcagctgttatttccacaaagcagactttttttggttgggtcctctttaaatggatttggtacccggagcagtgatggtgatttatgcctagttgttaaggaagaaccatgtttttttcaggtaaatcagaagactgaagcacggcatatactcaccttagtccataaacacttctgtactagactttcgggctacattgagagacctcagctgattcgagcaaaagtgccaattgtgaagttcagggataaagtcagttgtgtggagtttgacttgaatgtaaacaatattgttggaataagaaacacattccttctcagaacttatgcataccttgaaaatcgagttcgtccgttagtgctggtgattaagaagtgggcaagtcaccatcagataaatgatgccagtcgtggtactttaagcagctatagtcttgtattgatggttttgcactatttacaaaccctacctgaacccatccttccatccctccaaaaaatttacccagagtcttttagtcctgctatacagctgcaccttgtacatcaagctccatgtaatgttcctccttacctctcaaagaatgaatcaaaccttggggacctcttactgggctttcttaaatattatgctacagaatttgactggaatagtcaaatgatttcagttcgtgaagccaaagccattccaaggcctgatggtattgaatggagaaataaatacatctgtgtagaagaaccttttgatggaacaaatacagccagagcagtgcacgaaaagcagaaatttgatatgatcaaggatcaatttttaaagtcatggcacagattgaaaaacaagagagatttgaacagtatactacctgtaagagctgctgtcctgaaaagataactggcctctatttcttaataaattcttccaagaaataaagaacaatagtttcatcataatacattatgtttacctccatcatagttgcttttttcatagttcttgttttcatgttttatttttaaaaagacatataaagattgcatattttattatgacatttcctaataaacccctttgatttaaaaatgtatttttaaaaatgtttacattgatgatgagtaatattgcatgtgttttcaggtgatcagataaaatatattttgggaaattaactgaacaaataaaaagtttttgatataacttcaattaattgtaccacatgctaatcctgaagagatgtgtagaattttggaaagggtctaattcatacatgcttaaagtataacctacgttagatagtttgttgtcaaagtctgttctagtaaagtgaagattcaagtcagttgttcagttacttgaagcaaaacgaaatctttcatttcagtcaaatcactgcagtcatgaaatactgaacaattgccttaagtctttgcttgactcactgggatagactgaggctttgggtgtgtctgtattagcatttcattagtacttcacatgcttttgatgtactcttgagattgctttaaattttgtattgaaacaacaatacattttgcactgtagtaatgggagcactaactcttacaacagttagtgaatcgttttaaagaatcagttcagtgtagacattttgaaaagattgtttcctgtgctttacgatagcttagtgcaatgtgcacttctgttttacttgccattttcctgctctgttttctctgtgacatgaagcaacagaaactgagatcaaagttaagattatatcctgtttgtagtatcagatatttttctgtgtacaattataggattgtaatctaaactggaatttttaggcagtaagtcaccacaaaatgttttagataagacacaataaaattattataaataaaagcttaatgtttgtaaaaaatctcttttttagtatttcttttttcacatgaaagaagtggtggctgctaaaaaaaaagctacagtgtttattaagggtctttttgatttatgtaaatatttgtaaattggtcagtgcctgtaaatttaaatataaaaagtaaccttgaaaacagttttaactttttcaaaagaactatgtccaacattttttagacctgctgtagtacagttttgtacctctaacgtattttttttttgcagaccaaatgctaaaacttttgcttttctttgacttgtaaaaggtgcacattttcattttcttccttaagttcaaatttttgtatgatgtcaaatgcaataaaatttatatatggacattgtt

SEQ ID NO: 163612 - DNA, 3223 bp, Homo sapiens
  Payload ID: 12219
  Gene Symbol: PAPD4
  Gene Name: PAP associated domain containing 4
  Uniprot ID: Q6PIY7
  ENST ID: ENST00000423041
  CDS Start-End: 406-1848
ctattctcatccggggtcacgtcggtcttccgggtgtctttgacagggttttctacgccgctttttcggcgactttttgctcttccgctttttgccaccgcccccaaccttctatatccttgcagcccctaccttttcttgtgttgctcctcccctggcagccgtgaggggggttagatctcagccggagccggagctgggcctagctgtcccacgggccaccactacctcctttggttcgggagaaagctacgaccaagtacgcccagctcgggccttagaacttctgaacgggcagtgcgggaccaaaagaggaagatagtcttgggacccttgcatggtgtttcaaagggtggtgaagaactaaggtagaagaatacatgttcacttccagtgaacaagagcatgttcccaaactcaattttgggtcgcccacccttcactccaaatcatcaacaacataataacttctttaccctgtcacctactgtttattcacaccagcagcttatagatgcacaattcaactttcagaatgcagacttgtctagagctgtgtcattacagcagctgacatatggaaatgtcagtccaatacagacctcagcttccccattatttcgaggaaggaagagattaagcgatgaaaaaaaccttcctcttgacggtaaacggcaacgtttccattcaccccaccaagagccaactgtagttaaccagatagtgcctttatcaggtgaacgaagatactcaatgccaccattgtttcatacacattatgtaccagatatagtcagatgtgttccaccttttcgagaaattgcatttttagaacctagagaaatcacactgcctgaggccaaagataagttgagtcagcagatactggagttatttgaaacatgtcagcagcaaataagtgatttaaagaagaaagaactctgtcgaacacagctgcagagagaaattcagctgttatttccacaaagcagactttttttggttgggtcctctttaaatggatttggtacccggagcagtgatggtgatttatgcctagttgttaaggaagaaccagtaaatcagaagactgaagcacggcatatactcaccttagtccataaacacttctgtactagactttcgggctacattgagagacctcagctgattcgagcaaaagtgccaattgtgaagttcagggataaagtcagttgtgtggagtttgacttgaatgtaaacaatattgttggaataagaaacacattccttctcagaacttatgcataccttgaaaatcgagttcgtccgttagtgctggtgattaagaagtgggcaagtcaccatcagataaatgatgccagtcgtggtactttaagcagctatagtcttgtattgatggttttgcactatttacaaaccctacctgaacccatccttccatccctccaaaaaatttacccagagtcttttagtcctgctatacagctgcaccttgtacatcaagctccatgtaatgttcctccttacctctcaaagaatgaatcaaaccttggggacctcttactgggctttcttaaatattatgctacagaatttgactggaatagtcaaatgatttcagttcgtgaagccaaagccattccaaggcctgatggtattgaatggagaaataaatacatctgtgtagaagaaccttttgatggaacaaatacagccagagcagtgcacgaaaagcagaaatttgatatgatcaaggatcaatttttaaagtcatggcacagattgaaaaacaagagagatttgaacagtatactacctgtaagagctgctgtcctgaaaagataactggcctctatttcttaataaattcttccaagaaataaagaacaatagtttcatcataatacattatgtttacctccatcatagttgcttttttcatagttcttgttttcatgttttatttttaaaaagacatataaagattgcatattttattatgacatttcctaataaacccctttgatttaaaaatgtatttttaaaaatgtttacattgatgatgagtaatattgcatgtgttttcaggtgatcagataaaatatattttgggaaattaactgaacaaataaaaagtttttgatataacttcaattaattgtaccacatgctaatcctgaagagatgtgtagaattttggaaagggtctaattcatacatgcttaaagtataacctacgttagatagtttgttgtcaaagtctgttctagtaaagtgaagattcaagtcagttgttcagttacttgaagcaaaacgaaatctttcatttcagtcaaatcactgcagtcatgaaatactgaacaattgccttaagtctttgcttgactcactgggatagactgaggctttgggtgtgtctgtattagcatttcattagtacttcacatgcttttgatgtactcttgagattgctttaaattttgtattgaaacaacaatacattttgcactgtagtaatgggagcactaactcttacaacagttagtgaatcgttttaaagaatcagttcagtgtagacattttgaaaagattgtttcctgtgctttacgatagcttagtgcaatgtgcacttctgttttacttgccattttcctgctctgttttctctgtgacatgaagcaacagaaactgagatcaaagttaagattatatcctgtttgtagtatcagatatttttctgtgtacaattataggattgtaatctaaactggaatttttaggcagtaagtcaccacaaaatgttttagataagacacaataaaattattataaataaaagcttaatgtttgtaaaaaatctcttttttagtatttcttttttcacatgaaagaagtggtggctgctaaaaaaaaagctacagtgtttattaagggtctttttgatttatgtaaatatttgtaaattggtcagtgcctgtaaatttaaatataaaaagtaaccttgaaaacagttttaactttttcaaaagaactatgtccaacattttttagacctgctgtagtacagttttgtacctctaacgtattttttttttgcagaccaaatgctaaaacttttgcttttctttgacttgtaaaaggtgcacattttcattttcttccttaagttcaaatttttgtatgatgtcaaatgcaataaaatttatatatggacattgtt

SEQ ID NO: 163613 - DNA, 2204 bp, Homo sapiens
  Payload ID: 12219
  Gene Symbol: PAPD4
  Gene Name: PAP associated domain containing 4
  Uniprot ID: Q6PIY7
  ENST ID: ENST00000428308
  CDS Start-End: 443-1897
ctacgccgctttttcggcgactttttgctcttccgctttttgccaccgcccccaaccttctatatccttgcagcccctaccttttcttgtgttgctcctcccctggcagccgtgaggggggttagatctcagccggagccggagctgggcctagctgtcccacgggccaccactacctcctttggttcgggagaaagctacgaccaagtacgcccagctcgggccttagaacttctgaacgggcagtgcgggaccaaaagaggaagatagtcttgggacccttgcatggtgtttcaaagggtggtgaagaactaaggggctccagagcttgatatatttctgggaatttggaatatgctaaactagatttctgccctagactaaacatctggctgtggactcaatgtagaagaatacatgttcacttccagtgaacaagagcatgttcccaaactcaattttgggtcgcccacccttcactccaaatcatcaacaacataataacttctttaccctgtcacctactgtttattcacaccagcagcttatagatgcacaattcaactttcagaatgcagacttgtctagagctgtgtcattacagcagctgacatatggaaatgtcagtccaatacagacctcagcttccccattatttcgaggaaggaagagattaagcgatgaaaaaaaccttcctcttgacggtaaacggcaacgtttccattcaccccaccaagagccaactgtagttaaccagatagtgcctttatcaggtgaacgaagatactcaatgccaccattgtttcatacacattatgtaccagatatagtcagatgtgttccaccttttcgagaaattgcatttttagaacctagagaaatcacactgcctgaggccaaagataagttgagtcagcagatactggagttatttgaaacatgtcagcagcaaataagtgatttaaagaagaaagaactctgtcgaacacagctgcagagagaaattcagctgttatttccacaaagcagactttttttggttgggtcctctttaaatggatttggtacccggagcagtgatggtgatttatgcctagttgttaaggaagaaccatgtttttttcaggtaaatcagaagactgaagcacggcatatactcaccttagtccataaacacttctgtactagactttcgggctacattgagagacctcagctgattcgagcaaaagtgccaattgtgaagttcagggataaagtcagttgtgtggagtttgacttgaatgtaaacaatattgttggaataagaaacacattccttctcagaacttatgcataccttgaaaatcgagttcgtccgttagtgctggtgattaagaagtgggcaagtcaccatcagataaatgatgccagtcgtggtactttaagcagctatagtcttgtattgatggttttgcactatttacaaaccctacctgaacccatccttccatccctccaaaaaatttacccagagtcttttagtcctgctatacagctgcaccttgtacatcaagctccatgtaatgttcctccttacctctcaaagaatgaatcaaaccttggggacctcttactgggctttcttaaatattatgctacagaatttgactggaatagtcaaatgatttcagttcgtgaagccaaagccattccaaggcctgatggtattgaatggagaaataaatacatctgtgtagaagaaccttttgatggaacaaatacagccagagcagtgcacgaaaagcagaaatttgatatgatcaaggatcaatttttaaagtcatggcacagattgaaaaacaagagagatttgaacagtatactacctgtaagagctgctgtcctgaaaagataactggcctctatttcttaataaattcttccaagaaataaagaacaatagtttcatcataatacattatgtttacctccatcatagttgcttttttcatagttcttgttttcatgttttatttttaaaaagacatataaagattgcatattttattatgacatttcctaataaacccctttgatttaaaaatgtatttttaaaaatgtttacattgatgatgagtaatattgcatgtgttttcaggtgatcagataaaatatattttgggaaattaactgaacaaataaaaagtttttgatataacttc

SEQ ID NO: 163614 - DNA, 3523 bp, Homo sapiens
  Payload ID: 12219
  Gene Symbol: PAPD4
  Gene Name: PAP associated domain containing 4
  Uniprot ID: Q6PIY7
  ENST ID: ENST00000453514
  CDS Start-End: 694-2148
cgctccccgctgcctattctcatccggggtcacgtcggtcttccgggtgtctttgacagggttttctacgccgctttttcggcgactttttgctcttccgctttttgccaccgcccccaaccttctatatccttgcagcccctaccttttcttgtgttgctcctcccctggcagccgtgaggggggttagatctcagccggagccggagctgggcctagctgtcccacgggccaccactacctcctttggttcgggagaaagctacgaccaagtacgcccagctcgggccttagaacttctgaacgggcagtgcgggtaggccctgcttagcccttcccggaggacacctgtgagtttagggggtttcggagaggaacgcagcagtgtaggcccaggtcggcggcggggcacgggaaacttttccgaaacggtagcgttttgttttgcgtgggaggttccagcagtatctcttggttattccaaatttatgggcggcatctgggctgctgtacattttgaagaatcttaggaccgcttactttgcttactcgttttctattcctcgcgtactgcctcgtccaccactccaggaccaaaagaggaagatagtcttgggacccttgcatggtgtttcaaagggtggtgaagaactaaggtagaagaatacatgttcacttccagtgaacaagagcatgttcccaaactcaattttgggtcgcccacccttcactccaaatcatcaacaacataataacttctttaccctgtcacctactgtttattcacaccagcagcttatagatgcacaattcaactttcagaatgcagacttgtctagagctgtgtcattacagcagctgacatatggaaatgtcagtccaatacagacctcagcttccccattatttcgaggaaggaagagattaagcgatgaaaaaaaccttcctcttgacggtaaacggcaacgtttccattcaccccaccaagagccaactgtagttaaccagatagtgcctttatcaggtgaacgaagatactcaatgccaccattgtttcatacacattatgtaccagatatagtcagatgtgttccaccttttcgagaaattgcatttttagaacctagagaaatcacactgcctgaggccaaagataagttgagtcagcagatactggagttatttgaaacatgtcagcagcaaataagtgatttaaagaagaaagaactctgtcgaacacagctgcagagagaaattcagctgttatttccacaaagcagactttttttggttgggtcctctttaaatggatttggtacccggagcagtgatggtgatttatgcctagttgttaaggaagaaccatgtttttttcaggtaaatcagaagactgaagcacggcatatactcaccttagtccataaacacttctgtactagactttcgggctacattgagagacctcagctgattcgagcaaaagtgccaattgtgaagttcagggataaagtcagttgtgtggagtttgacttgaatgtaaacaatattgttggaataagaaacacattccttctcagaacttatgcataccttgaaaatcgagttcgtccgttagtgctggtgattaagaagtgggcaagtcaccatcagataaatgatgccagtcgtggtactttaagcagctatagtcttgtattgatggttttgcactatttacaaaccctacctgaacccatccttccatccctccaaaaaatttacccagagtcttttagtcctgctatacagctgcaccttgtacatcaagctccatgtaatgttcctccttacctctcaaagaatgaatcaaaccttggggacctcttactgggctttcttaaatattatgctacagaatttgactggaatagtcaaatgatttcagttcgtgaagccaaagccattccaaggcctgatggtattgaatggagaaataaatacatctgtgtagaagaaccttttgatggaacaaatacagccagagcagtgcacgaaaagcagaaatttgatatgatcaaggatcaatttttaaagtcatggcacagattgaaaaacaagagagatttgaacagtatactacctgtaagagctgctgtcctgaaaagataactggcctctatttcttaataaattcttccaagaaataaagaacaatagtttcatcataatacattatgtttacctccatcatagttgcttttttcatagttcttgttttcatgttttatttttaaaaagacatataaagattgcatattttattatgacatttcctaataaacccctttgatttaaaaatgtatttttaaaaatgtttacattgatgatgagtaatattgcatgtgttttcaggtgatcagataaaatatattttgggaaattaactgaacaaataaaaagtttttgatataacttcaattaattgtaccacatgctaatcctgaagagatgtgtagaattttggaaagggtctaattcatacatgcttaaagtataacctacgttagatagtttgttgtcaaagtctgttctagtaaagtgaagattcaagtcagttgttcagttacttgaagcaaaacgaaatctttcatttcagtcaaatcactgcagtcatgaaatactgaacaattgccttaagtctttgcttgactcactgggatagactgaggctttgggtgtgtctgtattagcatttcattagtacttcacatgcttttgatgtactcttgagattgctttaaattttgtattgaaacaacaatacattttgcactgtagtaatgggagcactaactcttacaacagttagtgaatcgttttaaagaatcagttcagtgtagacattttgaaaagattgtttcctgtgctttacgatagcttagtgcaatgtgcacttctgttttacttgccattttcctgctctgttttctctgtgacatgaagcaacagaaactgagatcaaagttaagattatatcctgtttgtagtatcagatatttttctgtgtacaattataggattgtaatctaaactggaatttttaggcagtaagtcaccacaaaatgttttagataagacacaataaaattattataaataaaagcttaatgtttgtaaaaaatctcttttttagtatttcttttttcacatgaaagaagtggtggctgctaaaaaaaaagctacagtgtttattaagggtctttttgatttatgtaaatatttgtaaattggtcagtgcctgtaaatttaaatataaaaagtaaccttgaaaacagttttaactttttcaaaagaactatgtccaacattttttagacctgctgtagtacagttttgtacctctaacgtattttttttttgcagaccaaatgctaaaacttttgcttttctttgacttgtaaaaggtgcacattttcattttcttccttaagttcaaatttttgtatgatgtcaaatgcaataaaatttatatatggacattgtt

SEQ ID NO: 163615 - DNA, 2997 bp, Homo sapiens
  Payload ID: 12219
  Gene Symbol: PAPD4
  Gene Name: PAP associated domain containing 4
  ENST ID: ENST00000504233
  CDS Start-End: 679-2004
attctcatccggggtcacgtcggtcttccgggtgtctttgacagggttttctacgccgctttttcggcgactttttgctcttccgctttttgccaccgcccccaaccttctatatccttgcagcccctaccttttcttgtgttgctcctcccctggcagccgtgaggggggttagatctcagccggagccggagctgggcctagctgtcccacgggccaccactacctcctttggttcgggagaaagctacgaccaagtacgcccagctcgggccttagaacttctgaacgggcagtgcgggtaggccctgcttagcccttcccggaggacacctgtgagtttagggggtttcggagaggaacgcagcagtgtaggcccaggtcggcggcggggcacgggaaacttttccgaaacggtagcgttttgttttgcgtgggaggttccagcagtatctcttggttattccaaatttatgggcggcatctgggctgctgtacattttgaagaatcttaggaccgcttactttgcttactcgttttctattcctcgcgtactgcctcgtccaccactccaggaccaaaagaggaagatagtcttgggacccttgcatggtgtttcaaagggtggtgaagaactaaggtagaagaatacatgttcacttccagtgaacaagagcatgttcccaaactcaattttgggtcgcccacccttcactccaaatcatcaacaacataataacttctttaccctgtcacctactgtttattcacaccagcagcttatagatgcacaattcaactttcagaatgcagacttgtctagagctgtgtcattacagcagctgacatatggaaatgtcagtccaatacagacctcagcttccccattatttcgaggaaggaagagattaagcgatgaaaaaaaccttcctcttgacggtaaacggcaacgtttccattcaccccaccaagagccaactgtagttaaccagatagtgcctttatcaggtgaacgaagatactcaatgccaccattgtttcatacacattatgtaccagatatagtcagatgtgttccaccttttcgagaaattgcatttttagaacctagagaaatcacactgcctgaggccaaagataagttgagtcagcagatactggagttatttgaaacatgtcagcagcaaataagtgatttaaagaagaaagaactctgtcgaacacagctgcagagagaaattcagctgttatttccacaaagcagactttttttggttgggtcctctttaaatggatttggtacccggagcagtgatggtgatttatgcctagttgttaaggaagaaccatgtttttttcaggtaaatcagaagactgaagcacggcatatactcaccttagtccataaacacttctgtactagactttcgggctacattgagagacctcagctgattcgagcaaaagtgccaattgtgaagttcagggataaagtcagttgtgtggagtttgacttgaatgtaaacaatattgttggaataagaaacacattccttctcagaacttatgcataccccctacctgaacccatccttccatccctccaaaaaatttacccagagtcttttagtcctgctatacagctgcaccttgtacatcaagctccatgtaatgttcctccttacctctcaaagaatgaatcaaaccttggggacctcttactgggctttcttaaatattatgctacagaatttgactggaatagtcaaatgatttcagttcgtgaagccaaagccattccaaggcctgatggtattgaatggagaaataaatacatctgtgtagaagaaccttttgatggaacaaatacagccagagcagtgcacgaaaagcagaaatttgatatgatcaaggatcaatttttaaagtcatggcacagattgaaaaacaagagagatttgaacagtatactacctgtaagagctgctgtcctgaaaagataactggcctctatttcttaataaattcttccaagaaataaagaacaatagtttcatcataatacattatgtttacctccatcatagttgcttttttcatagttcttgttttcatgttttatttttaaaaagacatataaagattgcatattttattatgacatttcctaataaacccctttgatttaaaaatgtatttttaaaaatgtttacattgatgatgagtaatattgcatgtgttttcaggtgatcagataaaatatattttgggaaattaactgaacaaataaaaagtttttgatataacttcaattaattgtaccacatgctaatcctgaagagatgtgtagaattttggaaagggtctaattcatacatgcttaaagtataacctacgttagatagtttgttgtcaaagtctgttctagtaaagtgaagattcaagtcagttgttcagttacttgaagcaaaacgaaatctttcatttcagtcaaatcactgcagtcatgaaatactgaacaattgccttaagtctttgcttgactcactgggatagactgaggctttgggtgtgtctgtattagcatttcattagtacttcacatgcttttgatgtactcttgagattgctttaaattttgtattgaaacaacaatacattttgcactgtagtaatgggagcactaactcttacaacagttagtgaatcgttttaaagaatcagttcagtgtagacattttgaaaagattgtttcctgtgctttacgatagcttagtgcaatgtgcacttctgttttacttgccattttcctgctctgttttctctgtgacatgaagcaacagaaactgagatcaaagttaagattatatcctgtttgtagtatcagatatttttctgtgtacaattataggattgtaatctaaactggaatttttaggcagtaagtcaccacaaaatgttttagataagacacaataaaattattataaataaaa

SEQ ID NO: 163616 - DNA, 7233 bp, Homo sapiens
  Payload ID: 12220
  Gene Symbol: PAPD5
  Gene Name: PAP associated domain containing 5
  ENST ID: ENST00000357464
  CDS Start-End: 1-910
gatatttggaagttttaaaactggactttatttacctactagtgacatcgacctagtggtgtttgggaagtgggagaacctacccctctggactctggaagaagctcttcggaaacacaaagtcgcagatgaggattcggtgaaagttttagacaaagcaactgtacctattattaaattaacagattcttttactgaagtgaaagttgatatcagctttaatgtacagaatggcgtgagagcagctgacctcatcaaagattttaccaagaaatatcctgtattgccatacttggttttagtattgaaacaattcctattgcagagggaccttaatgaagtatttacaggtggaattggttcttatagtctctttttaatggcagtcagtttccttcagttacatcccagggaagatgcttgcatccccaatacaaactatggtgttctcttaatagaattttttgaattatatggacgacacttcaattatttaaagactggcatccggataaaggatggtggttcatatgtggccaaagatgaagtacagaaaaatatgctagatggctacaggccatcaatgctttatatcgaagatcctttacaaccaggtaacgatgttggaaggagttcatatggggccatgcaagtgaagcaggcctttgattatgcctacgttgttttgagtcatgctgtatcaccaatagcaaagtactatcccaacaatgaaacagaaagcatactaggtagaataattagagtaacagatgaagttgccacatatagagattggatatcaaagcagtggggcttgaagaatagacctgagccttcatgcaatggtaagatattttccttggtccagtgtcgtcctcttctgccacacagtccagctctagtgatgtagattccgatgcaacaccatgcaaaaccccgaaacagctgctttgccgtccgtccactgggaaccgagtagggtcgcaagatgtatccttggagtcctctcaggcagttgggaaaatgcaaagcacccaaaccactaacacatccaacagcaccaacaaatctcagcatggatcagcaaggctctttcgttcttccagcaaaggcttccaaggtacaactcaaacaagccatggttccttgatgacaaacaaacaacatcaaggcaaatccaataatcagtattaccatggcaaaaagaggaaacacaagagggacgcgcccctctcagacctctgtagatagtcagcgctgcgcggtggactgtcttctctgtgcaatgatctcatgctcaggacagttgcgcagggactcctgggagatattcaggagcctcacactgttcagacgttgacttagcaactgcgttttttcccagctcgccacagaatggatcatgaagactgacaactgcaaaaaaaacaaaacaaaacaaaaaaaaaagcaagcaaaaaagagggaaaaaaaaggctgcttatttgataagtcatatgctacaacagggtcattttaagatttaaagcttgaatgtaaaataaatatatttctcattggctttatgcagagttatagggaatagtattcagtgttggtagggtgatagaaacaaaaaacagtatcagaggatgaggtggggaaggaaaacaaaggtatctgataggaagtccagattccaaaggggaaagtgatctgtgcatgttttttttttaaatatttttgcatatatttaccattttattgtgtgtatatatagaagaccatataggagattgatatttgtaatagtggatttgttaataatactttttacataacattactgtttaaattgtaaacagattttttctcaggattagtttgaaaaataatctaaattgtcatcttaacatccatatatagggaagtgattagttctattactcaatttgtttttctcagcattgaaatgacttaatagaacccttgtgtcctgctgcaaaaatttttcctctctaaagaaaaggtttatggtggcaaatgatgtttattttattttgtaaaaaaaaaaaaatgtactatgtacttttgtgtaaacactgaaaaatctctggtcatctccgagaattaacttgcaactgttttctatagtgctgtcgtcttgggcaatgggcaattacatgactttgtgtttgcttcctttgcagtcttttttttttccccccatttcttcctaataggaaaaaaaaaaaaaaaaaggtcacccatgtctggtctcattcctgttgcagtgaaacttcgagttccacagactttgcatgctggcttctctaaccctgtgtgctgcgtgtgcctgtttctcatctcttattctttttaaaattcatgcttaactactgtgggagaataactgtaaacagctttaattaaatcatacttataaaaaactattttcttatattccactctatgcttttggtattgttgatctttacaaattaaatggtctttgataatggatctattttgtattgccttattaagaccaaatacttcttgtcatcccattctttatcctcttctttcatggaattgttatcgttaattaaaacttttttaaacattggcttgtttcaatcatactgtaaattttggttgtagtcagctttgagtgcaatgagatgtataattctgttatcattacctgttgagtttgaaactcagttgggaatatttaatataatagaatgtaagtgacatttctgaaaatgctttctttcagggtgaaagctcttatgtttagcatcaatgtgtatggctctgttaaatgcagccatttctgagacgagattcttttatatatatatacatataaagtactattggcttttaggagtttcttttatatacatttatgaaatactgaagaccaatcagaccattaatggacacttagtgtaactttttataaagaaaataatgctaaagtaagaccaaaactgatgtcatcactgaaattaacaattttcaatatgttcatattttaattcacaatggaaaaatgtgttccaaaactggaaactcatagtactcgtgtaaactgtggaagatttcaaatgtgatgttattttgacaatgttttaaattttagagtcacattttattctgatcagaatttttattgagatgttgagcttttgtttttgaaactagtttgtcataacattgtgcataatcacagtatttattttctaggacaattgtgaatgtgtagacttatgtttactgctaagggaacaattatttataaaataatattaaatccagtattagctgcctatttcagacacttaatacttgcagagatctatgttacatttaccacactgaagttttttttgttgttttttgtttgtttttaaagaatcaccctcattgttgaaagtaaatgtactcttagggtgcgaatattagtgttccaataagcatgtgattatattaaggtggtggtagcgggaagataattctgattccattgggaatcttaggttttcgtaaatttattgggaaaatagtttttcctgtactgctgaagtttctttttggtaaacagtatctttctaaaagaaaaaagcatgaaggagaaattgaggtgtgtatacatttcctcaaatgaccagcattgtattcgtgaatactgtgtatcttgcagtgaacagtgtggaagctgttcatttttcaatctgaagtaaaatactttcaagaacttttagtttgcctgctcatttgttttatacatttcatctatttgactcctatcttatttcttttttgagttttaatacttcctatattttgtgaatatatcagaaatgtgtcatttatatattagagtccattcatatccatgaatcataaccttcctttgctaatacttgttgaatgggattttacaaattctccctcactctggtgacatttctcaggcagtcatgtatgtgtacctggccattagaaatattaatatttaaagactgttttttagaggagctgatgggttggtgaggtgtcagcacaaaatcttactggttatgttttgatgataaaagtatatccattttttccctccagctttaaggtgactgtgaaggtgcctggttttgaatgtctttgtttggtttggagatgtcgcactcagttttcaaatctagcttggatctgtaggacctatgttttttacaagtaattgccctccagtcttcaacagttgattctgttttatttttatcctgttttgagtgtactttacctttacttgcattttgagcctcattaatatttaggttatttgatttggctccagatattcctagatctgcacagggcaaaacatgggctatagggtgagcatttttaattgtctttttctgctggaaccttatatctctccatgtgttttctgctccttccctcccccatgaaatggtaagtgtgacttgtgtttgcctgaacctgtggactagtgtttggggtttctggaaacactagagggtcagaaaagagtaatgaccaccgtgacgtgcaggattctcttgctgtgacatgttcattgcaaagccctctccagtgactaggaggtgtagttattaaggttgatctgttagaaatcaccattattaggtattagtggtagatgttgctgatacttttattggtcatgactacatctcagttttactttaatattgatctatagtttgatcagttccttgaattctaatatgttgatttctcagtgtttctgtcactaaccaagaatgtttctaggcagttggttgcttcacagtcaaaactaaatggtaaactatcaaaaatacattcccaattttgctgtgataaatattgaaatgttaaaattaatgaacagaagaatttattcttacccatctattcttgttctcctagttcattaaactttcagttattggaaaggcacattctcaaagtattttatgagcaaaatattctataaatgcgtctaacaaacctaattgaatataaaagttatatttagtagttactgttgatagtaattttcatcagggtcatagttcatctagtaaaatatttagagaatgatgttaacattccagcattaaagtgggaacaaagatttatatatgaaattccttaaaagagttcatcttgccttggtttctgaccctcaagactctagctacctgccatcttgtcaaaacatttgtgggtagaataagtgttaaagatcaaattttaatatgcttctcgatatttaacatagctaagaagccagattttactgtagaagttatttacatgatttgaaaacttgacctaactggaagcctttttctcagtcatcttgttctaagccatcttgacttcacacccttagcgacttttcttttttttttggtcaaagataatgagctaaatatatatagacgttgaatgttgacaaaattattaaccagaaaaattgcttataaaggctgctgatctatttgatacctagaattaaatatttgaggacagtttttagttaataaactgctaatgtttattttactgtctctcaggtttttggtttttttaaaaaaaatgtgtttggcctttacattttctacttaagtgtgtactttattgagtttaaccttgtctgtagcctagtagcctgaaagaaaaggagacagaaccagagagatggatgtagtgcattccctttggttattacacatttgtggtagctcctggatttactgagagatattttagctatgtcaataagaacagctaatgatgtggaaatcaggtgttctcttgtgtatttcagtgaacatttttattagtagttgcatatcatctctagttccacattttaacttaacgtctttgtggcttcaccactgagctacctttcactacaccagcttctgtgtggcctggtaacatggaaggtctctcctaaggacagtctggacgtattttgggggaatgttatttatcttaaagatgcctagaaacaaaacgcatatagtaccagtgagaaactatgaagtaaacaagttgctcaggccgggcatggtggctcacgcctgtaatcccagcactttgggaggccgaagcgggaggatggcttgaggctgggagtttgagaccttcatctcttaaaaaaacaaacaaaaacctgaatggtgaggtgtggtggaattgggtaggggagggaaaggaggacttggaaaagcattctccaaagccagcaacttggtgaagttcagtacttgcctcttagaggttaggccatgcctttcaaagagagtgaaatgatgggttatcagccacattcttggagttaatatttttcttcatctttcagtttgggttctgtgctattcatagttcttccctaagaccatttcattattaccttttatatttagttgcaatttattataatatgttgttttgtccctgaacttaatctcctaattttaagatcctctctgatttttgcatattgaaacttacagaagtcactttaaaaaagtcttttgaaagtcctacaatcctaaaataaatcacaagcttgtttgttagacgtgtcaagagtctccagtctttactactaaaaagcagcactgccttaacacacattgttatgggtgaaaagtgagggacgaccagtgtagtttctggatataaagtgtgaaggactgttgagttaaacatttttagtggaatatacatagataacgtgtatttagaaactttggtgaagccagtatttgtttttagtaacctttttatgtatttccttctttgattagcattgtcttcagtgttaagaaatgtggactcctgtgaggtgctggaggtttgaatcatcttgaaaactttccaatcttgtctagttaccactgcagagacactaaggaatttaccagaaaaagatatttgatacaagtgatttaagaaatctcaacatttcctgaggccgtatcactgggcaaccagtgatgaaaactatgaatgaattgcacacctggaagattttttaagctaatgacagtttcttcaaagatgtcaattatttgccttggaaattttataaattgcatttctatgcacatcggcctctagtgcttaccactcggtttattattcataatctgcaattcaataaaggctttgtgttttcatttatcttcaaaa

SEQ ID NO: 163617 - DNA, 4635 bp, Homo sapiens
  Payload ID: 12220
  Gene Symbol: PAPD5
  Gene Name: PAP associated domain containing 5
  Uniprot ID: Q8NDF8
  ENST ID: ENST00000436909
  CDS Start-End: 36-2132
acaacgcgctccctgcggggcgggcggcaacctccatgcggcctcgtccacgctcagcaccggggaagccgaggcggagaagccgcgcgcgcctcagaagctcccggacgcccagcggcggcgcgagcggcggcggcggcagcagcagcagcagcagcacggccaccggcgggagcggcagcagcaccggcagccccggcggcgcggcctcggccccggccccggccccggccggcatgtatcgctccggggagcgcctgctgggcagccacgcgctgcccgcggagcagcgggacttcctgcccctagagacgaccaacaacaacaacaaccaccaccagcccggggcctgggcccgccgggcgggctcctcggcgtcctcgcctccctcggcgtcctcgtccccgcacccttcggccgccgtccccgccgccgatccagccgattcggcctcgggcagcagcaacaagaggaagcgcgacaacaaggccagcacgtatggactcaactacagcctgctgcagcccagcggagggcgggccgcggggggcggccgagcagacggcggcggggtcgtgtacagcgggaccccgtggaaacggaggaactacaaccagggagtcgtgggtctgcatgaagaaatcagtgatttttatgaatacatgtctccaagacctgaggaggagaagatgcggatggaggtggtgaacaggatcgagagtgtaattaaggagctctggcccagcgctgacgtccagatatttggaagttttaaaactggactttatttacctactagtgacatcgacctagtggtgtttgggaagtgggagaacctacccctctggactctggaagaagctcttcggaaacacaaagtcgcagatgaggattcggtgaaagttttagacaaagcaactgtacctattattaaattaacagattcttttactgaagtgaaagttgatatcagctttaatgtacagaatggcgtgagagcagctgacctcatcaaagattttaccaagaaatatcctgtattgccatacttggttttagtattgaaacaattcctattgcagagggaccttaatgaagtatttacaggtggaattggttcttatagtctctttttaatggcagtcagtttccttcagttacatcccagggaagatgcttgcatccccaatacaaactatggtgttctcttaatagaattttttgaattatatggacgacacttcaattatttaaagactggcatccggataaaggatggtggttcatatgtggccaaagatgaagtacagaaaaatatgctagatggctacaggccatcaatgctttatatcgaagatcctttacaaccaggtaacgatgttggaaggagttcatatggggccatgcaagtgaagcaggcctttgattatgcctacgttgttttgagtcatgctgtatcaccaatagcaaagtactatcccaacaatgaaacagaaagcatactaggtagaataattagagtaacagatgaagttgccacatatagagattggatatcaaagcagtggggcttgaagaatagacctgagccttcatgcaatggaaatggtgttaccttgatagtagatactcagcagttagataaatgtaataataatctatctgaagaaaatgaagcccttggaaaatgtagaagtaaaacctcggaatctcttagtaaacactcttcaaactcttcatcaggtccagtgtcgtcctcttctgccacacagtccagctctagtgatgtagattccgatgcaacaccatgcaaaaccccgaaacagctgctttgccgtccgtccactgggaaccgagtagggtcgcaagatgtatccttggagtcctctcaggcagttgggaaaatgcaaagcacccaaaccactaacacatccaacagcaccaacaaatctcagcatggatcagcaaggctctttcgttcttccagcaaaggcttccaaggtacaactcaaacaagccatggttccttgatgacaaacaaacaacatcaaggcaaatccaataatcagtattaccatggcaaaaagaggaaacacaagagggacgcgcccctctcagacctctgtagatagtcagcgctgcgcggtggactgtcttctctgtgcaatgatctcatgctcaggacagttgcgcagggactcctgggagatattcaggagcctcacactgttcagacgttgacttagcaactgcgttttttcccagctcgccacagaatggatcatgaagactgacaactgcaaaaaaaacaaaacaaaacaaaaaaaaaagcaagcaaaaaagagggaaaaaaaaggctgcttatttgataagtcatatgctacaacagggtcattttaagatttaaagcttgaatgtaaaataaatatatttctcattggctttatgcagagttatagggaatagtattcagtgttggtagggtgatagaaacaaaaaacagtatcagaggatgaggtggggaaggaaaacaaaggtatctgataggaagtccagattccaaaggggaaagtgatctgtgcatgttttttttttaaatatttttgcatatatttaccattttattgtgtgtatatatagaagaccatataggagattgatatttgtaatagtggatttgttaataatactttttacataacattactgtttaaattgtaaacagattttttctcaggattagtttgaaaaataatctaaattgtcatcttaacatccatatatagggaagtgattagttctattactcaatttgtttttctcagcattgaaatgacttaatagaacccttgtgtcctgctgcaaaaatttttcctctctaaagaaaaggtttatggtggcaaatgatgtttattttattttgtaaaaaaaaaaaaatgtactatgtacttttgtgtaaacactgaaaaatctctggtcatctccgagaattaacttgcaactgttttctatagtgctgtcgtcttgggcaatgggcaattacatgactttgtgtttgcttcctttgcagtcttttttttttccccccatttcttcctaataggaaaaaaaaaaaaaaaaaggtcacccatgtctggtctcattcctgttgcagtgaaacttcgagttccacagactttgcatgctggcttctctaaccctgtgtgctgcgtgtgcctgtttctcatctcttattctttttaaaattcatgcttaactactgtgggagaataactgtaaacagctttaattaaatcatacttataaaaaactattttcttatattccactctatgcttttggtattgttgatctttacaaattaaatggtctttgataatggatctattttgtattgccttattaagaccaaatacttcttgtcatcccattctttatcctcttctttcatggaattgttatcgttaattaaaacttttttaaacattggcttgtttcaatcatactgtaaattttggttgtagtcagctttgagtgcaatgagatgtataattctgttatcattacctgttgagtttgaaactcagttgggaatatttaatataatagaatgtaagtgacatttctgaaaatgctttctttcagggtgaaagctcttatgtttagcatcaatgtgtatggctctgttaaatgcagccatttctgagacgagattcttttatatatatatacatataaagtactattggcttttaggagtttcttttatatacatttatgaaatactgaagaccaatcagaccattaatggacacttagtgtaactttttataaagaaaataatgctaaagtaagaccaaaactgatgtcatcactgaaattaacaattttcaatatgttcatattttaattcacaatggaaaaatgtgttccaaaactggaaactcatagtactcgtgtaaactgtggaagatttcaaatgtgatgttattttgacaatgttttaaattttagagtcacattttattctgatcagaatttttattgagatgttgagcttttgtttttgaaactagtttgtcataacattgtgcataatcacagtatttattttctaggacaattgtgaatgtgtagacttatgtttactgctaagggaacaattatttataaaataatattaaatccagtattagctgcctatttcagacacttaatacttgcagagatctatgttacatttaccacactgaagttttttttgttgttttttgtttgtttttaaagaatcaccctcattgttgaaagtaaatgtactcttagggtgcgaatattagtgttccaataagcatgtgattatattaaggtggtggtagcgggaagataattctgattccattgggaatcttaggttttcgtaaatttattgggaaaatagtttttcctgtactgctgaagtttctttttggtaaacagtatctttctaaaagaaaaaagcatgaaggagaaattgaggtgtgtatacatttcctcaaatgaccagcattgtattcgtgaatactgtgtatcttgcagtgaacagtgtggaagctgttcatttttcaatctgaagtaaaatactttcaagaactttta

SEQ ID NO: 163618 - DNA, 2916 bp, Homo sapiens
  Payload ID: 12220
  Gene Symbol: PAPD5
  Gene Name: PAP associated domain containing 5
  ENST ID: ENST00000561678
  CDS Start-End: 75-1841
ccaccggcgggagcggcagcagcaccggcagccccggcggcgcggcctcggccccggccccggccccggccggcatgtatcgctccggggagcgcctgctgggcagccacgcgctgcccgcggagcagcgggacttcctgcccctagagacgaccaacaacaacaacaaccaccaccagcccggggcctgggcccgccgggcgggctcctcggcgtcctcgcctccctcggcgtcctcgtccccgcacccttcggccgccgtccccgccgccgatccagccgattcggcctcgggcagcagcaacaagaggaagcgcgacaacaaggccagcacgtatggactcaactacagcctgctgcagcccagcggagggcgggccgcggggggcggccgagcagacggcggcggggtcgtgtacagcgggaccccgtggaaacggaggaactacaaccagggagtcgtgggtctgcatgaagaaatcagtgatttttatgaatacatgtctccaagacctgaggaggagaagatgcggatggaggtggtgaacaggatcgagagtgtaattaaggagctctggcccagcgctgacgtccagatatttggaagttttaaaactggactttatttacctactagtgacatcgacctagtggtgtttgggaagtgggagaacctacccctctggactctggaagaagctcttcggaaacacaaagtcgcagatgaggattcggtgaaagttttagacaaagcaactgtacctattattaaattaacagattcttttactgaagtgaaagttgatatcagctttaatgtacagaatggcgtgagagcagctgacctcatcaaagattttaccaagttacatcccagggaagatgcttgcatccccaatacaaactatggtgttctcttaatagaattttttgaattatatggacgacacttcaattatttaaagactggcatccggataaaggatggtggttcatatgtggccaaagatgaagtacagaaaaatatgctagatggctacaggccatcaatgctttatatcgaagatcctttacaaccaggtaacgatgttggaaggagttcatatggggccatgcaagtgaagcaggcctttgattatgcctacgttgttttgagtcatgctgtatcaccaatagcaaagtactatcccaacaatgaaacagaaagcatactaggtagaataattagagtaacagatgaagttgccacatatagagattggatatcaaagcagtggggcttgaagaatagacctgagccttcatgcaatggaaatggtgttaccttgatagtagatactcagcagttagataaatgtaataataatctatctgaagaaaatgaagcccttggaaaatgtagaagtaaaacctcggaatctcttagtaaacactcttcaaactcttcatcaggtccagtgtcgtcctcttctgccacacagtccagctctagtgatgtagattccgatgcaacaccatgcaaaaccccgaaacagctgctttgccgtccgtccactgggaaccgagtagggtcgcaagatgtatccttggagtcctctcaggcagttgggaaaatgcaaagcacccaaaccactaacacatccaacagcaccaacaaatctcagcatggatcagcaaggctctttcgttcttccagcaaaggcttccaaggtacaactcaaacaagccatggttccttgatgacaaacaaacaacatcaaggcaaatccaataatcagtattaccatggcaaaaagaggaaacacaagagggacgcgcccctctcagacctctgtagatagtcagcgctgcgcggtggactgtcttctctgtgcaatgatctcatgctcaggacagttgcgcagggactcctgggagatattcaggagcctcacactgttcagacgttgacttagcaactgcgttttttcccagctcgccacagaatggatcatgaagactgacaactgcaaaaaaaacaaaacaaaacaaaaaaaaaagcaagcaaaaaagagggaaaaaaaaggctgcttatttgataagtcatatgctacaacagggtcattttaagatttaaagcttgaatgtaaaataaatatatttctcattggctttatgcagagttatagggaatagtattcagtgttggtagggtgatagaaacaaaaaacagtatcagaggatgaggtggggaaggaaaacaaaggtatctgataggaagtccagattccaaaggggaaagtgatctgtgcatgttttttttttaaatatttttgcatatatttaccattttattgtgtgtatatatagaagaccatataggagattgatatttgtaatagtggatttgttaataatactttttacataacattactgtttaaattgtaaacagattttttctcaggattagtttgaaaaataatctaaattgtcatcttaacatccatatatagggaagtgattagttctattactcaatttgtttttctcagcattgaaatgacttaatagaacccttgtgtcctgctgcaaaaatttttcctctctaaagaaaaggtttatggtggcaaatgatgtttattttattttgtaaaaaaaaaaaaatgtactatgtacttttgtgtaaacactgaaaaatctctggtcatctccgagaattaacttgcaactgttttctatagtgctgtcgtcttgggcaatgggcaattacatgactttgtgtttgcttcctttgcagtcttttttttttccccccatttcttcctaataggaaaaaaaaaaaaaaaaaggtcacccatgtctggtctcattcctgttgcagtgaaacttcgagttccacagactttgcatgctggcttctctaaccctgtgtgc

SEQ ID NO: 163619 - DNA, 5459 bp, Homo sapiens
  Payload ID: 12221
  Gene Symbol: PAPD7
  Gene Name: PAP associated domain containing 7
  Uniprot ID: Q5XG87
  ENST ID: ENST00000230859
  CDS Start-End: 978-3356
ccacgctgccctgcgcacgcgcagcgcggctcaggcggcagcccggtgacaccggccctagcgcgcatgtctgcacgccggggtctgcgcgccgcggcgggccgagggcggcgtgcgggccttccagccgctgcctattccacccaacgccggcctagtcagtaatggctcaacgccaccgcctctccctccagcccctcccagtcgcgtagcttctgacgccgtcctcaccccgcccgcggccgacggggccccaacgcgcaggcgcggtaaccacggcggcagtgtctagtgaggatttgaaatcggtcgcgcgtgcgcaccggcgacacggcccggcgaccgaggccgcgcttcctcctgccgcccccgtccccgccccctcccccgcccctcattggagcggacgcggcggcggccccctccttcccccgcgctgtcgccgccgagagtgtcttttcaccgccgccgccgccgccgccgcaggagcgccgagccagcggcgcgagcgtgactgagggctagccgcacgggcggcggcgcctcccgcgggtccttcagccgctcggcgcctgggcccgccccctcggccccgccgcccgcccttctccgatggcctctccccgcggcccgagtggaacgccgccgccgccgcggcccccgcgcccgccccgcgccgcgtgaagcgggagcccggagaccgcagccgcccgctgggacgcgccaagcgccggagccgcccgccgcggcctgccggggcccatcaccgccgccgccgccccacgccggagcccgacgggagcgcggctagagcaggaggccggggctcggcccgcccgccgccgccgccgccgccgccgccaccggcccaggcccgtccgtccgtccgtgcgcgcgcggccgggcctcggggcgcggcgggggcggggccgcgtcggggcgggcgggcgcgcgggccccgcgggggcggcgcgtggatggatccgcgcgtggcctggatccagcccgagcagaaggggccggccaatgccctgtggatgcagatctgggagacctcgcagggcgtgggccgcggcggctcgggcttcgcgtcctatttctgcctcaactcgccggcgctggacacggcggccgcggcgggggcggccgggcggggcagtggcggcctgggccccgcgctgcccgccgcgtcgcccccgccgcccggccccaccgcgcccgccgcgctgccccccgcgctgctgacggcgctggggcccgcggccgagggcgcgcggcgcttgcacaagtcgccgtcgctgtcgtcctcgtcgtcgtcctcctcgtccaacgcggagtcgggcaccgagagccccggctgctcgtcgtcgtcctccagcagcgcctcgctgggccggccgggcggcggccgcggcggcgccttcttcaacttcgccgacggcgcgcccagcgcccctggcacagccaacgggcaccccgggccgcgcggccccgcgcccgccggctccccgtcgcagcaccagttccacccgggtcgccggaaacgcgagaacaaggccagcacctacggcctcaactacctgctgtccggcagccgcgcggccgctctcagcggagggggcggccccggggcccaggcgccgcggcccggcaccccgtggaagagccgcgcgtacagcccgggcatccagggactacatgaggaaataattgacttttataacttcatgtccccttgtcctgaagaagcagctatgagaagagaggtggtgaaacggatcgaaactgtggtgaaagacctttggccgacggctgatgtacagatatttggcagctttagtacaggtctttatcttccaactagcgacatagacctggtggtcttcgggaaatgggagcgtcctcctttacagctgctggagcaagccctgcggaagcacaacgtggctgagccgtgttccatcaaagtccttgacaaggctacggtaccaataataaagctcacagatcaggagactgaagtgaaagttgacatcagctttaacatggagacgggcgtccgggcagcggagttcatcaagaattacatgaagaaatattcattgctgccttacttgattttagtattgaaacagttccttctgcagagggacctgaatgaagtttttacaggtggaattagctcatacagcctaattttaatggccattagctttctacagttgcatccaagaattgatgcccggagagctgatgaaaaccttggaatgcttcttgtagaattttttgaactctatgggagaaattttaattacttgaaaaccggtattagaatcaaagaaggaggtgcctatatcgccaaagaggagatcatgaaagccatgaccagcgggtacagaccgtcgatgctgtgcattgaggaccccctgctgccagggaatgacgttggccggagctcctatggcgccatgcaggtgaagcaggtcttcgattatgcctacatagtgctcagccatgctgtgtcaccgctggccaggtcctatccaaacagagacgccgaaagtactttaggaagaatcatcaaagtaactcaggaggtgattgactaccggaggtggatcaaagagaagtggggcagcaaagcccacccgtcgccaggcatggacagcaggatcaagatcaaagagcgaatagccacatgcaatggggagcagacgcagaaccgagagcccgagtctccctatggccagcgcttgactttgtcgctgtccagcccccagctcctgtcttcaggctcctcggcctcttctgtgtcttcactttctgggagtgacgttgattcagacacaccgccctgcacaacgcccagtgtttaccagttcagtctgcaagcgccagctcctctcatggccggcttacccaccgccttgccaatgcccagtggcaaacctcagcccaccacttccagaacactgatcatgacaaccaacaatcagaccaggtttactatacctccaccgaccctaggggttgctcctgttccttgcagacaagctggtgtagaaggaactgcgtctttgaaagccgtccaccacatgtcttccccggccattccctcagcgtcccccaacccgctctcgagccctcatctgtatcataagcagcacaacggcatgaaactgtccatgaagggctctcacggccacacccaaggcggcggctacagctctgtgggtagcggaggtgtgcggccccctgtgggcaacaggggacaccaccagtataaccgcaccggctggaggaggaaaaaacacacacacacacgggacagtctgcccgtgagcctcagcagataatggctcctggctgcgtcagcctcccccacccctctgcagactgccccgcggcctcggccaccggcaggggaaccgagaccagcaccccgcacgtcagccgggctcgcggcacgcccgccgctgatcactctgcatgtttcttcgtgtggtggtcgcgtccatcttcaagaacagctcgttgtgctcatctgtgaagccttattaaacgtggacgttgttttctgccttcccaggattcttccttcagtgctgaggcaggtcgggctcaggaactgcagggacgtgaacatgcgcttgcggtttgaggtagccgtgtctgttccttcgcggtttgctattttcatttcctgttcgtcaaagcagcagaggagatcaaaccccgttcgtgtgtctttcctccacggataagcttgggaggtcattgttttactgccctcacattttgtttgaaatttcagaactgtttttctatgtaaatattgaaaacttatgatttgtgcaataactcagatattttttatttaatttcctattttcacataagttatatttaagggaggagggaattttttttaaacaagcttaggtcctttcccgagctgcattttctaagttgggtcatcgtgtcggctggttgtctgacgagcatcgttacaaacaccatgatgaggggtttggggttttattttgatgtcttttcttttggtcggaagtgagtgaaggagccaggtcgccctgaaggttttccaaagggcttggctccagagccacctggcagactgcccgtggccctgctgtcgggccccaggccgttgtcctgctctgaccacagagttttaatgttttggttttcacttcttttaaactggacaacaaatccagcatttcaagtgccagaagtataactttctaaggagagaagggttgtcacattataaaatctttaggaaaatgtgaactggaaaacgcttcggtcagttttagtgacatagcctgtgatgatgggtctggtgactattattgcggaccgtggtacccagttttaggaatgtggagaaaggaattctgttgattccgttgaggaatctgtagcgtatgcattcgttctgttaagagcaaatctaggagaagtgcttcagctgcccagtgcgccgtggggagtgttttaacggatcgtgtcgcaggagagcacagcccagcgttggggccgggaccgctggcgcccgacgtcggaagcatacaggtatactatgcaagtgtattctgccacaacaaccactgtctttgttacctttttttgaacaagaatatatccatcctgcctaaccctgagtttttggagcaccacagttgtcctgggagttggttgcatcttgtaggccatctgacttcctgtttttaaaacgggggtctggtcttgctaaacactacaggtaggttggtctttgaagtccactagtggagaatgtcaagacaagatacttattaccatgacatctgatgcatgtgcagcagtggggagttctagattgatctctgaatgtgatcgacgcccagcaaggacaagctttaaaatgtctgcggtctgcccttttgaagcaggactggctcactctgtcattgggagctgtcagctgcgactgcaggttctctaggaggcattccagaatagagtagcacactgtgtctgcagttctcgatgaccgaaagttatcaaaaatatttaaaatatttaaattgtgaacctattgataaagaatatttataaaaactgatctgtaggcctgtactaatctctacgcattagcaatattgactgtaaacccacattaaggaaaccactacgggtctggcagtgcgtgtcccgtggggtgtgcattttaaaactcgattcatagacacaggtaccatgttccatttccgtcatggtgaagcaaatgaattggcctggctaccactgtggtcgcgtgctacaggtttgacaaaaagatatcatgtttcgatttttttgtgtgtggacaacaatatggaagctaaaattgacatatttttatgtaaagtttttctattctttgatttttaataaactttggaaaccagttt

SEQ ID NO: 163620 - DNA, 603 bp, Homo sapiens
  Payload ID: 12221
  Gene Symbol: PAPD7
  Gene Name: PAP associated domain containing 7
  ENST ID: ENST00000515721
  CDS Start-End: 523-603
cccggggcccaggcgccgcggcccggcaccccgtggaagagccgcgcgtacagcccgggcatccaggggtgagtgcgcggggaggccgcgggggcgggggcggggcccatggtcctggccggcgcccgcggtgcagacacccgtcccaggcgcccgggcttttggaggatggatgttgaaggctaaggccaaggcccgactctgcactgaaagttttttttttaaacatcagactcatttatcgtggagtgacttgcccagatcctacaagtaacagtccaagaaaaggggctgctgggtaggacctgcaggtatttgtcttttttactcttgagattggaacgggaaatcgactctctacccctccaccccgcctccgggcaagtgaggaaccccttgtcaaagtggggcgtagataagtgtggagtttcacgtaagttaagttgcagaataatttagcattgccaggaactcgaatcacgtcgaagactacatgaggaaataattgacttttataacttcatgtccccttgtcctgaagaagcagctatgagaagagaggtggtgaaacggatcgaaactgtggtgaaagacctttggccg

SEQ ID NO: 163621 - DNA, 1902 bp, Homo sapiens
  Payload ID: 12221
  Gene Symbol: PAPD7
  Gene Name: PAP associated domain containing 7
  Uniprot ID: Q5XG87
  ENST ID: ENST00000631941
  CDS Start-End: 189-1817
gcttttggaggatggatgttgaaggctaaggccaaggcccgactctgcactgaaagttttttttttaaacatcagactcatttatcgtggagtgacttgcccagatcctacaagtaacagtccaagaaaaggggctgctgggtaggacctgcagactacatgaggaaataattgacttttataacttcatgtccccttgtcctgaagaagcagctatgagaagagaggtggtgaaacggatcgaaactgtggtgaaagacctttggccgacggctgatgtacagatatttggcagctttagtacaggtctttatcttccaactagcgacatagacctggtggtcttcgggaaatgggagcgtcctcctttacagctgctggagcaagccctgcggaagcacaacgtggctgagccgtgttccatcaaagtccttgacaaggctacggtaccaataataaagctcacagatcaggagactgaagtgaaagttgacatcagctttaacatggagacgggcgtccgggcagcggagttcatcaagaattacatgaagaaatattcattgctgccttacttgattttagtattgaaacagttccttctgcagagggacctgaatgaagtttttacaggtggaattagctcatacagcctaattttaatggccattagctttctacagttgcatccaagaattgatgcccggagagctgatgaaaaccttggaatgcttcttgtagaattttttgaactctatgggagaaattttaattacttgaaaaccggtattagaatcaaagaaggaggtgcctatatcgccaaagaggagatcatgaaagccatgaccagcgggtacagaccgtcgatgctgtgcattgaggaccccctgctgccagggaatgacgttggccggagctcctatggcgccatgcaggtgaagcaggtcttcgattatgcctacatagtgctcagccatgctgtgtcaccgctggccaggtcctatccaaacagagacgccgaaagtactttaggaagaatcatcaaagtaactcaggaggtgattgactaccggaggtggatcaaagagaagtggggcagcaaagcccacccgtcgccaggcatggacagcaggatcaagatcaaagagcgaatagccacatgcaatggggagcagacgcagaaccgagagcccgagtctccctatggccagcgcttgactttgtcgctgtccagcccccagctcctgtcttcaggctcctcggcctcttctgtgtcttcactttctgggagtgacgttgattcagacacaccgccctgcacaacgcccagtgtttaccagttcagtctgcaagcgccagctcctctcatggccggcttacccaccgccttgccaatgcccagtggcaaacctcagcccaccacttccagaacactgatcatgacaaccaacaatcagaccaggtttactatacctccaccgaccctaggggttgctcctgttccttgcagacaagctggtgtagaaggaactgcgtctttgaaagccgtccaccacatgtcttccccggccattccctcagcgtcccccaacccgctctcgagccctcatctgtatcataagcagcacaacggcatgaaactgtccatgaagggctctcacggccacacccaaggcggcggctacagctctgtgggtagcggaggtgtgcggccccctgtgggcaacaggggacaccaccagtataaccgcaccggctggaggaggaaaaaacacacacacacacgggacagtctgcccgtgagcctcagcagataatggctcctggctgcgtcagcctcccccacccctctgcagactgccccgcggcctcggccaccggcaggggaaccgagaccagcac

SEQ ID NO: 163622 - DNA, 4182 bp, Homo sapiens
  Payload ID: 12222
  Gene Symbol: PAPLN
  Gene Name: papilin, proteoglycan-like sulfated glycoprotein
  ENST ID: ENST00000216658
  CDS Start-End: 20-2446
ccagcgaagacaggctgagatgcggctgctcctgctcgtgccgctgctgctggctccagcgcccgggtcctcggctcccaaggtgaggcggcagagtgacacctggggaccctggagccagtggagcccctgcagccggacctgtggagggggtgtcagcttccgggagcgcccctgctactcccagaggagagatggaggctccagctgcgtgggccccgcccggagccaccgctcttgtcgcacggagagctgccccgacggcgcccgggacttccgggccgagcagtgcgcggagttcgacggagcggagttccaggggcggcggtatcggtggctgccctactacagcgccccaaacaagtgtgaactgaactgcattcccaagggggagaacttctactacaagcacagggaggctgtggttgatgggacgccctgcgagcctggcaagagggatgtctgtgtggatggcagctgccgggttgtcggctgtgatcacgagctggactcgtccaagcaggaggacaagtgtctgcggtgtgggggtgacggcacgacctgctaccccgtcgcaggcacctttgacgctaatgacctcagccgaggctacaaccagatcctcatagttcccatgggtgccaccagcatcctcatcgacgaggctgctgccagcaggaacttcctggctgtgaagaatgttcgtggggaatactacctcaatgggcactggaccatcgaggcggcccgggccctgccagcagccagcaccatcctgcattacgagcggggtgctgagggggacctggcccctgagcgactccatgcccggggccccacctcggagcccctggtcatcgagctcatcagccaggagcccaaccccggtgtgcactatgagtaccacctgcccctgcgccgccccagccccggcttcagctggagccacggctcatggagtgactgcagcgcggagtgtggcggaggtcaccagtcccgcctggtgttctgcaccatcgaccatgaggcctaccccgaccacatgtgccagcgccagccacggccagctgaccggcgttcctgcaatcttcacccttgcccggagaccaagcgctggaaggcagggccatgggcaccctgctcagcctcctgtggaggaggctcccagtcccgctccgtgtactgcatctcgtctgacggggccggcatccaggaggccgtggaggaggctgagtgtgccgggctgcctgggaagccccctgccattcaggcctgtaacctgcagcgctgtgcagcctggagcccggagccctggggagagtgttctgtcagttgtggcgttggcgtccggaagcggagcgttacttgccggggtgaaaggggttctttgctccataccgcagcgtgctccttggaagaccggccacctctgactgagccctgtgtgcatgaggactgccccctcctcagtgaccaggcctggcatgttggcacctggggtctatgctccaagagctgcagctcgggcactcggaggcgacaggtcatctgtgccattgggccgcccagccactgcgggagcctgcagcactccaagcctgtggatgtggagccttgtaacacgcagccctgtcatctcccccaggaggtccccagcatgcaggatgtgcacacccctgccagcaacccctggatgccgttgggccctcaggagtcccctgcctcagactccagaggccagtggtgggcagcccaggaacacccctcagccaggggtgaccacaggggagaacgaggtgaccccaggggcgaccaaggcacccacctgtcagccctgggccccgctccctctctgcagcagcccccataccagcaacccctgcggtcgggctcagggccccacgactgcagacacagtcctcacgggtgctgccccgatggccacacggcatctctcgggcctcagtggcaaggctgccctggggccccctgtcagcagagcaggtacgggtgctgccctgacagggtatctgtcgctgaggggccccatcacgctggctgcacaaagtcgtatggtggtgacagcaccgggggcatgcccaggtcaagggcagtggcttctacagtccacaacacccaccagccccaggcccagcagaatgagcccagtgagtgccggggctcccagtttggctgttgctatgacaacgtggccactgcagccggtcctcttggggaaggctgtgtgggccagcccagccatggattagcttggcaggtgtggagccctcgttggtgcaggcagccctggggcagttggtgcggctctcctgctcagacgacactgccccggaatcccaggctgcctggcagaaagatggccagcccatctcctctgacaggtgtgtgtgacggccccccgacctcctctgacaggtgtgtgtgacagccccccgacctcctctgacaggttcacgtgacagctccctccacctccgctgacaggcacaggctgcagttcgacggatccctgatcatccaccccctgcaggcagaggacgcgggcacctacagctgtggcagcacccggccaggccgcgactcccagaagatccaacttcgcatcatagggggtgacatggccgtgctgtctgaggctgagctgagccgcttccctcagcccagggacccagctcaggactttggccaagcgggggctgctgggcccctgggggccatcccctcttcacacccacagcctgcaaacaggctgcgtttggaccagaaccagccccgggtggtggatgccagtccaggccagcggatccggatgacctgccgtgccgaaggcttcccgcccccagccatcgagtggcagagagatgggcagcctgtctcttctcccagacaccagctgcagcctgatggctccctggtcattagccgagtggctgtagaagatggcggcttctacacctgtgtcgctttcaatgggcaggaccgagaccagcgatgggtccagctcagagttctgggggagctgacaatctcaggactgccccctactgtgacagtgccagagggtgatacggccaggctattgtgtgtggtagcaggagaaagtgtgaacatcaggtggtccaggaacgggctacctgtgcaggctgatggccaccgtgtccaccagtccccagatggcacgctgctcatttacaacttgcgggccagggatgagggctcctacacgtgcagtgcctaccaggggagccaggcagtcagccgcagcaccgaggtgaaggtggtctcaccagcacccaccgcccagcccagggaccctggcagggactgcgtcgaccagccagagctggccaactgtgatttgatcctgcaggcccagctttgtggcaatgagtattactccagcttctgctgtgccagctgttcacgtttccagcctcacgctcagcccatctggcagtagggatgaaggctagttccagccccagtccaaaatagttcatagggctagggagaaaggaagatggactcttggcttcctctctctggctggcaaagggagttatcttctggaatacattagctctttcaaaaacccacccagtgtttagcctcaacggcagccagttaccagcttctctctgtagccttcagcagtgtttgcatctctgacataaccacaggctgctgttttcaagaagagcaatctgtttggataagaaaaacctttactttacagcttccctttataatttgttacacaggaatagttaaatgcatttgtttgtttgttttttgagacagagtttcactcttgttgcccaggctggagggcaatggcgcgatctcagctcactgcaacctccgtctcctgggttcttgattctcctgtgtcagccttctgagtagctaggattacagatgcctatcaccatgcctgggtaatttttgtatttttagttgagatggggtttcaccatgttggccaggctggtctcgaacttctgacctcagatgatctgcccgcctcagcctcccaaagtgctgggattacaggcatgagccaccacgcccagccatcaatgcattttttttattttttttttgagacagagtttcgcacttcttgcccaggctggagtacaatggtgcgatcttggctca

SEQ ID NO: 163623 - DNA, 5834 bp, Homo sapiens
  Payload ID: 12222
  Gene Symbol: PAPLN
  Gene Name: papilin, proteoglycan-like sulfated glycoprotein
  Uniprot ID: O95428
  ENST ID: ENST00000340738
  CDS Start-End: 103-3858
gcgttccttgcggcccggccgacctcgcgggcttgggcctgggcgggcaccgacggagcggccctggctgcagcctcccggcgccagcgaagacaggctgagatgcggctgctcctgctcgtgccgctgctgctggctccagcgcccgggtcctcggctcccaaggtgaggcggcagagtgacacctggggaccctggagccagtggagcccctgcagccggacctgtggagggggtgtcagcttccgggagcgcccctgctactcccagaggagagatggaggctccagctgcgtgggccccgcccggagccaccgctcttgtcgcacggagagctgccccgacggcgcccgggacttccgggccgagcagtgcgcggagttcgacggagcggagttccaggggcggcggtatcggtggctgccctactacagcgccccaaacaagtgtgaactgaactgcattcccaagggggagaacttctactacaagcacagggaggctgtggttgatgggacgccctgcgagcctggcaagagggatgtctgtgtggatggcagctgccgggttgtcggctgtgatcacgagctggactcgtccaagcaggaggacaagtgtctgcggtgtgggggtgacggcacgacctgctaccccgtcgcaggcacctttgacgctaatgacctcagccgagctgtgaagaatgttcgtggggaatactacctcaatgggcactggaccatcgaggcggcccgggccctgccagcagccagcaccatcctgcattacgagcggggtgctgagggggacctggcccctgagcgactccatgcccggggccccacctcggagcccctggtcatcgagctcatcagccaggagcccaaccccggtgtgcactatgagtaccacctgcccctgcgccgccccagccccggcttcagctggagccacggctcatggagtgactgcagcgcggagtgtggcggaggtcaccagtcccgcctggtgttctgcaccatcgaccatgaggcctaccccgaccacatgtgccagcgccagccacggccagctgaccggcgttcctgcaatcttcacccttgcccggagaccaagcgctggaaggcagggccatgggcaccctgctcagcctcctgtggaggaggctcccagtcccgctccgtgtactgcatctcgtctgacggggccggcatccaggaggccgtggaggaggctgagtgtgccgggctgcctgggaagccccctgccattcaggcctgtaacctgcagcgctgtgcagcctggagcccggagccctggggagagtgttctgtcagttgtggcgttggcgtccggaagcggagcgttacttgccggggtgaaaggggttctttgctccataccgcagcgtgctccttggaagaccggccacctctgactgagccctgtgtgcatgaggactgccccctcctcagtgaccaggcctggcatgttggcacctggggtctatgctccaagagctgcagctcgggcactcggaggcgacaggtcatctgtgccattgggccgcccagccactgcgggagcctgcagcactccaagcctgtggatgtggagccttgtaacacgcagccctgtcatctcccccaggaggtccccagcatgcaggatgtgcacacccctgccagcaacccctggatgccgttgggccctcaggagtcccctgcctcagactccagaggccagtggtgggcagcccaggaacacccctcagccaggggtgaccacaggggagaacgaggtgaccccaggggcgaccaaggcacccacctgtcagccctgggccccgctccctctctgcagcagcccccataccagcaacccctgcggtcgggctcagggccccacgactgcagacacagtcctcacgggtgctgccccgatggccacacggcatctctcgggcctcagtggcaaggctgccctggggccccctgtcagcagagcaggtacgggtgctgccctgacagggtatctgtcgctgaggggccccatcacgctggctgcacaaagtcgtatggtggtgacagcaccgggggcatgcccaggtcaagggcagtggcttctacagtccacaacacccaccagccccaggcccagcagaatgagcccagtgagtgccggggctcccagtttggctgttgctatgacaacgtggccactgcagccggtcctcttggggaaggctgtgtgggccagcccagccatgcctaccccgtgcggtgcctgctgcccagtgcccatggctcttgcgcagactgggctgcccgctggtacttcgttgcctctgtgggccaatgtaaccgcttctggtatggcggctgccatggcaatgccaataactttgcctcggagcaagagtgcatgagcagctgccagggatctctccatgggccccgtcgtccccagcctggggcttctggaaggagcacccacacggatggtggcggcagcagtcctgcaggcgagcaggaacccagccagcacaggacaggggccgcggtgcagagaaagccctggccttctggtggtctctggcggcaagaccaacagcctgggccaggggaggccccccacacccaggcctttggagaatggccatgggggcaggagcttgggtccagggcccctggactgggtggagatgccggatcaccagcgccacccttccacagctcctcctacaggattagcttggcaggtgtggagccctcgttggtgcaggcagccctggggcagttggtgcggctctcctgctcagacgacactgccccggaatcccaggctgcctggcagaaagatggccagcccatctcctctgacaggcacaggctgcagttcgacggatccctgatcatccaccccctgcaggcagaggacgcgggcacctacagctgtggcagcacccggccaggccgcgactcccagaagatccaacttcgcatcatagggggtgacatggccgtgctgtctgaggctgagctgagccgcttccctcagcccagggacccagctcaggactttggccaagcgggggctgctgggcccctgggggccatcccctcttcacacccacagcctgcaaacaggctgcgtttggaccagaaccagccccgggtggtggatgccagtccaggccagcggatccggatgacctgccgtgccgaaggcttcccgcccccagccatcgagtggcagagagatgggcagcctgtctcttctcccagacaccagctgcagcctgatggctccctggtcattagccgagtggctgtagaagatggcggcttctacacctgtgtcgctttcaatgggcaggaccgagaccagcgatgggtccagctcagagttctgggggagctgacaatctcaggactgccccctactgtgacagtgccagagggtgatacggccaggctattgtgtgtggtagcaggagaaagtgtgaacatcaggtggtccaggaacgggctacctgtgcaggctgatggccaccgtgtccaccagtccccagatggcacgctgctcatttacaacttgcgggccagggatgagggctcctacacgtgcagtgcctaccaggggagccaggcagtcagccgcagcaccgaggtgaaggtggtctcaccagcacccaccgcccagcccagggaccctggcagggactgcgtcgaccagccagagctggccaactgtgatttgatcctgcaggcccagctttgtggcaatgagtattactccagcttctgctgtgccagctgttcacgtttccagcctcacgctcagcccatctggcagtagggatgaaggctagttccagccccagtccaaaatagttcatagggctagggagaaaggaagatggactcttggcttcctctctctggctggcaaagggagttatcttctggaatacattagctctttcaaaaacccacccagtgtttagcctcaacggcagccagttaccagcttctctctgtagccttcagcagtgtttgcatctctgacataaccacaggctgctgttttcaagaagagcaatctgtttggataagaaaaacctttactttacagcttccctttataatttgttacacaggaatagttaaatgcatttgtttgtttgttttttgagacagagtttcactcttgttgcccaggctggagggcaatggcgcgatctcagctcactgcaacctccgtctcctgggttcttgattctcctgtgtcagccttctgagtagctaggattacagatgcctatcaccatgcctgggtaatttttgtatttttagttgagatggggtttcaccatgttggccaggctggtctcgaacttctgacctcagatgatctgcccgcctcagcctcccaaagtgctgggattacaggcatgagccaccacgcccagccatcaatgcattttttttattttttttttgagacagagtttcgcacttcttgcccaggctggagtacaatggtgcgatcttggctcactgcaacctccacctcctgggttcaagcgcttctccagcctcagcctcctgagtagctgggattacaggtatgtgccaccatgcctggctaattttgtatttttagtagagacggggtttctccatgttggtcagactggtcttgaactcccgacctcaggtaatccgcccgcctcggcctcccaaaatgctgggattagaggtgtgagccactgtgcccagcccatcaatgtgttttaaagctagctgtcagggttccacttaatttaaagctgggcagggagatgtgtaatgatttcaaagttaacacctgtttgttttctaaagggcatgccaagtcctgctgtatcagggaagtattctgtgctaaaatcagcgatggttcattgctctagtctctctcacccttctaggcagtgcatcagtcagctctaaatctggtgcagagggttaacagcataacccttgttggcaaaatggaatagatgttaagacctcaaatagggatttgggatgaaacagctgcagttagcactgttatctgagcatgaaagaactggaaacgctccttacgtcgagatgttggaccttgaagccctcctgaggccaacatgcaaatctggctgtgacggttcatctgacacctgtgtaaagctgaccagcctgctctgtacagtgacaatgaggagcccctctcttccttaagtaggaatctgtgaagcaaaatgtttgctgccaaagacaaatcagactgtcagtcattaaaaacagcattagcaggatgaggatagcaatggggaagggttgtgggcaatgcagtaacagggaaatggcttcagaaatggtttgagttggaagacaacattcttcatctctcaggacttctaattccttgatgctaaaagaagaggcatggattctatgagcttccaagtccctttccactttaaccttctacaaatctttcagaggactgcctagtagcaaaggttattcctggacacaggaaagacgggcattacagggaccaaagctctgaaaggtgacttttattaccaacacactggctggaaaagggacaaaccacatcacgggtgagtgatacttctcagtcttctctactcattcaacaaaggaaatgtgggctggggcagaggtcttttttcatttaatactggaaaaatattgaagagcatccatgttcacttatggctggttttgctatagaaattggaaaataaaggccacttttttgaaatccccagtttaattaaa

SEQ ID NO: 163624 - DNA, 3709 bp, Homo sapiens
  Payload ID: 12222
  Gene Symbol: PAPLN
  Gene Name: papilin, proteoglycan-like sulfated glycoprotein
  ENST ID: ENST00000557061
  CDS Start-End: 1-645
gtccacaacacccaccagccccaggcccagcagaatgagcccagtgagtgccggggctcccagtttggctgttgctatgacaacgtggccactgcagccggtcctcttggggaaggctgtgtgggccagcccagccatgcctaccccgtgcggtgcctgctgcccagtgcccatggctcttgcgcagactgggctgcccgctggtacttcgttgcctctgtgggccaatgtaaccgcttctggtatggcggctgccatggcaatgccaataactttgcctcggagcaagagtgcatgagcagctgccagggatctctccatgggccccgtcgtccccagcctggggcttctggaaggagcacccacacggatggtggcggcagcagtcctgcaggcgagcaggaacccagccagcacaggacaggggccgcggtgcagagaaagccctggccttctggtggtctctggcggcaagaccaacagcctgggccaggggaggccccccacacccaggcctttggagaatggccatgggggcaggagcttgggtccagggcccctggactgggtggagatgccggatcaccagcgccacccttccacagctcctcctacagatctcacttcccacctctccaggattagcttggcaggtgtggagccctcgttggtgcaggcagccctggggcagttggtgcggctctcctgctcagacgacactgccccggaatcccaggctgcctggcagaaagatggccagcccatctcctctgacaggcacaggctgcagttcgacggatccctgatcatccaccccctgcaggcagaggacgcgggcacctacagctgtggcagcacccggccaggccgcgactcccagaagatccaacttcgcatcatagggggtgacatggccgtgctgtctgaggctgagctgagccgcttccctcagcccagggacccagctcaggactttggccaagcgggggctgctgggcccctgggggccatcccctcttcacacccacagcctgcaaacaggctgcgtttggaccagaaccagccccgggtggtggatgccagtccaggccagcggatccggatgacctgccgtgccgaaggcttcccgcccccagccatcgagtggcagagagatgggcagcctgtctcttctcccagacaccagctgcagcctgatggctccctggtcattagccgagtggctgtagaagatggcggcttctacacctgtgtcgctttcaatgggcaggaccgagaccagcgatgggtccagctcagagttctgggggagctgacaatctcaggactgccccctactgtgacagtgccagagggtgatacggccaggctattgtgtgtggtagcaggagaaagtgtgaacatcaggtggtccaggaacgggctacctgtgcaggctgatggccaccgtgtccaccagtccccagatggcacgctgctcatttacaacttgcgggccagggatgagggctcctacacgtgcagtgcctaccaggggagccaggcagtcagccgcagcaccgaggtgaaggtggtctcaccagcacccaccgcccagcccagggaccctggcagggactgcgtcgaccagccagagctggccaactgtgatttgatcctgcaggcccagctttgtggcaatgagtattactccagcttctgctgtgccagctgttcacgtttccagcctcacgctcagcccatctggcagtagggatgaaggctagttccagccccagtccaaaatagttcatagggctagggagaaaggaagatggactcttggcttcctctctctggctggcaaagggagttatcttctggaatacattagctctttcaaaaacccacccagtgtttagcctcaacggcagccagttaccagcttctctctgtagccttcagcagtgtttgcatctctgacataaccacaggctgctgttttcaagaagagcaatctgtttggataagaaaaacctttactttacagcttccctttataatttgttacacaggaatagttaaatgcatttgtttgtttgttttttgagacagagtttcactcttgttgcccaggctggagggcaatggcgcgatctcagctcactgcaacctccgtctcctgggttcttgattctcctgtgtcagccttctgagtagctaggattacagatgcctatcaccatgcctgggtaatttttgtatttttagttgagatggggtttcaccatgttggccaggctggtctcgaacttctgacctcagatgatctgcccgcctcagcctcccaaagtgctgggattacaggcatgagccaccacgcccagccatcaatgcattttttttattttttttttgagacagagtttcgcacttcttgcccaggctggagtacaatggtgcgatcttggctcactgcaacctccacctcctgggttcaagcgcttctccagcctcagcctcctgagtagctgggattacaggtatgtgccaccatgcctggctaattttgtatttttagtagagacggggtttctccatgttggtcagactggtcttgaactcccgacctcaggtaatccgcccgcctcggcctcccaaaatgctgggattagaggtgtgagccactgtgcccagcccatcaatgtgttttaaagctagctgtcagggttccacttaatttaaagctgggcagggagatgtgtaatgatttcaaagttaacacctgtttgttttctaaagggcatgccaagtcctgctgtatcagggaagtattctgtgctaaaatcagcgatggttcattgctctagtctctctcacccttctaggcagtgcatcagtcagctctaaatctggtgcagagggttaacagcataacccttgttggcaaaatggaatagatgttaagacctcaaatagggatttgggatgaaacagctgcagttagcactgttatctgagcatgaaagaactggaaacgctccttacgtcgagatgttggaccttgaagccctcctgaggccaacatgcaaatctggctgtgacggttcatctgacacctgtgtaaagctgaccagcctgctctgtacagtgacaatgaggagcccctctcttccttaagtaggaatctgtgaagcaaaatgtttgctgccaaagacaaatcagactgtcagtcattaaaaacagcattagcaggatgaggatagcaatggggaagggttgtgggcaatgcagtaacagggaaatggcttcagaaatggtttgagttggaagacaacattcttcatctctcaggacttctaattccttgatgctaaaagaagaggcatggattctatgagcttccaagtccctttccactttaaccttctacaaatctttcagaggactgcctagtagcaaaggttattcctggacacaggaaagacgggcattacagggaccaaagctctgaaaggtgacttttattaccaacacactggctggaaaagggacaaaccacatcacgggtgagtgatacttctcagtcttctctactcattcaacaaaggaaatgtgggctggggcagaggtcttttttcatttaatactggaaaaatattgaagagcatccatgttcacttatggctggttttgctatagaaattggaaaataaaggccacttttttg

SEQ ID NO: 163625 - DNA, 4282 bp, Homo sapiens
  Payload ID: 12222
  Gene Symbol: PAPLN
  Gene Name: papilin, proteoglycan-like sulfated glycoprotein
  Uniprot ID: O95428
  ENST ID: ENST00000555445
  CDS Start-End: 155-3943
gcggtgcaccgaggcgcacccggctgtcctgttgcgggtctcctggtcacctgtgggccatagggagagacgcgcccacacactctcgcccgcgcccaggacagctgcgggagccccgggccgctctaacccaatgcgtctcccgcaggctgagatgcggctgctcctgctcgtgccgctgctgctggctccagcgcccgggtcctcggctcccaaggtgaggcggcagagtgacacctggggaccctggagccagtggagcccctgcagccggacctgtggagggggtgtcagcttccgggagcgcccctgctactcccagaggagagatggaggctccagctgcgtgggccccgcccggagccaccgctcttgtcgcacggagagctgccccgacggcgcccgggacttccgggccgagcagtgcgcggagttcgacggagcggagttccaggggcggcggtatcggtggctgccctactacagcgccccaaacaagtgtgaactgaactgcattcccaagggggagaacttctactacaagcacagggaggctgtggttgatgggacgccctgcgagcctggcaagagggatgtctgtgtggatggcagctgccgggttgtcggctgtgatcacgagctggactcgtccaagcaggaggacaagtgtctgcggtgtgggggtgacggcacgacctgctaccccgtcgcaggcacctttgacgctaatgacctcagccgaggctacaaccagatcctcatagttcccatgggtgccaccagcatcctcatcgacgaggctgctgccagcaggaacttcctggctgtgaagaatgttcgtggggaatactacctcaatgggcactggaccatcgaggcggcccgggccctgccagcagccagcaccatcctgcattacgagcggggtgctgagggggacctggcccctgagcgactccatgcccggggccccacctcggagcccctggtcatcgagctcatcagccaggagcccaaccccggtgtgcactatgagtaccacctgcccctgcgccgccccagccccggcttcagctggagccacggctcatggagtgactgcagcgcggagtgtggcggaggtcaccagtcccgcctggtgttctgcaccatcgaccatgaggcctaccccgaccacatgtgccagcgccagccacggccagctgaccggcgttcctgcaatcttcacccttgcccggagaccaagcgctggaaggcagggccatgggcaccctgctcagcctcctgtggaggaggctcccagtcccgctccgtgtactgcatctcgtctgacggggccggcatccaggaggccgtggaggaggctgagtgtgccgggctgcctgggaagccccctgccattcaggcctgtaacctgcagcgctgtgcagcctggagcccggagccctggggagagtgttctgtcagttgtggcgttggcgtccggaagcggagcgttacttgccggggtgaaaggggttctttgctccataccgcagcgtgctccttggaagaccggccacctctgactgagccctgtgtgcatgaggactgccccctcctcagtgaccaggcctggcatgttggcacctggggtctatgctccaagagctgcagctcgggcactcggaggcgacaggtcatctgtgccattgggccgcccagccactgcgggagcctgcagcactccaagcctgtggatgtggagccttgtaacacgcagccctgtcatctcccccaggaggtccccagcatgcaggatgtgcacacccctgccagcaacccctggatgccgttgggccctcaggagtcccctgcctcagactccagaggccagtggtgggcagcccaggaacacccctcagccaggggtgaccacaggggagaacgaggtgaccccaggggcgaccaaggcacccacctgtcagccctgggccccgctccctctctgcagcagcccccataccagcaacccctgcggtcgggctcagggccccacgactgcagacacagtcctcacgggtgctgccccgatggccacacggcatctctcgggcctcagtggcaaggctgccctggggccccctgtcagcagagcaggtacgggtgctgccctgacagggtatctgtcgctgaggggccccatcacgctggctgcacaaagtcgtatggtggtgacagcaccgggggcatgcccaggtcaagggcagtggcttctacagtccacaacacccaccagccccaggcccagcagaatgagcccagtgagtgccggggctcccagtttggctgttgctatgacaacgtggccactgcagccggtcctcttggggaaggctgtgtgggccagcccagccatgactgggctgcccgctggtacttcgttgcctctgtgggccaatgtaaccgcttctggtatggcggctgccatggcaatgccaataactttgcctcggagcaagagtgcatgagcagctgccagggatctctccatgggccccgtcgtccccagcctggggcttctggaaggagcacccacacggatggtggcggcagcagtcctgcaggcgagcaggaacccagccagcacaggacaggggccgcggtgcagagaaagccctggccttctggtggtctctggcggcaagaccaacagcctgggccaggggaggccccccacacccaggcctttggagaatggccatgggggcaggagcttgggtccagggcccctggactgggtggagatgccggatcaccagcgccacccttccacagctcctcctacaggattagcttggcaggtgtggagccctcgttggtgcaggcagccctggggcagttggtgcggctctcctgctcagacgacactgccccggaatcccaggctgcctggcagaaagatggccagcccatctcctctgacaggcacaggctgcagttcgacggatccctgatcatccaccccctgcaggcagaggacgcgggcacctacagctgtggcagcacccggccaggccgcgactcccagaagatccaacttcgcatcatagggggtgacatggccgtgctgtctgaggctgagctgagccgcttccctcagcccagggacccagctcaggactttggccaagcgggggctgctgggcccctgggggccatcccctcttcacacccacagcctgcaaacaggctgcgtttggaccagaaccagccccgggtggtggatgccagtccaggccagcggatccggatgacctgccgtgccgaaggcttcccgcccccagccatcgagtggcagagagatgggcagcctgtctcttctcccagacaccagctgcagcctgatggctccctggtcattagccgagtggctgtagaagatggcggcttctacacctgtgtcgctttcaatgggcaggaccgagaccagcgatgggtccagctcagagttctgggggagctgacaatctcaggactgccccctactgtgacagtgccagagggtgatacggccaggctattgtgtgtggtagcaggagaaagtgtgaacatcaggtggtccaggaacgggctacctgtgcaggctgatggccaccgtgtccaccagtccccagatggcacgctgctcatttacaacttgcgggccagggatgagggctcctacacgtgcagtgcctaccaggggagccaggcagtcagccgcagcaccgaggtgaaggtggtctcaccagcacccaccgcccagcccagggaccctggcagggactgcgtcgaccagccagagctggccaactgtgatttgatcctgcaggcccagctttgtggcaatgagtattactccagcttctgctgtgccagctgttcacgtttccagcctcacgctcagcccatctggcagtagggatgaaggctagttccagccccagtccaaaatagttcatagggctagggagaaaggaagatggactcttggcttcctctctctggctggcaaagggagttatcttctggaatacattagctctttcaaaaacccacccagtgtttagcctcaacggcagccagttaccagcttctctctgtagccttcagcagtgtttgcatctctgacataaccacaggctgctgttttcaagaagagcaatctgtttggataagaaaaacctttactttacagcttccctttataatttgttacacaggaatagttaaatgcatttgtttgtttgttttttgagac

SEQ ID NO: 163626 - DNA, 4090 bp, Homo sapiens
  Payload ID: 12222
  Gene Symbol: PAPLN
  Gene Name: papilin, proteoglycan-like sulfated glycoprotein
  Uniprot ID: O95428
  ENST ID: ENST00000554301
  CDS Start-End: 164-4000
gtgttctctgcggtgcaccgaggcgcacccggctgtcctgttgcgggtctcctggtcacctgtgggccatagggagagacgcgcccacacactctcgcccgcgcccaggacagctgcgggagccccgggccgctctaacccaatgcgtctcccgcaggctgagatgcggctgctcctgctcgtgccgctgctgctggctccagcgcccgggtcctcggctcccaaggtgaggcggcagagtgacacctggggaccctggagccagtggagcccctgcagccggacctgtggagggggtgtcagcttccgggagcgcccctgctactcccagaggagagatggaggctccagctgcgtgggccccgcccggagccaccgctcttgtcgcacggagagctgccccgacggcgcccgggacttccgggccgagcagtgcgcggagttcgacggagcggagttccaggggcggcggtatcggtggctgccctactacagcgccccaaacaagtgtgaactgaactgcattcccaagggggagaacttctactacaagcacagggaggctgtggttgatgggacgccctgcgagcctggcaagagggatgtctgtgtggatggcagctgccgggttgtcggctgtgatcacgagctggactcgtccaagcaggaggacaagtgtctgcggtgtgggggtgacggcacgacctgctaccccgtcgcaggcacctttgacgctaatgacctcagccgaggctacaaccagatcctcatagttcccatgggtgccaccagcatcctcatcgacgaggctgctgccagcaggaacttcctggctgtgaagaatgttcgtggggaatactacctcaatgggcactggaccatcgaggcggcccgggccctgccagcagccagcaccatcctgcattacgagcggggtgctgagggggacctggcccctgagcgactccatgcccggggccccacctcggagcccctggtcatcgagctcatcagccaggagcccaaccccggtgtgcactatgagtaccacctgcccctgcgccgccccagccccggcttcagctggagccacggctcatggagtgactgcagcgcggagtgtggcggaggtcaccagtcccgcctggtgttctgcaccatcgaccatgaggcctaccccgaccacatgtgccagcgccagccacggccagctgaccggcgttcctgcaatcttcacccttgcccggagaccaagcgctggaaggcagggccatgggcaccctgctcagcctcctgtggaggaggctcccagtcccgctccgtgtactgcatctcgtctgacggggccggcatccaggaggccgtggaggaggctgagtgtgccgggctgcctgggaagccccctgccattcaggcctgtaacctgcagcgctgtgcagcctggagcccggagccctggggagagtgttctgtcagttgtggcgttggcgtccggaagcggagcgttacttgccggggtgaaaggggttctttgctccataccgcagcgtgctccttggaagaccggccacctctgactgagccctgtgtgcatgaggactgccccctcctcagtgaccaggcctggcatgttggcacctggggtctatgctccaagagctgcagctcgggcactcggaggcgacaggtcatctgtgccattgggccgcccagccactgcgggagcctgcagcactccaagcctgtggatgtggagccttgtaacacgcagccctgtcatctcccccaggaggtccccagcatgcaggatgtgcacacccctgccagcaacccctggatgccgttgggccctcaggagtcccctgcctcagactccagaggccagtggtgggcagcccaggaacacccctcagccaggggtgaccacaggggagaacgaggtgaccccaggggcgaccaaggcacccacctgtcagccctgggccccgctccctctctgcagcagcccccataccagcaacccctgcggtcgggctcagggccccacgactgcagacacagtcctcacgggtgctgccccgatggccacacggcatctctcgggcctcagtggcaaggctgccctggggccccctgtcagcagagcaggtacgggtgctgccctgacagggtatctgtcgctgaggggccccatcacgctggctgcacaaagtcgtatggtggtgacagcaccgggggcatgcccaggtcaagggcagtggcttctacagtccacaacacccaccagccccaggcccagcagaatgagcccagtgagtgccggggctcccagtttggctgttgctatgacaacgtggccactgcagccggtcctcttggggaaggctgtgtgggccagcccagccatgcctaccccgtgcggtgcctgctgcccagtgcccatggctcttgcgcagactgggctgcccgctggtacttcgttgcctctgtgggccaatgtaaccgcttctggtatggcggctgccatggcaatgccaataactttgcctcggagcaagagtgcatgagcagctgccagggatctctccatgggccccgtcgtccccagcctggggcttctggaaggagcacccacacggatggtggcggcagcagtcctgcaggcgagcaggaacccagccagcacaggacaggggccgcggtgcagagaaagccctggccttctggtggtctctggcggcaagaccaacagcctgggccaggggaggccccccacacccaggcctttggagaatggccatgggggcaggagcttgggtccagggcccctggactgggtggagatgccggatcaccagcgccacccttccacagctcctcctacaggattagcttggcaggtgtggagccctcgttggtgcaggcagccctggggcagttggtgcggctctcctgctcagacgacactgccccggaatcccaggctgcctggcagaaagatggccagcccatctcctctgacaggcacaggctgcagttcgacggatccctgatcatccaccccctgcaggcagaggacgcgggcacctacagctgtggcagcacccggccaggccgcgactcccagaagatccaacttcgcatcatagggggtgacatggccgtgctgtctgaggctgagctgagccgcttccctcagcccagggacccagctcaggactttggccaagcgggggctgctgggcccctgggggccatcccctcttcacacccacagcctgcaaacaggctgcgtttggaccagaaccagccccgggtggtggatgccagtccaggccagcggatccggatgacctgccgtgccgaaggcttcccgcccccagccatcgagtggcagagagatgggcagcctgtctcttctcccagacaccagctgcagcctgatggctccctggtcattagccgagtggctgtagaagatggcggcttctacacctgtgtcgctttcaatgggcaggaccgagaccagcgatgggtccagctcagagttctgggggagctgacaatctcaggactgccccctactgtgacagtgccagagggtgatacggccaggctattgtgtgtggtagcaggagaaagtgtgaacatcaggtggtccaggaacgggctacctgtgcaggctgatggccaccgtgtccaccagtccccagatggcacgctgctcatttacaacttgcgggccagggatgagggctcctacacgtgcagtgcctaccaggggagccaggcagtcagccgcagcaccgaggtgaaggtggtctcaccagcacccaccgcccagcccagggaccctggcagggactgcgtcgaccagccagagctggccaactgtgatttgatcctgcaggcccagctttgtggcaatgagtattactccagcttctgctgtgccagctgttcacgtttccagcctcacgctcagcccatctggcagtagggatgaaggctagttccagccccagtccaaaatagttcatagggctagggagaaaggaagatggactcttggcttcctctctctggctgg

SEQ ID NO: 163627 - DNA, 4108 bp, Homo sapiens
  Payload ID: 12222
  Gene Symbol: PAPLN
  Gene Name: papilin, proteoglycan-like sulfated glycoprotein
  ENST ID: ENST00000555123
  CDS Start-End: 21-2810
gccagcgaagacaggctgagatgcggctgctcctgctcgtgccgctgctgctggctccagcgcccgggtcctcggctcccaaggtgaggcggcagagtgacacctggggaccctggagccagtggagcccctgcagccggacctgtggagggggtgtcagcttccgggagcgcccctgctactcccagaggagagatggaggctccagctgcgtgggccccgcccggagccaccgctcttgtcgcacggagagctgccccgacggcgcccgggacttccgggccgagcagtgcgcggagttcgacggagcggagttccaggggcggcggtatcggtggctgccctactacagcgccccaaacaagtgtgaactgaactgcattcccaagggggagaacttctactacaagcacagggaggctgtggttgatgggacgccctgcgagcctggcaagagggatgtctgtgtggatggcagctgccgggttgtcggctgtgatcacgagctggactcgtccaagcaggaggacaagtgtctgcggtgtgggggtgacggcacgacctgctaccccgtcgcaggcacctttgacgctaatgacctcagccgagctgtgaagaatgttcgtggggaatactacctcaatgggcactggaccatcgaggcggcccgggccctgccagcagccagcaccatcctgcattacgagcggggtgctgagggggacctggcccctgagcgactccatgcccggggccccacctcggagcccctggtcatcgagctcatcagccaggagcccaaccccggtgtgcactatgagtaccacctgcccctgcgccgccccagccccggcttcagctggagccacggctcatggagtgactgcagcgcggagtgtggcggaggtcaccagtcccgcctggtgttctgcaccatcgaccatgaggcctaccccgaccacatgtgccagcgccagccacggccagctgaccggcgttcctgcaatcttcacccttgcccggagaccaagcgctggaaggcagggccatgggcaccctgctcagcctcctgtggaggaggctcccagtcccgctccgtgtactgcatctcgtctgacggggccggcatccaggaggccgtggaggaggctgagtgtgccgggctgcctgggaagccccctgccattcaggcctgtaacctgcagcgctgtgcagcctggagcccggagccctggggagagtgttctgtcagttgtggcgttggcgtccggaagcggagcgttacttgccggggtgaaaggggttctttgctccataccgcagcgtgctccttggaagaccggccacctctgactgagccctgtgtgcatgaggactgccccctcctcagtgaccaggcctggcatgttggcacctggggtctatgctccaagagctgcagctcgggcactcggaggcgacaggtcatctgtgccattgggccgcccagccactgcgggagcctgcagcactccaagcctgtggatgtggagccttgtaacacgcagccctgtcatctcccccaggaggtccccagcatgcaggatgtgcacacccctgccagcaacccctggatgccgttgggccctcaggagtcccctgcctcagactccagaggccagtggtgggcagcccaggaacacccctcagccaggggtgaccacaggggagaacgaggtgaccccaggggcgaccaaggcacccacctgtcagccctgggccccgctccctctctgcagcagcccccataccagcaacccctgcggtcgggctcagggccccacgactgcagacacagtcctcacgggtgctgccccgatggccacacggcatctctcgggcctcagtggcaaggctgccctggggccccctgtcagcagagcaggtacgggtgctgccctgacagggtatctgtcgctgaggggccccatcacgctggctgcacaaagtcgtatggtggtgacagcaccgggggcatgcccaggtcaagggcagtggcttctacagtccacaacacccaccagccccaggcccagcagaatgagcccagtgagtgccggggctcccagtttggctgttgctatgacaacgtggccactgcagccggtcctcttggggaaggctgtgtgggccagcccagccatgcctaccccgtgcggtgcctgctgcccagtgcccatggctcttgcgcagactgggctgcccgctggtacttcgttgcctctgtgggccaatgtaaccgcttctggtatggcggctgccatggcaatgccaataactttgcctcggagcaagagtgcatgagcagctgccagggatctctccatgggccccgtcgtccccagcctggggcttctggaaggagcacccacacggatggtggcggcagcagtcctgcaggcgagcaggaacccagccagcacaggacaggggccgcggtgcagagaaagccctggccttctggtggtctctggcggcaagaccaacagcctgggccaggggaggccccccacacccaggcctttggagaatggccatgggggcaggagcttgggtccagggcccctggactgggtggagatgccggatcaccagcgccacccttccacagctcctcctacaggattagcttggcaggtgtggagccctcgttggtgcaggcagccctggggcagttggtgcggctctcctgctcagacgacactgccccggaatcccaggctgcctggcagaaagatggccagcccatctcctctgacaggttcacgtgacagctccctccacctccgctgacaggcacaggctgcagttcgacggatccctgatcatccaccccctgcaggcagaggacgcgggcacctacagctgtggcagcacccggccaggccgcgactcccagaagatccaacttcgcatcatagggggtgacatggccgtgctgtctgaggctgagctgagccgcttccctcagcccagggacccagctcaggactttggccaagcgggggctgctgggcccctgggggccatcccctcttcacacccacagcctgcaaacaggctgcgtttggaccagaaccagccccgggtggtggatgccagtccaggccagcggatccggatgacctgccgtgccgaaggcttcccgcccccagccatcgagtggcagagagatgggcagcctgtctcttctcccagcacccaccgcccagcccagggaccctggcagggactgcgtcgaccagccagagctggccaactgtgatttgatcctgcaggcccagctttgtggcaatgagtattactccagcttctgctgtgccagctgttcacgtttccagcctcacgctcagcccatctggcagtagggatgaaggctagttccagccccagtccaaaatagttcatagggctagggagaaaggaagatggactcttggcttcctctctctggctggcaaagggagttatcttctggaatacattagctctttcaaaaacccacccagtgtttagcctcaacggcagccagttaccagcttctctctgtagccttcagcagtgtttgcatctctgacataaccacaggctgctgttttcaagaagagcaatctgtttggataagaaaaacctttactttacagcttccctttataatttgttacacaggaatagttaaatgcatttgtttgtttgttttttgagacagagtttcactcttgttgcccaggctggagggcaatggcgcgatctcagctcactgcaacctccgtctcctgggttcttgattctcctgtgtcagccttctgagtagctaggattacagatgcctatcaccatgcctgggtaatttttgtatttttagttgagatggggtttcaccatgttggccaggctggtctcgaacttctgacctcagatgatctgcccgcctcagcctcccaaagtgctgggattacaggcatgagccaccacgcccagccatcaatgcattttttttattttttttttgagacagagtttcgcacttcttgcccaggctggagtacaatggtgcgatcttggctca

SEQ ID NO: 163628 - DNA, 2994 bp, Homo sapiens
  Payload ID: 12222
  Gene Symbol: PAPLN
  Gene Name: papilin, proteoglycan-like sulfated glycoprotein
  ENST ID: ENST00000559759
  CDS Start-End: 1-935
agtgcatgagcagctgccagggatctctccatgggccccgtcgtccccagcctggggcttctggaaggagcacccacacggatggtggcggcagcagtcctgcaggcgagcaggaacccagccagcacaggacaggggccgcggtgcagagaaagccctggccttctggtggtctctggcggcaagaccaacagcctgggccaggggaggccccccacacccaggcctttggagaatggccatgggggcaggagcttgggtccagggcccctggactgggtggagatgccggatcaccagcgccacccttccacagctcctcctacaggattagcttggcaggtgtggagccctcgttggtgcaggcagccctggggcagttggtgcggctctcctgctcagacgacactgccccggaatcccaggctgcctggcagaaagatggccagcccatctcctctgacaggcacaggctgcagttcgacggatccctgatcatccaccccctgcaggcagaggacgcgggcacctacagctgtggcagcacccggccaggccgcgactcccagaagatccaacttcgcatcatagggggtgacatggccgtgctgtctgaggctgagctgagccgcttccctcagcccagggacccagctcaggactttggccaagcgggggctgctgggcccctgggggccatcccctcttcacacccacagcctgcaaacaggctgcgtttggaccagaaccagccccgggtggtggatgccagtccaggccagcggatccggatgacctgccgtgccgaaggcttcccgcccccagccatcgagtggcagagagatgggcagcctgtctcttctcccagcacccaccgcccagcccagggaccctggcagggactgcgtcgaccagccagagctggccaactgtgatttgatcctgcaggcccagctttgtggcaatgagtattactccagcttctgctgtgccagctgttcacgtttccagcctcacgctcagcccatctggcagtagggatgaaggctagttccagccccagtccaaaatagttcatagggctagggagaaaggaagatggactcttggcttcctctctctggctggcaaagggagttatcttctggaatacattagctctttcaaaaacccacccagtgtttagcctcaacggcagccagttaccagcttctctctgtagccttcagcagtgtttgcatctctgacataaccacaggctgctgttttcaagaagagcaatctgtttggataagaaaaacctttactttacagcttccctttataatttgttacacaggaatagttaaatgcatttgtttgtttgttttttgagacagagtttcactcttgttgcccaggctggagggcaatggcgcgatctcagctcactgcaacctccgtctcctgggttcttgattctcctgtgtcagccttctgagtagctaggattacagatgcctatcaccatgcctgggtaatttttgtatttttagttgagatggggtttcaccatgttggccaggctggtctcgaacttctgacctcagatgatctgcccgcctcagcctcccaaagtgctgggattacaggcatgagccaccacgcccagccatcaatgcattttttttattttttttttgagacagagtttcgcacttcttgcccaggctggagtacaatggtgcgatcttggctcactgcaacctccacctcctgggttcaagcgcttctccagcctcagcctcctgagtagctgggattacaggtatgtgccaccatgcctggctaattttgtatttttagtagagacggggtttctccatgttggtcagactggtcttgaactcccgacctcaggtaatccgcccgcctcggcctcccaaaatgctgggattagaggtgtgagccactgtgcccagcccatcaatgtgttttaaagctagctgtcagggttccacttaatttaaagctgggcagggagatgtgtaatgatttcaaagttaacacctgtttgttttctaaagggcatgccaagtcctgctgtatcagggaagtattctgtgctaaaatcagcgatggttcattgctctagtctctctcacccttctaggcagtgcatcagtcagctctaaatctggtgcagagggttaacagcataacccttgttggcaaaatggaatagatgttaagacctcaaatagggatttgggatgaaacagctgcagttagcactgttatctgagcatgaaagaactggaaacgctccttacgtcgagatgttggaccttgaagccctcctgaggccaacatgcaaatctggctgtgacggttcatctgacacctgtgtaaagctgaccagcctgctctgtacagtgacaatgaggagcccctctcttccttaagtaggaatctgtgaagcaaaatgtttgctgccaaagacaaatcagactgtcagtcattaaaaacagcattagcaggatgaggatagcaatggggaagggttgtgggcaatgcagtaacagggaaatggcttcagaaatggtttgagttggaagacaacattcttcatctctcaggacttctaattccttgatgctaaaagaagaggcatggattctatgagcttccaagtccctttccactttaaccttctacaaatctttcagaggactgcctagtagcaaaggttattcctggacacaggaaagacgggcattacagggaccaaagctctgaaaggtgacttttattaccaacacactggctggaaaagggacaaaccacatcacgggtgagtgatacttctcagtcttctctactcattcaacaaaggaaatgtgggctggggcagaggtcttttttcatttaatactggaaaaatattgaagagcatccatgttcacttatggctggttttgctatagaaattggaaaataaaggccacttttttg

SEQ ID NO: 163629 - DNA, 2105 bp, Homo sapiens
  Payload ID: 12223
  Gene Symbol: PRCC
  Gene Name: papillary renal cell carcinoma (translocation-associated)
  Uniprot ID: Q92733
  ENST ID: ENST00000271526
  CDS Start-End: 273-1748
attggtgaggcaaggaggaggcggagtgactcggcggccattagctgtgtgtagttgcccgggactaggagcttaagtgaagaggtacgccttgttcggtggaaatcagccgtagccatgagtttctgccggggctagccctagagtacggagcaggcggacttttcggttccccgccccgccaggtggcggggcctactaggcctccgggcatccccggtctcaagtaggcctcatctgccggcaagggcgcccgaaacgcgggaggcgccatgtcgctggttgcttacgccagcagcgatgagagcgagccggatgaggctgagcccgagccggaggaagaggaggcggtggctcctacatctgggcccgctttagggggcttgttcgcttctctccctgcgcccaagggtccggccttgctgcctccgccccctcagatgctggcgccagcctttcccccgccgctgttgcttcccccacccaccggagaccccaggcttcagcctcctccccccttgcccttcggcctgggaggcttccccccacctccaggcgtgagcccggctgaagcggcgggagttggggagggactgggattggggttgccctcgccccgaggccctggcctcaatctgccccctccaattggcggtgccggtcccccgctggggcttcccaagccaaagaagaggaaagagcccgtgaagatcgcggcgccggagttgcataagggagattcagattctgaggaagatgaacccacaaagaagaaaactatccttcagggatccagtgaggggactggtttgtctgccttgcttccccaacctaaaaacctgactgtgaaagagactaacaggttgctcctgccccatgccttctcccgcaaaccctcggatggctcccctgatactaagccctccagactggcttctaagaccaagacttcctctcttgcccctgttgtgggcaccacaaccaccactccgtcgccctctgctatcaaggctgctgccaagagtgctgccctgcaggtgacaaagcagatcacgcaggaagaagacgacagtgatgaggaagtagcccccgaaaactttttctccctccctgaaaaggctgagccacctggagttgagccatacccttaccccatccccactgtccctgaagagctgcctccaggcacggaaccagagccggctttccaggacgatgcagccaatgccccccttgaattcaagatggcagcaggttcaagtggggccccttggatgcctaagcctggggacgactacagctacaatcagttttccacatatggcgatgccaatgccgctggtgcttattatcaggattattacagtggtggctactatcctgcacaggacccggccctggtccccccccaggaaattgccccagatgcctccttcatcgatgacgaagcatttaagcggctgcagggcaagaggaaccgagggagagaagaaatcaactttgtggagatcaaaggtgatgaccagctcagtggggcccagcaatggatgactaagtcattgacagaagagaaaaccatgaagtcattcagcaaaaagaaaggtgagcagccaacaggccagcagcggcggaaacaccagatcacatatcttattcatcaggccaaggagcgggagctggaactgaagaacacctggtcagagaacaagctcagccgccgtcagacccaagccaaatatggattctagggctctggaactgattgctcccaggatctcctgccagcccagctggcctggcccccagcttcacctctgggaccccagctgctctaagcccaggatctctttccccaaggacccagccctcgcctctgcgagaatgaacatatttgatagatttttcttaacaagttagaaaattcagctcctttctgtcctggagctagcaaagacttgtgtgatgcctccgaaggggctctgagttctggggtgggagttttgctctctgtcaggtgtgataaaatgttgaaccctccccaccaccacttttttttttttaaaccagggatgtctgttgaaataaaacattcagtctgacaaaca

SEQ ID NO: 163630 - DNA, 1084 bp, Homo sapiens
  Payload ID: 12223
  Gene Symbol: PRCC
  Gene Name: papillary renal cell carcinoma (translocation-associated)
  ENST ID: ENST00000454659
  CDS Start-End: 1-773
gtgatgaggaagtagcccccgaaaactttttctccctccctgaaaaggctgagccacctggagttgagccatacccttaccccatccccactgtccctgaagagctgcctccaggcacggaaccagagccggctttccaggacgatgcagccaatgccccccttgaattcaagatggcagcaggttcaagtggggccccttggatgcctaagcctggggacgactacagctacaatcagttttccacatatggcgatgccaatgccgctggtgcttattatcagggtctgcagcaacatctgggccactcgcctctaaggggaatcatgagattcctgaactcaaaatctggtaaacgaacctgctttgttcccagctttgattattacagtggtggctactatcctgcacaggacccggccctggtccccccccaggaaattgccccagatgcctccttcatcgatgacgaagcatttaagcggctgcagggcaagaggaaccgagggagagaagaaatcaactttgtggagatcaaaggtgatgaccagctcagtggggcccagcaatggatgactaagtcattgacagaagagaaaaccatgaagtcattcagcaaaaagaaaggtgagcagccaacaggccagcagcggcggaaacaccagatcacatatcttattcatcaggccaaggagcgggagctggaactgaagaacacctggtcagagaacaagctcagccgccgtcagacccaagccaaatatggattctagggctctggaactgattgctcccaggatctcctgccagcccagctggcctggcccccagcttcacctctgggaccccagctgctctaagcccaggatctctttccccaaggacccagccctcgcctctgcgagaatgaacatatttgatagatttttcttaacaagttagaaaattcagctcctttctgtcctggagctagcaaagacttgtgtgatgcctccgaaggggctctgagttctggggtgggagttttgctctctgtcaggtgtgataaaatgttgaaccctccccaccaccacttttttttttt

SEQ ID NO: 163631 - DNA, 634 bp, Homo sapiens
  Payload ID: 12223
  Gene Symbol: PRCC
  Gene Name: papillary renal cell carcinoma (translocation-associated)
  ENST ID: ENST00000526188
  CDS Start-End: 1-597
caggaagaagacgacagtgatgaggaagtagcccccgaaaactttttctccctccctgaaaaggctgagccacctggagttgagccatacccttaccccatccccactgtccctgaagagctgcctccaggcacggaaccagagccggctttccaggacgatgcagccaatgccccccttgaattcaagatggcagcaggttcaagtggggccccttggatgcctaagcctggggacgactacagctacaatcagttttccacatatggcgatgccaatgccgctggtgcttattatcagtttaagcggctgcagggcaagaggaaccgagggagagaagaaatcaactttgtggagatcaaaggtgatgaccagctcagtggggcccagcaatggatgactaagtcattgacagaagagaaaaccatgaagtcattcagcaaaaagaaaggtgagcagccaacaggccagcagcggcggaaacaccagatcacatatcttattcatcaggccaaggagcgggagctggaactgaagaacacctggtcagagaacaagctcagccgccgtcagacccaagccaaatatggattctagggctctggaactgattgctcccaggatctcctgccag

SEQ ID NO: 163632 - DNA, 4369 bp, Homo sapiens
  Payload ID: 12224
  Gene Symbol: PAPPA2
  Gene Name: pappalysin 2
  Uniprot ID: Q9BXP8
  ENST ID: ENST00000367661
  CDS Start-End: 1165-3648
gggcatgactctctctcttgagtaggcacacactcccttttctcgggtgtgtactttttgctttgtgatacatctctgcactttcagtattttccaactcatccttaaattccttctcacaacagtgtcaagagcctggacgccagccaggattgaggtcctacgggtgtttggggacctccccaagcccacgagtatcaatggcagtatcaattgtctgtgacagtgattaaggagcaaaacacttggaacccacaagactcccagaaggtgaagttaagagctcccagactcataaggttattagaacagcaaactggcaccccaaagaactttacggagacttgcaacctatcaacaagttggatgagggattaaaagccttcaacaaccaacaaccccaagcatcaaactgaaggaaacattctaaccttcacagacagactggaggctggatggggacctggctgaagacatctggagaatgaaagttaagtaccagcttgcatttttgtgcccctagattatttttgcattttaaaataagaagcatcaaattgcgtgtctctgtgtaaaagttctagcaatttgttttaaggtgaacttattttggcttagggactacaaaaagagaaggtaattcctagggaaggaagaagagaaagaaatgaaaattagagaataagattattttgaatgacttcaggtagcgaggagtgtgtgtttgtgagtgtgtatttgagagacttggctcatgcctgtgggtcttctcttctagtatcagtgaggggagggattactgaagaagaaggggggaaaaaaaaagaaagaaatctgagctttctgggaggaaattcaaaggaaccaagagaaattaacttcgttctgcaaggactaaagtacagcaagaggagagaggtcaagcgagaagcgtgcgggaagcacatgccctggggaggcatagaagccacactggcagagcggccagcacaggtagccagcagaggcattcttggggctatttgaaaaagtttggtctgtgaacaaaacagtttccctggtgactgcaaatccattgctagctgcctctttctcgtctgcccatcactctggtgtggtacccagaagttgacttctggttctgtagaaagagctaggggaggtatgatgtgcttaaagatcctaagaataagcctggcgattttggctgggtgggcactctgttctgccaactctgagctgggctggacacgcaagaaatccttggttgagagggaacacctgaatcaggtgctgttggaaggagaacgttgttggctgggggccaaggttcgaagacccagagcttctccacagcatcacctctttggagtctaccccagcagggctgggaactacctaaggccctaccccgtgggggagcaagaaatccatcatacaggacgcagcaaaccagacactgaaggaaatgctgtgagccttgttcccccagacctgactgaaaatccagcaggactgaggggtgcagttgaagagccggctgccccatgggtaggggatagtcctattgggcaatctgagctgctgggagatgatgacgcttatctcggcaatcaaagatccaaggagtctctaggtgaggccgggattcagaaaggctcagccatggctgccactactaccaccgccattttcacaaccctgaacgaacccaaaccagagacccaaaggaggggctgggccaagtccaggcagcgtcgccaagtgtggaagaggcgggcggaagatgggcagggagactccggtatctcttcacatttccaaccttggcccaagcattcccttaaacacagggtcaaaaagagtccaccggaggaaagcaaccaaaatggtggagagggctcctaccgagaagcagagacctttaactcccaagtaggactgcccatcttatacttctctgggaggcgggagcggctgctgctgcgtccagaagtgctggctgagattccccgggaggcgttcacagtggaagcctgggttaaaccggagggaggacagaacaacccagccatcatcgcaggtgtgtttgataactgctcccacactgtcagtgacaaaggctgggccctggggatccgctcagggaaggacaagggaaagcgggatgctcgcttcttcttctccctctgcaccgaccgcgtgaagaaagccaccatcttgattagccacagtcgctaccaaccaggcacatggacccatgtggcagccacttacgatggacggcacatggccctgtatgtggatggcactcaggtggctagcagtctagaccagtctggtcccctgaacagccccttcatggcatcttgccgctctttgctcctggggggagacagctctgaggatgggcactatttccgtggacacctgggcacactggttttctggtcgaccgccctgccacaaagccattttcagcacagttctcagcattcaagtggggaggaggaagcgactgacttggtcctgacagcgagctttgagcctgtgaacacagagtgggttccctttagagatgagaagtacccacgacttgaggttctccagggctttgagccagagcctgagattctgtcgcctttgcagcccccactctgtgggcaaacagtctgtgacaatgtggaattgatctcccagtacaatggatactggccccttcggggagagaaggtgatacgctaccaggtggtgaacatctgtgatgatgagggcctaaaccccattgtgagtgaggagcagattcgtctgcagcacgaggcactgaatgaggccttcagccgctacaacatcagctggcagctgagcgtccaccaggtccacaattccaccctgcgacaccgggttgtgcttgtgaactgtgagcccagcaagattggcaatgaccattgtgaccccgagtgtgagcacccactcacaggctatgatgggggtgactgccgcctgcagggccgctgctactcctggaaccgcagggatgggctctgtcacgtggagtgtaacaacatgctgaacgactttgacgacggagactgctgcgacccccaggtggctgatgtgcgcaagacctgctttgaccctgactcacccaagagggcatacatgagtgtgaaggagctgaaggaggccctgcagctgaacagtactcacttcctcaacatctactttgccagctcagtgcgggaagaccttgcaggtgctgccacctggccttgggacaaggacgctgtcactcacctgggtggcattgtcctcagcccagcatattatgggatgcctggccacaccgacaccatgatccatgaagtgggacatgttctgggactctaccatgtctttaaaggagtcagtgaaagagaatcctgcaatgacccctgcaaggagacagtgccatccatggaaacgggagacctctgtgccgacaccgcccccactcccaagagtgagctgtgccgggaaccagagcccactagtgacacctgtggcttcactcgcttcccaggggctccgttcaccaactacatgagctacacgggtatcaccactgtcttgttttgttttctgttaagaatacatgggggcctttgagagctgggagggtggaggtgtgggagctgatgggagaatgattaagtggtcatttgtgtcggagagttgaagtgtatttattataaggtattattattttttcatgtctttgaagaacttgaagaaatactgacatattaaggtactttgttcactgaattctcctctactagatattttaaaatatacttctatcctcgatagtaaaaaaggcacagagccaaaagccctcttgtgatccccttgacttctagaatgtggttattcttatttttgcccgcattcttagacatttactctgaagaagagtccaatggaaataaaggaaaagagtttatgggtcaaggtggcccattgtactgtttttgaagttggtcaacaaggtggcttggttaatttaggctcagcatgttttactgtatgttactaaaaaaaaaaaaaaaaaaaatcagattctctttttccagcactagtcaagcacaaattcttagctgcctaccaccctttccccaccaaaaggtgacatctaattttaaaaaaatggcatcttcctggccctcggaaaaacttgtcatctggtctttcttgccttaattcagcttctgtattattcttcgctgtctctcacgccttccttgtttcttgtgaaaagtaatagtgactggtttcctataatggactcaaagttatccctaaaattaaagacttatttgatgaccta

SEQ ID NO: 163633 - DNA, 9691 bp, Homo sapiens
  Payload ID: 12224
  Gene Symbol: PAPPA2
  Gene Name: pappalysin 2
  Uniprot ID: Q9BXP8
  ENST ID: ENST00000367662
  CDS Start-End: 1165-6540
gggcatgactctctctcttgagtaggcacacactcccttttctcgggtgtgtactttttgctttgtgatacatctctgcactttcagtattttccaactcatccttaaattccttctcacaacagtgtcaagagcctggacgccagccaggattgaggtcctacgggtgtttggggacctccccaagcccacgagtatcaatggcagtatcaattgtctgtgacagtgattaaggagcaaaacacttggaacccacaagactcccagaaggtgaagttaagagctcccagactcataaggttattagaacagcaaactggcaccccaaagaactttacggagacttgcaacctatcaacaagttggatgagggattaaaagccttcaacaaccaacaaccccaagcatcaaactgaaggaaacattctaaccttcacagacagactggaggctggatggggacctggctgaagacatctggagaatgaaagttaagtaccagcttgcatttttgtgcccctagattatttttgcattttaaaataagaagcatcaaattgcgtgtctctgtgtaaaagttctagcaatttgttttaaggtgaacttattttggcttagggactacaaaaagagaaggtaattcctagggaaggaagaagagaaagaaatgaaaattagagaataagattattttgaatgacttcaggtagcgaggagtgtgtgtttgtgagtgtgtatttgagagacttggctcatgcctgtgggtcttctcttctagtatcagtgaggggagggattactgaagaagaaggggggaaaaaaaaagaaagaaatctgagctttctgggaggaaattcaaaggaaccaagagaaattaacttcgttctgcaaggactaaagtacagcaagaggagagaggtcaagcgagaagcgtgcgggaagcacatgccctggggaggcatagaagccacactggcagagcggccagcacaggtagccagcagaggcattcttggggctatttgaaaaagtttggtctgtgaacaaaacagtttccctggtgactgcaaatccattgctagctgcctctttctcgtctgcccatcactctggtgtggtacccagaagttgacttctggttctgtagaaagagctaggggaggtatgatgtgcttaaagatcctaagaataagcctggcgattttggctgggtgggcactctgttctgccaactctgagctgggctggacacgcaagaaatccttggttgagagggaacacctgaatcaggtgctgttggaaggagaacgttgttggctgggggccaaggttcgaagacccagagcttctccacagcatcacctctttggagtctaccccagcagggctgggaactacctaaggccctaccccgtgggggagcaagaaatccatcatacaggacgcagcaaaccagacactgaaggaaatgctgtgagccttgttcccccagacctgactgaaaatccagcaggactgaggggtgcagttgaagagccggctgccccatgggtaggggatagtcctattgggcaatctgagctgctgggagatgatgacgcttatctcggcaatcaaagatccaaggagtctctaggtgaggccgggattcagaaaggctcagccatggctgccactactaccaccgccattttcacaaccctgaacgaacccaaaccagagacccaaaggaggggctgggccaagtccaggcagcgtcgccaagtgtggaagaggcgggcggaagatgggcagggagactccggtatctcttcacatttccaaccttggcccaagcattcccttaaacacagggtcaaaaagagtccaccggaggaaagcaaccaaaatggtggagagggctcctaccgagaagcagagacctttaactcccaagtaggactgcccatcttatacttctctgggaggcgggagcggctgctgctgcgtccagaagtgctggctgagattccccgggaggcgttcacagtggaagcctgggttaaaccggagggaggacagaacaacccagccatcatcgcaggtgtgtttgataactgctcccacactgtcagtgacaaaggctgggccctggggatccgctcagggaaggacaagggaaagcgggatgctcgcttcttcttctccctctgcaccgaccgcgtgaagaaagccaccatcttgattagccacagtcgctaccaaccaggcacatggacccatgtggcagccacttacgatggacggcacatggccctgtatgtggatggcactcaggtggctagcagtctagaccagtctggtcccctgaacagccccttcatggcatcttgccgctctttgctcctggggggagacagctctgaggatgggcactatttccgtggacacctgggcacactggttttctggtcgaccgccctgccacaaagccattttcagcacagttctcagcattcaagtggggaggaggaagcgactgacttggtcctgacagcgagctttgagcctgtgaacacagagtgggttccctttagagatgagaagtacccacgacttgaggttctccagggctttgagccagagcctgagattctgtcgcctttgcagcccccactctgtgggcaaacagtctgtgacaatgtggaattgatctcccagtacaatggatactggccccttcggggagagaaggtgatacgctaccaggtggtgaacatctgtgatgatgagggcctaaaccccattgtgagtgaggagcagattcgtctgcagcacgaggcactgaatgaggccttcagccgctacaacatcagctggcagctgagcgtccaccaggtccacaattccaccctgcgacaccgggttgtgcttgtgaactgtgagcccagcaagattggcaatgaccattgtgaccccgagtgtgagcacccactcacaggctatgatgggggtgactgccgcctgcagggccgctgctactcctggaaccgcagggatgggctctgtcacgtggagtgtaacaacatgctgaacgactttgacgacggagactgctgcgacccccaggtggctgatgtgcgcaagacctgctttgaccctgactcacccaagagggcatacatgagtgtgaaggagctgaaggaggccctgcagctgaacagtactcacttcctcaacatctactttgccagctcagtgcgggaagaccttgcaggtgctgccacctggccttgggacaaggacgctgtcactcacctgggtggcattgtcctcagcccagcatattatgggatgcctggccacaccgacaccatgatccatgaagtgggacatgttctgggactctaccatgtctttaaaggagtcagtgaaagagaatcctgcaatgacccctgcaaggagacagtgccatccatggaaacgggagacctctgtgccgacaccgcccccactcccaagagtgagctgtgccgggaaccagagcccactagtgacacctgtggcttcactcgcttcccaggggctccgttcaccaactacatgagctacacggatgataactgcactgacaacttcactcctaaccaagtggcccgaatgcattgctatttggacctagtctatcagcagtggactgaaagcagaaagcccacccccatccccattccacctatggtcatcggacagaccaacaagtccctcactatccactggctgcctcctattagtggagttgtatatgacagggcctcaggcagcttgtgtggcgcttgcactgaagatgggacctttcgtcagtatgtgcacacagcttcctcccggcgggtgtgtgactcctcaggttattggaccccagaggaggctgtggggcctcctgatgtggatcagccctgcgagccaagcttacaggcctggagccctgaggtccacctgtaccacatgaacatgacggtcccctgccccacagaaggctgtagcttggagctgctcttccaacacccggtccaagccgacaccctcaccctgtgggtcacttccttcttcatggagtcctcgcaggtcctctttgacacagagatcttgctggaaaacaaggagtcagtgcacctgggccccttagacactttctgtgacatcccactcaccatcaaactgcacgtggatgggaaggtgtcgggggtgaaagtctacacctttgatgagaggatagagattgatgcagcactcctgacttctcagccccacagtcccttgtgctctggctgcaggcctgtgaggtaccaggttctccgcgatcccccatttgccagtggtttgcccgtggtggtgacacattctcacaggaagttcacggacgtggaggtcacacctggacagatgtatcagtaccaagttctagctgaagctggaggagaactgggagaagcttcgcctcctctgaaccacattcatggagctccttattgtggagatgggaaggtgtcagagagactgggagaagagtgtgatgatggagaccttgtgagcggagatggctgctccaaggtgtgtgagctggaggaaggtttcaactgtgtaggagagccaagcctttgctacatgtatgagggagatggcatatgtgaaccttttgagagaaaaaccagcattgtagactgtggcatctacactcccaaaggatacttggatcaatgggctacccgggcttactcctctcatgaagacaagaagaagtgtcctgtttccttggtaactggagaacctcattccctaatttgcacatcataccatccagatttacccaaccaccgtcccctaactggctggtttccctgtgttgccagtgaaaatgaaactcaggatgacaggagtgaacagccagaaggtagcctgaagaaagaggatgaggtttggctcaaagtgtgtttcaatagaccaggagaggccagagcaatttttatttttttgacaactgatggcctagttcccggagagcatcagcagccgacagtgactctctacctgaccgatgtccgtggaagcaaccactctcttggaacctatggactgtcatgccagcataatccactgattatcaatgtgacccatcaccagaatgtccttttccaccataccacctcagtgctgctgaatttctcatccccacgggtcggcatctcagctgtggctctaaggacatcctcccgcattggtctttcggctcccagtaactgcatctcagaggacgaggggcagaatcatcagggacagagctgtatccatcggccctgtgggaagcaggacagctgtccgtcattgctgcttgatcatgctgatgtggtgaactgtacctctataggcccaggtctcatgaagtgtgctatcacttgtcaaaggggatttgcccttcaggccagcagtgggcagtacatcaggcccatgcagaaggaaattctgctcacatgttcttctgggcactgggaccagaatgtgagctgccttcccgtggactgcggtgttcccgacccgtctttggtgaactatgcaaacttctcctgctcagagggaaccaaatttctgaaacgctgctcaatctcttgtgtcccaccagccaagctgcaaggactgagcccatggctgacatgtcttgaagatggtctctggtctctccctgaagtctactgcaagttggagtgtgatgctccccctattattctgaatgccaacttgctcctgcctcactgcctccaggacaaccacgacgtgggcaccatctgcaaatatgaatgcaaaccagggtactatgtggcagaaagtgcagagggtaaagtcaggaacaagctcctgaagatacaatgcctggaaggtggaatctgggagcaaggcagctgcattcctgtggtgtgtgagccaccccctcctgtgtttgaaggcatgtatgaatgtaccaatggcttcagcctggacagccagtgtgtgctcaactgtaaccaggaacgtgaaaagcttcccatcctctgcactaaagagggcctgtggacccaggagtttaagttgtgtgagaatctgcaaggagaatgcccaccacccccctcagagctgaattctgtggagtacaaatgtgaacaaggatatgggattggtgcagtgtgttccccattgtgtgtaatcccccccagtgaccccgtgatgctacctgagaatatcactgctgacactctggagcactggatggaacctgtcaaagtccagagcattgtgtgcactggccggcgtcaatggcacccagaccccgtcttagtccactgcatccagtcatgtgagcccttccaagcagatggttggtgtgacactatcaacaaccgagcctactgccactatgacgggggagactgctgctcttccacactctcctccaagaaggtcattccatttgctgctgactgtgacctggatgagtgcacctgccgggaccccaaggcagaagaaaatcagtaactgtgggaacaagcccctccctccactgcctcagaggcagtaagaaagagaggccgacccaggaggaaacaaagggtgaatgaagaagaacaatcatgaaatggaagaaggaggaagagcatgaaggatcttataagaaatgcaagaggatattgataggtgtgaactagttcatcaagtagcccaagtaggagagaatcataggcaaaagtttctttaaagtggcagttgattaacatggaaggggaaatatgatagatatataaggaccctcctccctcacttatattctattaaatcctatcctcaactcttgccctgctctccgctccaccccctgccaactactcagtcccacccaacttgtaaaccaataccaaaatactagaggagaagttggcagggatactgttaatacccattttgaatggattgccatctttcagagcttgtctgctctcaactggctctttttctttttgtgtagtttcccttaaataatgaagttagttattaattctttataagtatttaaacataattatataaatatattatatatattatattttttgctgtttactaagctaaaaattattcattgttccacacatgctgctgtgaagttcacattcaagatgaatgttgagactttgaggacagaaaggcaacttattttcccatctttctatggatgcggattggcaggttgaatgggaagtacagaaggagagagagtaattagatggaattctggatgctagcatgtaaagctaatcatctttttttttatgacctgggagctgggcccattttatgaccaaggagatggggagttggaatggtggtactaagaggcataggaagttgagtgtgaataccattggtgatgggtccaggagaactagactatggttcttgaatatctgtccacaaagaatatactaacttttgtcaacttctcagaactcccaactggagtcggtgagacctaggattttctgcacttccacacatgcctgttccaagtgtggctgtcagccagtcaacaagtttgtactatggcccattctctgatcaccaggattacaggaactcacacactcctcatacttggcctgtagtcctacttcttgttagaagtctccaagtctggccagtcacatgaccaagtgttgatttttctggaggaaaaattttatggaaatgatataggggaaaggtgggaggagatgaaagaacaggcaagagctgtcagggttaaatccaggcccgggcatgagaatggaagtgatcagggagactcggtccttgttccaagtctccaaagaagaccaaagtgggtcccttgagcaatgaagaatctgagataaattctcttcaagtatcatgtacaaaatctgtgagccagagattttgacttgagcaagccatggaaatgcatggagcaagggtgacactctgtggggagacagaagaatttcaactatttaatgtccattttgttgtttttaccctttcttatccaatagatggaatgcacatgaaatgaccatattaagcctctctctatttacatcccaggctcactgggatgtgatctactgcagttacattttcttgtaacggtttctggattagaccctagggaaagtgagtaaggagccagtttctgtttaacattctagttttactcattttaggaaggctgtgagtgaggcttgtctcctttaaagtttcttctccaatggaaaccaagaacagacaaaatttagagctcagctgtggtctcttctcatcttctgctcttttgctttgaccacagtttttctactcttcccatcaacactagagcaatggctgtgcaaataggaataggaaatactaccacaatgatagaaatattatccacactatcacgtagggaagaacaatatcctgaaagagaataaaacacgaataaggtgatgtacccacattaatctgtgggtttgtggaatgagggttgcaaagttattgggaaaaggaaagagcagagttcacccattcaaaaaaaaccttttgtctactaatctctagtgtaaagaaaatgtagttcagataccattcattgtcttgggtcatgcttagtgcccccaagaagacaaacatatttattcttgggattctgataggcttcaatatgcaaaggacaatggaaaagtttagacactctattttcaaaattttataaacttgttttattggggaaaatgtccaaattgctagacacattctaagttctgccttggagaatcctactttgtctgagattgaggcagaggaattgttatcctgggcattactcagctcaggaacatggagcctgtggttcatgccagtgtgtgtcttcatgcagtctctccacaagagcaacagtaagaacatttctgttttaaatttcattttaaaatattttattatctgcaattcaccactgctctgggaaagcaaaaggaaagttcctgttgtgtgtgaagagcctcttaggctataaggcttcccagccatagtcagctatagctattcagagacagcaggttcttccagtctttgttcctgggacctgatgttttgagcaactcaggtcactgataaagtggaaggactaagacactgtggtcacagatcccagcaacatcaactcacactcaatccatgtggtggtccacattctgctactcttatccacccatgtggtcattgagagcctttctcagagactcttctgtgtgtttgattgtgcccaggtggcccagggctagctggctctaacaactagcatgacagcctccaatcagaaaggcaggtaaggggacagggtgaggagaatgggcagatactgacagaaattaaagtaaagggattgtgaaagtaaagagctcttcctgattctcatcttctcttttttctattacaaggcattgaacttggcacttcctgtattctttgtgatcactattgagtgcattagttaacacccaaggggatggcttgattgggaatgtagtgaaaggagctgatctactgtattgtaatgtaaaacagctacagccagttattttgtaagattataagttgttcattaaaaaatcagcacacaaaatatgaa

SEQ ID NO: 163634 - DNA, 5867 bp, Homo sapiens
  Payload ID: 12225
  Gene Symbol: PARD3
  Gene Name: par-3 family cell polarity regulator
  Uniprot ID: Q8TEW0
  ENST ID: ENST00000350537
  CDS Start-End: 327-4259
gcggccccgagcgagcgccagcgccacacagccccgggcagccgccggcgagcgcgccgcgacgccgaacaggtggccggaggctgcgggcgccgcggcggggagaggcgaggcaagccccgggcgaagcgaggcgaggcgagggcggccgggccgggcatgcgagctgagcggccccccggcgtcgccgccgcctgcccgcgcccctagccgcccgcgcgcccgagtccccagcggctcctccgcgcccagcgtcctcggtcccggcctcggctgctccggctgcgctcggcgaggggcgcgggcccgcccgcggcggcggcggcatgaaagtgaccgtgtgcttcggacggacccgggtggtcgtgccgtgcggggacggccacatgaaagttttcagcctcatccagcaggcggtgacccgctaccggaaggccatcgccaaggatccaaactactggatacaggtgcatcgcttggaacatggagatggaggaatactagaccttgatgacattctttgtgatgtagcagacgataaagacagactggtagcagtgtttgatgagcaggatccacatcacggaggtgatggcaccagtgccagttccacgggtacccagagcccagagatatttggtagtgagcttggcaccaacaatgtctcagcctttcagccttaccaagcaacaagtgaaattgaggtcacaccttcagtccttcgagcaaatatgcctcttcatgttcgacgcagtagtgacccagctctaattggcctctccacttctgtcagtgatagtaatttttcctctgaagagccttcaaggaaaaatcccacacgctggtcaacaacagctggcttcctcaagcagaacactgctgggagtcctaaaacctgcgacaggaagaaagatgaaaactacagaagcctcccgcgggatactagtaactggtctaaccaatttcagagagacaatgctcgctcgtctctgagtgccagtcacccaatggtgggcaagtggctggagaaacaagaacaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccacgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagatagctgacgagactaaactcaatacagtggatgaccagaaagcaggttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcaggtttggcaaacatcgaaaagatgacaagattgagaaaacgggtaaaataaaaatacaggaatcctttacatcagaagaggagaggatacgaatgaagcaggagcaggagaggattcaagccaaaactcgagaatttagggaacgacaagctcgagagcgtgactatgctgaaattcaagattttcatcggacatttggctgtgatgatgagttaatgtatgggggagtttcttcttatgaaggttccatggctctcaacgctagacctcagagcccacgagaagggcatatgatggatgctttgtatgcccaagtcaagaagccgcggaattccaaaccctcacctgtagacagtaacagatcaactcctagcaatcatgatcggatacagcgtctgaggcaagaatttcagcaagcaaagcaagatgaagatgtagaagatcgtcggcggacctatagttttgagcaaccctggccgaacgcacggccggcgacgcagagcgggcgacactcggtgtccgtggaggtgcagatgcagcggcagcggcaggaggagcgcgagagctcccagcaggcccagcgccagtacagctctctgcctcggcaaagcaggaaaaatgccagctcggtctcccaggactcttgggagcagaactactcccctggggaaggcttccagagtgccaaagagaaccccaggtactccagctaccaaggctccaggaacggctacctgggaggacatggcttcaacgccagggtcatgctggaaactcaggagctccttcgccaggaacagaggcggaaggagcagcagatgaagaagcagcctccttccgaggggcccagcaactatgactcgtataagaaagtccaggaccccagttacgcccctcccaaggggcccttccggcaagatgtgcccccctccccttctcaggttgcgaggctgaacagacttcagactcctgagaaagggaggcccttctattcctgagcacgcaaataacggatgcttcatgtcgcgcaataaaagacattttcctatgaagacttgtattttgggagtttttttaaaacctcgatggtactatggagtatttctgttgttggtatcagtgcctttaagcggtgtaggcaaagaaatggaaggccttaatgtctttgccactatgtctcaagtgtctgtttcatggaaggatttcccaccctgtgacaatcatctgtttgaggtgttcatatgctctgcgcctctccacagtaccaggaatctcggccctactcatgagttgtccgcggcttggttgtaacatccctgcaccacttgcagtgacaaattcacctgaagtggaggatgacgtgcggccctgtttctccctctaagttctcttagctatgggatgacatcttagtctctggtggaggaaaagtgggcgacatacaccaaaaattggggctttctggtacttcacagcacagccatttgtcgtactttgtcatcactgtggttttctctttcctttctcagctctttgtgacgggagagtcggtcatcctattacagaagctaagccatagtccaacattgtttggtcaccatgggggtccttttgtaactgccttatgactcaacattaccaataaagtgatgatcctggtctgcgtttatacatacgcttgttcggtcctgttcctgacacgtgggttgagtcaccacagctctgtgtggggaacgtgggagacaggagtggctcctgccgggggaagctgggcctgccattggccctgtgtctatcatgaggggagagctaagaaagaaattctcctaggaagagctcatggcccagtacatcctagtaattattttaattagtttttgttctgacagcttgtcaggaagggcacagaatgggacagagataaaccagacagtcattttgatctgctctctacggtttttcaagtcagaggcaattgatgcttgtctaatgcatccacacactgcatgtctgactggcgatgccgcgctcctaagtagttctgccatgaaacataaaagacaaaggaaaagccgttacacatcacacagagaacattttcgggtcccacagcggtggtggcaggaagctcactctcgcgtcagtattagagtgtgtgtgtgggtctcggggatctcggtggctcccatcttccttcattgttctgaacatcctgtattgtaaaccatggctggggtgctaaagtgcctgtgaatcccgatgtggaaaaagctggaggtgaaagctcagcataccatgtatttactttaaaaacagaaaaaaagacatgtatggatatgtctattttttttttattggcacattgtatttttgtgttgacttgtttttagaaatgatgtgtccacacacgtacccgtgtctcttctgcatttctgtgtcatggttctgtttcttaatcacgtgcggcggtgtctaagtggtgttaccagtgtacgcgcagtgaccttggatgacagtggctctttctcacagcctcccctgagctgtgagaaacagctttctctgtacatatgcaactcctaataaaaggcatatttcttcctgtt

SEQ ID NO: 163635 - DNA, 5894 bp, Homo sapiens
  Payload ID: 12225
  Gene Symbol: PARD3
  Gene Name: par-3 family cell polarity regulator
  Uniprot ID: Q8TEW0
  ENST ID: ENST00000346874
  CDS Start-End: 327-4286
gcggccccgagcgagcgccagcgccacacagccccgggcagccgccggcgagcgcgccgcgacgccgaacaggtggccggaggctgcgggcgccgcggcggggagaggcgaggcaagccccgggcgaagcgaggcgaggcgagggcggccgggccgggcatgcgagctgagcggccccccggcgtcgccgccgcctgcccgcgcccctagccgcccgcgcgcccgagtccccagcggctcctccgcgcccagcgtcctcggtcccggcctcggctgctccggctgcgctcggcgaggggcgcgggcccgcccgcggcggcggcggcatgaaagtgaccgtgtgcttcggacggacccgggtggtcgtgccgtgcggggacggccacatgaaagttttcagcctcatccagcaggcggtgacccgctaccggaaggccatcgccaaggatccaaactactggatacaggtgcatcgcttggaacatggagatggaggaatactagaccttgatgacattctttgtgatgtagcagacgataaagacagactggtagcagtgtttgatgagcaggatccacatcacggaggtgatggcaccagtgccagttccacgggtacccagagcccagagatatttggtagtgagcttggcaccaacaatgtctcagcctttcagccttaccaagcaacaagtgaaattgaggtcacaccttcagtccttcgagcaaatatgcctcttcatgttcgacgcagtagtgacccagctctaattggcctctccacttctgtcagtgatagtaatttttcctctgaagagccttcaaggaaaaatcccacacgctggtcaacaacagctggcttcctcaagcagaacactgctgggagtcctaaaacctgcgacaggaagaaagatgaaaactacagaagcctcccgcgggatactagtaactggtctaaccaatttcagagagacaatgctcgctcgtctctgagtgccagtcacccaatggtgggcaagtggctggagaaacaagaacaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccacgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaatgcagagccaagccagatgcagattccaaaagaaacgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtgagtcaggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagagtatgtcagaaaaacgcacaaagcaattttcagatgccagtcaattggatttcgttaaaacacgaaaatcaaaaagcatggatttaggtatagctgacgagactaaactcaatacagtggatgaccagaaagcaggttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcaggattcaagccaaaactcgagaatttagggaacgacaagctcgagagcgtgactatgctgaaattcaagattttcatcggacatttggctgtgatgatgagttaatgtatgggggagtttcttcttatgaaggttccatggctctcaacgctagacctcagagcccacgagaagggcatatgatggatgctttgtatgcccaagtcaagaagccgcggaattccaaaccctcacctgtagacagtaacagatcaactcctagcaatcatgatcggatacagcgtctgaggcaagaatttcagcaagcaaagcaagatgaagatgtagaagatcgtcggcggacctatagttttgagcaaccctggccgaacgcacggccggcgacgcagagcgggcgacactcggtgtccgtggaggtgcagatgcagcggcagcggcaggaggagcgcgagagctcccagcaggcccagcgccagtacagctctctgcctcggcaaagcaggaaaaatgccagctcggtctcccaggactcttgggagcagaactactcccctggggaaggcttccagagtgccaaagagaaccccaggtactccagctaccaaggctccaggaacggctacctgggaggacatggcttcaacgccagggtcatgctggaaactcaggagctccttcgccaggaacagaggcggaaggagcagcagatgaagaagcagcctccttccgaggggcccagcaactatgactcgtataagaaagtccaggaccccagttacgcccctcccaaggggcccttccggcaagatgtgcccccctccccttctcaggttgcgaggctgaacagacttcagactcctgagaaagggaggcccttctattcctgagcacgcaaataacggatgcttcatgtcgcgcaataaaagacattttcctatgaagacttgtattttgggagtttttttaaaacctcgatggtactatggagtatttctgttgttggtatcagtgcctttaagcggtgtaggcaaagaaatggaaggccttaatgtctttgccactatgtctcaagtgtctgtttcatggaaggatttcccaccctgtgacaatcatctgtttgaggtgttcatatgctctgcgcctctccacagtaccaggaatctcggccctactcatgagttgtccgcggcttggttgtaacatccctgcaccacttgcagtgacaaattcacctgaagtggaggatgacgtgcggccctgtttctccctctaagttctcttagctatgggatgacatcttagtctctggtggaggaaaagtgggcgacatacaccaaaaattggggctttctggtacttcacagcacagccatttgtcgtactttgtcatcactgtggttttctctttcctttctcagctctttgtgacgggagagtcggtcatcctattacagaagctaagccatagtccaacattgtttggtcaccatgggggtccttttgtaactgccttatgactcaacattaccaataaagtgatgatcctggtctgcgtttatacatacgcttgttcggtcctgttcctgacacgtgggttgagtcaccacagctctgtgtggggaacgtgggagacaggagtggctcctgccgggggaagctgggcctgccattggccctgtgtctatcatgaggggagagctaagaaagaaattctcctaggaagagctcatggcccagtacatcctagtaattattttaattagtttttgttctgacagcttgtcaggaagggcacagaatgggacagagataaaccagacagtcattttgatctgctctctacggtttttcaagtcagaggcaattgatgcttgtctaatgcatccacacactgcatgtctgactggcgatgccgcgctcctaagtagttctgccatgaaacataaaagacaaaggaaaagccgttacacatcacacagagaacattttcgggtcccacagcggtggtggcaggaagctcactctcgcgtcagtattagagtgtgtgtgtgggtctcggggatctcggtggctcccatcttccttcattgttctgaacatcctgtattgtaaaccatggctggggtgctaaagtgcctgtgaatcccgatgtggaaaaagctggaggtgaaagctcagcataccatgtatttactttaaaaacagaaaaaaagacatgtatggatatgtctattttttttttattggcacattgtatttttgtgttgacttgtttttagaaatgatgtgtccacacacgtacccgtgtctcttctgcatttctgtgtcatggttctgtttcttaatcacgtgcggcggtgtctaagtggtgttaccagtgtacgcgcagtgaccttggatgacagtggctctttctcacagcctcccctgagctgtgagaaacagctttctctgtacatatgcaactcctaataaaaggcatatttcttcctgtt

SEQ ID NO: 163636 - DNA, 3518 bp, Homo sapiens
  Payload ID: 12225
  Gene Symbol: PARD3
  Gene Name: par-3 family cell polarity regulator
  Uniprot ID: Q8TEW0
  ENST ID: ENST00000340077
  CDS Start-End: 331-3426
cccagcggccccgagcgagcgccagcgccacacagccccgggcagccgccggcgagcgcgccgcgacgccgaacaggtggccggaggctgcgggcgccgcggcggggagaggcgaggcaagccccgggcgaagcgaggcgaggcgagggcggccgggccgggcatgcgagctgagcggccccccggcgtcgccgccgcctgcccgcgcccctagccgcccgcgcgcccgagtccccagcggctcctccgcgcccagcgtcctcggtcccggcctcggctgctccggctgcgctcggcgaggggcgcgggcccgcccgcggcggcggcggcatgaaagtgaccgtgtgcttcggacggacccgggtggtcgtgccgtgcggggacggccacatgaaagttttcagcctcatccagcaggcggtgacccgctaccggaaggccatcgccaaggatccaaactactggatacaggtgcatcgcttggaacatggagatggaggaatactagaccttgatgacattctttgtgatgtagcagacgataaagacagactggtagcagtgtttgatgagcaggatccacatcacggaggtgatggcaccagtgccagttccacgggtacccagagcccagagatatttggtagtgagcttggcaccaacaatgtctcagcctttcagccttaccaagcaacaagtgaaattgaggtcacaccttcagtccttcgagcaaatatgcctcttcatgttcgacgcagtagtgacccagctctaattggcctctccacttctgtcagtgatagtaatttttcctctgaagagccttcaaggaaaaatcccacacgctggtcaacaacagctggcttcctcaagcagaacactgctgggagtcctaaaacctgcgacaggaagaaagatgaaaactacagaagcctcccgcgggatactagtaactggtctaaccaatttcagagagacaatgctcgctcgtctctgagtgccagtcacccaatggtgggcaagtggctggagaaacaagaacaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccacgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaatgcagagccaagccagatgcagattccaaaagaaacgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagagtatgtcagaaaaacgcacaaagcaattttcagatgccagtcaattggatttcgttaaaacacgaaaatcaaaaagcatggatttaggtatagctgacgagactaaactcaatacagtggatgaccagaaagcaggttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcagccttgccaaactgaagcccgagaagagatgaacaacaaagcgattcaaaacatgtcttgaacagcacatattgcacagttgttgttttttttaaacaaacaataaatttacttttaatgaatt

SEQ ID NO: 163637 - DNA, 799 bp, Homo sapiens
  Payload ID: 12225
  Gene Symbol: PARD3
  Gene Name: par-3 family cell polarity regulator
  ENST ID: ENST00000374768
  CDS Start-End: 16-555
gcagagccaagccagatgcagattccaaaagaaacgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggaacataggacttgccatactgaatcagaccattggtccaccagttcctgtaacctgcgtcctgcctccaatccctgatgcttcagaggaaggcgaaaaactaaaactaaaactcaaaccaaaaaaatccctaaattcagctagtgaccttttgaaatgctgtatatatgagttgaagagtcattcattttcttcctagtctgttgccccgattttgttagctacagcttcattagtcctcttcggtttgca

SEQ ID NO: 163638 - DNA, 3420 bp, Homo sapiens
  Payload ID: 12225
  Gene Symbol: PARD3
  Gene Name: par-3 family cell polarity regulator
  ENST ID: ENST00000374773
  CDS Start-End: 327-3332
gcggccccgagcgagcgccagcgccacacagccccgggcagccgccggcgagcgcgccgcgacgccgaacaggtggccggaggctgcgggcgccgcggcggggagaggcgaggcaagccccgggcgaagcgaggcgaggcgagggcggccgggccgggcatgcgagctgagcggccccccggcgtcgccgccgcctgcccgcgcccctagccgcccgcgcgcccgagtccccagcggctcctccgcgcccagcgtcctcggtcccggcctcggctgctccggctgcgctcggcgaggggcgcgggcccgcccgcggcggcggcggcatgaaagtgaccgtgtgcttcggacggacccgggtggtcgtgccgtgcggggacggccacatgaaagttttcagcctcatccagcaggcggtgacccgctaccggaaggccatcgccaaggatccaaactactggatacaggtgcatcgcttggaacatggagatggaggaatactagaccttgatgacattctttgtgatgtagcagacgataaagacagactggtagcagtgtttgatgagcaggatccacatcacggaggtgatggcaccagtgccagttccacgggtacccagagcccagagatatttggtagtgagcttggcaccaacaatgtctcagcctttcagccttaccaagcaacaagtgaaattgaggtcacaccttcagtccttcgagcaaatatgcctcttcatgttcgacgcagtagtgacccagctctaattggcctctccacttctgtcagtgatagtaatttttcctctgaagagccttcaaggaaaaatcccacacgctggtcaacaacagctggcttcctcaagcagaacactgctgggagtcctaaaacctgcgacaggaagaaagatgaaaactacagaagcctcccgcgggatactagtaactggtctaaccaatttcagagagacaatgctcgctcgtctctgagtgccagtcacccaatggtgggcaagtggctggagaaacaagaacaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccacgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaatgcagagccaagccagatgcagattccaaaagaaacgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagatagctgacgagactaaactcaatacagtggatgaccagaaagcaggttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcagccttgccaaactgaagcccgagaagagatgaacaacaaagcgattcaaaacatgtcttgaacagcacatattgcacagttgttgttttttttaaacaaacaataaatttacttttaatg

SEQ ID NO: 163639 - DNA, 3389 bp, Homo sapiens
  Payload ID: 12225
  Gene Symbol: PARD3
  Gene Name: par-3 family cell polarity regulator
  Uniprot ID: Q8TEW0
  ENST ID: ENST00000374776
  CDS Start-End: 327-3293
gcggccccgagcgagcgccagcgccacacagccccgggcagccgccggcgagcgcgccgcgacgccgaacaggtggccggaggctgcgggcgccgcggcggggagaggcgaggcaagccccgggcgaagcgaggcgaggcgagggcggccgggccgggcatgcgagctgagcggccccccggcgtcgccgccgcctgcccgcgcccctagccgcccgcgcgcccgagtccccagcggctcctccgcgcccagcgtcctcggtcccggcctcggctgctccggctgcgctcggcgaggggcgcgggcccgcccgcggcggcggcggcatgaaagtgaccgtgtgcttcggacggacccgggtggtcgtgccgtgcggggacggccacatgaaagttttcagcctcatccagcaggcggtgacccgctaccggaaggccatcgccaaggatccaaactactggatacaggtgcatcgcttggaacatggagatggaggaatactagaccttgatgacattctttgtgatgtagcagacgataaagacagactggtagcagtgtttgatgagcaggatccacatcacggaggtgatggcaccagtgccagttccacgggtacccagagcccagagatatttggtagtgagcttggcaccaacaatgtctcagcctttcagccttaccaagcaacaagtgaaattgaggtcacaccttcagtccttcgagcaaatatgcctcttcatgttcgacgcagtagtgacccagctctaattggcctctccacttctgtcagtgatagtaatttttcctctgaagagccttcaaggaaaaatcccacacgctggtcaacaacagctggcttcctcaagcagaacactgctgggagtcctaaaacctgcgacaggaagaaagatgaaaactacagaagcctcccgcgggatactagtaactggtctaaccaatttcagagagacaatgctcgctcgtctctgagtgccagtcacccaatggtgggcaagtggctggagaaacaagaacaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccacgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagatagctgacgagactaaactcaatacagtggatgaccagaaagcaggttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcagccttgccaaactgaagcccgagaagagatgaacaacaaagcgattcaaaacatgtcttgaacagcacatattgcacagttgttgttttttttaaacaaacaataaatttacttttaatgaattctta

SEQ ID NO: 163640 - DNA, 5996 bp, Homo sapiens
  Payload ID: 12225
  Gene Symbol: PARD3
  Gene Name: par-3 family cell polarity regulator
  Uniprot ID: Q8TEW0
  ENST ID: ENST00000374788
  CDS Start-End: 327-4388
gcggccccgagcgagcgccagcgccacacagccccgggcagccgccggcgagcgcgccgcgacgccgaacaggtggccggaggctgcgggcgccgcggcggggagaggcgaggcaagccccgggcgaagcgaggcgaggcgagggcggccgggccgggcatgcgagctgagcggccccccggcgtcgccgccgcctgcccgcgcccctagccgcccgcgcgcccgagtccccagcggctcctccgcgcccagcgtcctcggtcccggcctcggctgctccggctgcgctcggcgaggggcgcgggcccgcccgcggcggcggcggcatgaaagtgaccgtgtgcttcggacggacccgggtggtcgtgccgtgcggggacggccacatgaaagttttcagcctcatccagcaggcggtgacccgctaccggaaggccatcgccaaggatccaaactactggatacaggtgcatcgcttggaacatggagatggaggaatactagaccttgatgacattctttgtgatgtagcagacgataaagacagactggtagcagtgtttgatgagcaggatccacatcacggaggtgatggcaccagtgccagttccacgggtacccagagcccagagatatttggtagtgagcttggcaccaacaatgtctcagcctttcagccttaccaagcaacaagtgaaattgaggtcacaccttcagtccttcgagcaaatatgcctcttcatgttcgacgcagtagtgacccagctctaattggcctctccacttctgtcagtgatagtaatttttcctctgaagagccttcaaggaaaaatcccacacgctggtcaacaacagctggcttcctcaagcagaacactgctgggagtcctaaaacctgcgacaggaagaaagatgaaaactacagaagcctcccgcgggatactagtaactggtctaaccaatttcagagagacaatgctcgctcgtctctgagtgccagtcacccaatggtgggcaagtggctggagaaacaagaacaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccacgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaatgcagagccaagccagatgcagattccaaaagaaacgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagagtatgtcagaaaaacgcacaaagcaattttcagatgccagtcaattggatttcgttaaaacacgaaaatcaaaaagcatggatttaggtatagctgacgagactaaactcaatacagtggatgaccagaaagcaggttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcaggtttggcaaacatcgaaaagatgacaagattgagaaaacgggtaaaataaaaatacaggaatcctttacatcagaagaggagaggatacgaatgaagcaggagcaggagaggattcaagccaaaactcgagaatttagggaacgacaagctcgagagcgtgactatgctgaaattcaagattttcatcggacatttggctgtgatgatgagttaatgtatgggggagtttcttcttatgaaggttccatggctctcaacgctagacctcagagcccacgagaagggcatatgatggatgctttgtatgcccaagtcaagaagccgcggaattccaaaccctcacctgtagacagtaacagatcaactcctagcaatcatgatcggatacagcgtctgaggcaagaatttcagcaagcaaagcaagatgaagatgtagaagatcgtcggcggacctatagttttgagcaaccctggccgaacgcacggccggcgacgcagagcgggcgacactcggtgtccgtggaggtgcagatgcagcggcagcggcaggaggagcgcgagagctcccagcaggcccagcgccagtacagctctctgcctcggcaaagcaggaaaaatgccagctcggtctcccaggactcttgggagcagaactactcccctggggaaggcttccagagtgccaaagagaaccccaggtactccagctaccaaggctccaggaacggctacctgggaggacatggcttcaacgccagggtcatgctggaaactcaggagctccttcgccaggaacagaggcggaaggagcagcagatgaagaagcagcctccttccgaggggcccagcaactatgactcgtataagaaagtccaggaccccagttacgcccctcccaaggggcccttccggcaagatgtgcccccctccccttctcaggttgcgaggctgaacagacttcagactcctgagaaagggaggcccttctattcctgagcacgcaaataacggatgcttcatgtcgcgcaataaaagacattttcctatgaagacttgtattttgggagtttttttaaaacctcgatggtactatggagtatttctgttgttggtatcagtgcctttaagcggtgtaggcaaagaaatggaaggccttaatgtctttgccactatgtctcaagtgtctgtttcatggaaggatttcccaccctgtgacaatcatctgtttgaggtgttcatatgctctgcgcctctccacagtaccaggaatctcggccctactcatgagttgtccgcggcttggttgtaacatccctgcaccacttgcagtgacaaattcacctgaagtggaggatgacgtgcggccctgtttctccctctaagttctcttagctatgggatgacatcttagtctctggtggaggaaaagtgggcgacatacaccaaaaattggggctttctggtacttcacagcacagccatttgtcgtactttgtcatcactgtggttttctctttcctttctcagctctttgtgacgggagagtcggtcatcctattacagaagctaagccatagtccaacattgtttggtcaccatgggggtccttttgtaactgccttatgactcaacattaccaataaagtgatgatcctggtctgcgtttatacatacgcttgttcggtcctgttcctgacacgtgggttgagtcaccacagctctgtgtggggaacgtgggagacaggagtggctcctgccgggggaagctgggcctgccattggccctgtgtctatcatgaggggagagctaagaaagaaattctcctaggaagagctcatggcccagtacatcctagtaattattttaattagtttttgttctgacagcttgtcaggaagggcacagaatgggacagagataaaccagacagtcattttgatctgctctctacggtttttcaagtcagaggcaattgatgcttgtctaatgcatccacacactgcatgtctgactggcgatgccgcgctcctaagtagttctgccatgaaacataaaagacaaaggaaaagccgttacacatcacacagagaacattttcgggtcccacagcggtggtggcaggaagctcactctcgcgtcagtattagagtgtgtgtgtgggtctcggggatctcggtggctcccatcttccttcattgttctgaacatcctgtattgtaaaccatggctggggtgctaaagtgcctgtgaatcccgatgtggaaaaagctggaggtgaaagctcagcataccatgtatttactttaaaaacagaaaaaaagacatgtatggatatgtctattttttttttattggcacattgtatttttgtgttgacttgtttttagaaatgatgtgtccacacacgtacccgtgtctcttctgcatttctgtgtcatggttctgtttcttaatcacgtgcggcggtgtctaagtggtgttaccagtgtacgcgcagtgaccttggatgacagtggctctttctcacagcctcccctgagctgtgagaaacagctttctctgtacatatgcaactcctaataaaaggcatatttcttcctgtt

SEQ ID NO: 163641 - DNA, 6005 bp, Homo sapiens
  Payload ID: 12225
  Gene Symbol: PARD3
  Gene Name: par-3 family cell polarity regulator
  Uniprot ID: Q8TEW0
  ENST ID: ENST00000374789
  CDS Start-End: 327-4397
gcggccccgagcgagcgccagcgccacacagccccgggcagccgccggcgagcgcgccgcgacgccgaacaggtggccggaggctgcgggcgccgcggcggggagaggcgaggcaagccccgggcgaagcgaggcgaggcgagggcggccgggccgggcatgcgagctgagcggccccccggcgtcgccgccgcctgcccgcgcccctagccgcccgcgcgcccgagtccccagcggctcctccgcgcccagcgtcctcggtcccggcctcggctgctccggctgcgctcggcgaggggcgcgggcccgcccgcggcggcggcggcatgaaagtgaccgtgtgcttcggacggacccgggtggtcgtgccgtgcggggacggccacatgaaagttttcagcctcatccagcaggcggtgacccgctaccggaaggccatcgccaaggatccaaactactggatacaggtgcatcgcttggaacatggagatggaggaatactagaccttgatgacattctttgtgatgtagcagacgataaagacagactggtagcagtgtttgatgagcaggatccacatcacggaggtgatggcaccagtgccagttccacgggtacccagagcccagagatatttggtagtgagcttggcaccaacaatgtctcagcctttcagccttaccaagcaacaagtgaaattgaggtcacaccttcagtccttcgagcaaatatgcctcttcatgttcgacgcagtagtgacccagctctaattggcctctccacttctgtcagtgatagtaatttttcctctgaagagccttcaaggaaaaatcccacacgctggtcaacaacagctggcttcctcaagcagaacactgctgggagtcctaaaacctgcgacaggaagaaagatgaaaactacagaagcctcccgcgggatactagtaactggtctaaccaatttcagagagacaatgctcgctcgtctctgagtgccagtcacccaatggtgggcaagtggctggagaaacaagaacaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccacgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaatgcagagccaagccagatgcagattccaaaagaaacgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtgagtcaggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagagtatgtcagaaaaacgcacaaagcaattttcagatgccagtcaattggatttcgttaaaacacgaaaatcaaaaagcatggatttaggtatagctgacgagactaaactcaatacagtggatgaccagaaagcaggttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcaggtttggcaaacatcgaaaagatgacaagattgagaaaacgggtaaaataaaaatacaggaatcctttacatcagaagaggagaggatacgaatgaagcaggagcaggagaggattcaagccaaaactcgagaatttagggaacgacaagctcgagagcgtgactatgctgaaattcaagattttcatcggacatttggctgtgatgatgagttaatgtatgggggagtttcttcttatgaaggttccatggctctcaacgctagacctcagagcccacgagaagggcatatgatggatgctttgtatgcccaagtcaagaagccgcggaattccaaaccctcacctgtagacagtaacagatcaactcctagcaatcatgatcggatacagcgtctgaggcaagaatttcagcaagcaaagcaagatgaagatgtagaagatcgtcggcggacctatagttttgagcaaccctggccgaacgcacggccggcgacgcagagcgggcgacactcggtgtccgtggaggtgcagatgcagcggcagcggcaggaggagcgcgagagctcccagcaggcccagcgccagtacagctctctgcctcggcaaagcaggaaaaatgccagctcggtctcccaggactcttgggagcagaactactcccctggggaaggcttccagagtgccaaagagaaccccaggtactccagctaccaaggctccaggaacggctacctgggaggacatggcttcaacgccagggtcatgctggaaactcaggagctccttcgccaggaacagaggcggaaggagcagcagatgaagaagcagcctccttccgaggggcccagcaactatgactcgtataagaaagtccaggaccccagttacgcccctcccaaggggcccttccggcaagatgtgcccccctccccttctcaggttgcgaggctgaacagacttcagactcctgagaaagggaggcccttctattcctgagcacgcaaataacggatgcttcatgtcgcgcaataaaagacattttcctatgaagacttgtattttgggagtttttttaaaacctcgatggtactatggagtatttctgttgttggtatcagtgcctttaagcggtgtaggcaaagaaatggaaggccttaatgtctttgccactatgtctcaagtgtctgtttcatggaaggatttcccaccctgtgacaatcatctgtttgaggtgttcatatgctctgcgcctctccacagtaccaggaatctcggccctactcatgagttgtccgcggcttggttgtaacatccctgcaccacttgcagtgacaaattcacctgaagtggaggatgacgtgcggccctgtttctccctctaagttctcttagctatgggatgacatcttagtctctggtggaggaaaagtgggcgacatacaccaaaaattggggctttctggtacttcacagcacagccatttgtcgtactttgtcatcactgtggttttctctttcctttctcagctctttgtgacgggagagtcggtcatcctattacagaagctaagccatagtccaacattgtttggtcaccatgggggtccttttgtaactgccttatgactcaacattaccaataaagtgatgatcctggtctgcgtttatacatacgcttgttcggtcctgttcctgacacgtgggttgagtcaccacagctctgtgtggggaacgtgggagacaggagtggctcctgccgggggaagctgggcctgccattggccctgtgtctatcatgaggggagagctaagaaagaaattctcctaggaagagctcatggcccagtacatcctagtaattattttaattagtttttgttctgacagcttgtcaggaagggcacagaatgggacagagataaaccagacagtcattttgatctgctctctacggtttttcaagtcagaggcaattgatgcttgtctaatgcatccacacactgcatgtctgactggcgatgccgcgctcctaagtagttctgccatgaaacataaaagacaaaggaaaagccgttacacatcacacagagaacattttcgggtcccacagcggtggtggcaggaagctcactctcgcgtcagtattagagtgtgtgtgtgggtctcggggatctcggtggctcccatcttccttcattgttctgaacatcctgtattgtaaaccatggctggggtgctaaagtgcctgtgaatcccgatgtggaaaaagctggaggtgaaagctcagcataccatgtatttactttaaaaacagaaaaaaagacatgtatggatatgtctattttttttttattggcacattgtatttttgtgttgacttgtttttagaaatgatgtgtccacacacgtacccgtgtctcttctgcatttctgtgtcatggttctgtttcttaatcacgtgcggcggtgtctaagtggtgttaccagtgtacgcgcagtgaccttggatgacagtggctctttctcacagcctcccctgagctgtgagaaacagctttctctgtacatatgcaactcctaataaaaggcatatttcttcctgtt

SEQ ID NO: 163642 - DNA, 5825 bp, Homo sapiens
  Payload ID: 12225
  Gene Symbol: PARD3
  Gene Name: par-3 family cell polarity regulator
  ENST ID: ENST00000374790
  CDS Start-End: 327-4217
gcggccccgagcgagcgccagcgccacacagccccgggcagccgccggcgagcgcgccgcgacgccgaacaggtggccggaggctgcgggcgccgcggcggggagaggcgaggcaagccccgggcgaagcgaggcgaggcgagggcggccgggccgggcatgcgagctgagcggccccccggcgtcgccgccgcctgcccgcgcccctagccgcccgcgcgcccgagtccccagcggctcctccgcgcccagcgtcctcggtcccggcctcggctgctccggctgcgctcggcgaggggcgcgggcccgcccgcggcggcggcggcatgaaagtgaccgtgtgcttcggacggacccgggtggtcgtgccgtgcggggacggccacatgaaagttttcagcctcatccagcaggcggtgacccgctaccggaaggccatcgccaaggatccaaactactggatacaggtgcatcgcttggaacatggagatggaggaatactagaccttgatgacattctttgtgatgtagcagacgataaagacagactggtagcagtgtttgatgagcaggatccacatcacggaggtgatggcaccagtgccagttccacgggtacccagagcccagagatatttggtagtgagcttggcaccaacaatgtctcagcctttcagccttaccaagcaacaagtgaaattgaggtcacaccttcagtccttcgagcaaatatgcctcttcatgttcgacgcagtagtgacccagctctaattggcctctccacttctgtcagtgatagtaatttttcctctgaagagccttcaaggaaaaatcccacacgctggtcaacaacagctggcttcctcaagcagaacactgctgggagtcctaaaacctgcgacaggaaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccacgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagagtatgtcagaaaaacgcacaaagcaattttcagatgccagtcaattggatttcgttaaaacacgaaaatcaaaaagcatggatttaggtatagctgacgagactaaactcaatacagtggatgaccagaaagcaggttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcaggtttggcaaacatcgaaaagatgacaagattgagaaaacgggtaaaataaaaatacaggaatcctttacatcagaagaggagaggatacgaatgaagcaggagcaggagaggattcaagccaaaactcgagaatttagggaacgacaagctcgagagcgtgactatgctgaaattcaagattttcatcggacatttggctgtgatgatgagttaatgtatgggggagtttcttcttatgaaggttccatggctctcaacgctagacctcagagcccacgagaagggcatatgatggatgctttgtatgcccaagtcaagaagccgcggaattccaaaccctcacctgtagacagtaacagatcaactcctagcaatcatgatcggatacagcgtctgaggcaagaatttcagcaagcaaagcaagatgaagatgtagaagatcgtcggcggacctatagttttgagcaaccctggccgaacgcacggccggcgacgcagagcgggcgacactcggtgtccgtggaggtgcagatgcagcggcagcggcaggaggagcgcgagagctcccagcaggcccagcgccagtacagctctctgcctcggcaaagcaggaaaaatgccagctcggtctcccaggactcttgggagcagaactactcccctggggaaggcttccagagtgccaaagagaaccccaggtactccagctaccaaggctccaggaacggctacctgggaggacatggcttcaacgccagggtcatgctggaaactcaggagctccttcgccaggaacagaggcggaaggagcagcagatgaagaagcagcctccttccgaggggcccagcaactatgactcgtataagaaagtccaggaccccagttacgcccctcccaaggggcccttccggcaagatgtgcccccctccccttctcaggttgcgaggctgaacagacttcagactcctgagaaagggaggcccttctattcctgagcacgcaaataacggatgcttcatgtcgcgcaataaaagacattttcctatgaagacttgtattttgggagtttttttaaaacctcgatggtactatggagtatttctgttgttggtatcagtgcctttaagcggtgtaggcaaagaaatggaaggccttaatgtctttgccactatgtctcaagtgtctgtttcatggaaggatttcccaccctgtgacaatcatctgtttgaggtgttcatatgctctgcgcctctccacagtaccaggaatctcggccctactcatgagttgtccgcggcttggttgtaacatccctgcaccacttgcagtgacaaattcacctgaagtggaggatgacgtgcggccctgtttctccctctaagttctcttagctatgggatgacatcttagtctctggtggaggaaaagtgggcgacatacaccaaaaattggggctttctggtacttcacagcacagccatttgtcgtactttgtcatcactgtggttttctctttcctttctcagctctttgtgacgggagagtcggtcatcctattacagaagctaagccatagtccaacattgtttggtcaccatgggggtccttttgtaactgccttatgactcaacattaccaataaagtgatgatcctggtctgcgtttatacatacgcttgttcggtcctgttcctgacacgtgggttgagtcaccacagctctgtgtggggaacgtgggagacaggagtggctcctgccgggggaagctgggcctgccattggccctgtgtctatcatgaggggagagctaagaaagaaattctcctaggaagagctcatggcccagtacatcctagtaattattttaattagtttttgttctgacagcttgtcaggaagggcacagaatgggacagagataaaccagacagtcattttgatctgctctctacggtttttcaagtcagaggcaattgatgcttgtctaatgcatccacacactgcatgtctgactggcgatgccgcgctcctaagtagttctgccatgaaacataaaagacaaaggaaaagccgttacacatcacacagagaacattttcgggtcccacagcggtggtggcaggaagctcactctcgcgtcagtattagagtgtgtgtgtgggtctcggggatctcggtggctcccatcttccttcattgttctgaacatcctgtattgtaaaccatggctggggtgctaaagtgcctgtgaatcccgatgtggaaaaagctggaggtgaaagctcagcataccatgtatttactttaaaaacagaaaaaaagacatgtatggatatgtctattttttttttattggcacattgtatttttgtgttgacttgtttttagaaatgatgtgtccacacacgtacccgtgtctcttctgcatttctgtgtcatggttctgtttcttaatcacgtgcggcggtgtctaagtggtgttaccagtgtacgcgcagtgaccttggatgacagtggctctttctcacagcctcccctgagctgtgagaaacagctttctctgtacatatgcaactcctaataaaaggcatatttcttcctgtt

SEQ ID NO: 163643 - DNA, 5669 bp, Homo sapiens
  Payload ID: 12225
  Gene Symbol: PARD3
  Gene Name: par-3 family cell polarity regulator
  Uniprot ID: Q8TEW0
  ENST ID: ENST00000374794
  CDS Start-End: 327-4061
gcggccccgagcgagcgccagcgccacacagccccgggcagccgccggcgagcgcgccgcgacgccgaacaggtggccggaggctgcgggcgccgcggcggggagaggcgaggcaagccccgggcgaagcgaggcgaggcgagggcggccgggccgggcatgcgagctgagcggccccccggcgtcgccgccgcctgcccgcgcccctagccgcccgcgcgcccgagtccccagcggctcctccgcgcccagcgtcctcggtcccggcctcggctgctccggctgcgctcggcgaggggcgcgggcccgcccgcggcggcggcggcatgaaagtgaccgtgtgcttcggacggacccgggtggtcgtgccgtgcggggacggccacatgaaagttttcagcctcatccagcaggcggtgacccgctaccggaaggccatcgccaaggatccaaactactggatacaggtgcatcgcttggaacatggagatggaggaatactagaccttgatgacattctttgtgatgtagcagacgataaagacagactggtagcagtgtttgatgagcaggatccacatcacggaggtgatggcaccagtgccagttccacgggtacccagagcccagagatatttggtagtgagcttggcaccaacaatgtctcagcctttcagccttaccaagcaacaagtgaaattgaggtcacaccttcagtccttcgagcaaatatgcctcttcatgttcgacgcagtagtgacccagctctaattggcctctccacttctgtcagtgatagtaatttttcctctgaagagccttcaaggaaaaatcccacacgctggtcaacaacagctggcttcctcaagcagaacactgctgggagtcctaaaacctgcgacaggaaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccacgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagagtatgtcagaaaaacgcacaaagcaattttcagatgccagtcaattggatttcgttaaaacacgaaaatcaaaaagcatggatttaggtagttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcaggattcaagccaaaactcgagaatttagggaacgacaagctcgagagcgtgactatgctgaaattcaagattttcatcggacatttggctgtgatgatgagttaatgtatgggggagtttcttcttatgaaggttccatggctctcaacgctagacctcagagcccacgagaagggcatatgatggatgctttgtatgcccaagtcaagaagccgcggaattccaaaccctcacctgtagacagtaacagatcaactcctagcaatcatgatcggatacagcgtctgaggcaagaatttcagcaagcaaagcaagatgaagatgtagaagatcgtcggcggacctatagttttgagcaaccctggccgaacgcacggccggcgacgcagagcgggcgacactcggtgtccgtggaggtgcagatgcagcggcagcggcaggaggagcgcgagagctcccagcaggcccagcgccagtacagctctctgcctcggcaaagcaggaaaaatgccagctcggtctcccaggactcttgggagcagaactactcccctggggaaggcttccagagtgccaaagagaaccccaggtactccagctaccaaggctccaggaacggctacctgggaggacatggcttcaacgccagggtcatgctggaaactcaggagctccttcgccaggaacagaggcggaaggagcagcagatgaagaagcagcctccttccgaggggcccagcaactatgactcgtataagaaagtccaggaccccagttacgcccctcccaaggggcccttccggcaagatgtgcccccctccccttctcaggttgcgaggctgaacagacttcagactcctgagaaagggaggcccttctattcctgagcacgcaaataacggatgcttcatgtcgcgcaataaaagacattttcctatgaagacttgtattttgggagtttttttaaaacctcgatggtactatggagtatttctgttgttggtatcagtgcctttaagcggtgtaggcaaagaaatggaaggccttaatgtctttgccactatgtctcaagtgtctgtttcatggaaggatttcccaccctgtgacaatcatctgtttgaggtgttcatatgctctgcgcctctccacagtaccaggaatctcggccctactcatgagttgtccgcggcttggttgtaacatccctgcaccacttgcagtgacaaattcacctgaagtggaggatgacgtgcggccctgtttctccctctaagttctcttagctatgggatgacatcttagtctctggtggaggaaaagtgggcgacatacaccaaaaattggggctttctggtacttcacagcacagccatttgtcgtactttgtcatcactgtggttttctctttcctttctcagctctttgtgacgggagagtcggtcatcctattacagaagctaagccatagtccaacattgtttggtcaccatgggggtccttttgtaactgccttatgactcaacattaccaataaagtgatgatcctggtctgcgtttatacatacgcttgttcggtcctgttcctgacacgtgggttgagtcaccacagctctgtgtggggaacgtgggagacaggagtggctcctgccgggggaagctgggcctgccattggccctgtgtctatcatgaggggagagctaagaaagaaattctcctaggaagagctcatggcccagtacatcctagtaattattttaattagtttttgttctgacagcttgtcaggaagggcacagaatgggacagagataaaccagacagtcattttgatctgctctctacggtttttcaagtcagaggcaattgatgcttgtctaatgcatccacacactgcatgtctgactggcgatgccgcgctcctaagtagttctgccatgaaacataaaagacaaaggaaaagccgttacacatcacacagagaacattttcgggtcccacagcggtggtggcaggaagctcactctcgcgtcagtattagagtgtgtgtgtgggtctcggggatctcggtggctcccatcttccttcattgttctgaacatcctgtattgtaaaccatggctggggtgctaaagtgcctgtgaatcccgatgtggaaaaagctggaggtgaaagctcagcataccatgtatttactttaaaaacagaaaaaaagacatgtatggatatgtctattttttttttattggcacattgtatttttgtgttgacttgtttttagaaatgatgtgtccacacacgtacccgtgtctcttctgcatttctgtgtcatggttctgtttcttaatcacgtgcggcggtgtctaagtggtgttaccagtgtacgcgcagtgaccttggatgacagtggctctttctcacagcctcccctgagctgtgagaaacagctttctctgtacatatgcaactcctaataaaaggcatatttcttcctgtt

SEQ ID NO: 163644 - DNA, 5740 bp, Homo sapiens
  Payload ID: 12225
  Gene Symbol: PARD3
  Gene Name: par-3 family cell polarity regulator
  Uniprot ID: Q8TEW0
  ENST ID: ENST00000545260
  CDS Start-End: 331-4131
cccagcggccccgagcgagcgccagcgccacacagccccgggcagccgccggcgagcgcgccgcgacgccgaacaggtggccggaggctgcgggcgccgcggcggggagaggcgaggcaagccccgggcgaagcgaggcgaggcgagggcggccgggccgggcatgcgagctgagcggccccccggcgtcgccgccgcctgcccgcgcccctagccgcccgcgcgcccgagtccccagcggctcctccgcgcccagcgtcctcggtcccggcctcggctgctccggctgcgctcggcgaggggcgcgggcccgcccgcggcggcggcggcatgaaagtgaccgtgtgcttcggacggacccgggtggtcgtgccgtgcggggacggccacatgaaagttttcagcctcatccagcaggcggtgacccgctaccggaaggccatcgccaaggatccaaactactggatacaggtgcatcgcttggaacatggagatggaggaatactagaccttgatgacattctttgtgatgtagcagacgataaagacagactggtagcagtgtttgatgagcaggatccacatcacggaggtgatggcaccagtgccagttccacgggtacccagagcccagagatatttggtagtgagcttggcaccaacaatgtctcagcctttcagccttaccaagcaacaagtgaaattgaggtcacaccttcagtccttcgagcaaatatgcctcttcatgttcgacgcagtagtgacccagctctaattggcctctccacttctgtcagtgatagtaatttttcctctgaagagccttcaaggaaaaatcccacacgctggtcaacaacagctggcttcctcaagcagaacactgctgggagtcctaaaacctgcgacaggaaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccacgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagatagctgacgagactaaactcaatacagtggatgaccagaaagcaggttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcaggtttggcaaacatcgaaaagatgacaagattgagaaaacgggtaaaataaaaatacaggaatcctttacatcagaagaggagaggatacgaatgaagcaggagcaggagaggattcaagccaaaactcgagaatttagggaacgacaagctcgagagcgtgactatgctgaaattcaagattttcatcggacatttggctgtgatgatgagttaatgtatgggggagtttcttcttatgaaggttccatggctctcaacgctagacctcagagcccacgagaagggcatatgatggatgctttgtatgcccaagtcaagaagccgcggaattccaaaccctcacctgtagacagtaacagatcaactcctagcaatcatgatcggatacagcgtctgaggcaagaatttcagcaagcaaagcaagatgaagatgtagaagatcgtcggcggacctatagttttgagcaaccctggccgaacgcacggccggcgacgcagagcgggcgacactcggtgtccgtggaggtgcagatgcagcggcagcggcaggaggagcgcgagagctcccagcaggcccagcgccagtacagctctctgcctcggcaaagcaggaaaaatgccagctcggtctcccaggactcttgggagcagaactactcccctggggaaggcttccagagtgccaaagagaaccccaggtactccagctaccaaggctccaggaacggctacctgggaggacatggcttcaacgccagggtcatgctggaaactcaggagctccttcgccaggaacagaggcggaaggagcagcagatgaagaagcagcctccttccgaggggcccagcaactatgactcgtataagaaagtccaggaccccagttacgcccctcccaaggggcccttccggcaagatgtgcccccctccccttctcaggttgcgaggctgaacagacttcagactcctgagaaagggaggcccttctattcctgagcacgcaaataacggatgcttcatgtcgcgcaataaaagacattttcctatgaagacttgtattttgggagtttttttaaaacctcgatggtactatggagtatttctgttgttggtatcagtgcctttaagcggtgtaggcaaagaaatggaaggccttaatgtctttgccactatgtctcaagtgtctgtttcatggaaggatttcccaccctgtgacaatcatctgtttgaggtgttcatatgctctgcgcctctccacagtaccaggaatctcggccctactcatgagttgtccgcggcttggttgtaacatccctgcaccacttgcagtgacaaattcacctgaagtggaggatgacgtgcggccctgtttctccctctaagttctcttagctatgggatgacatcttagtctctggtggaggaaaagtgggcgacatacaccaaaaattggggctttctggtacttcacagcacagccatttgtcgtactttgtcatcactgtggttttctctttcctttctcagctctttgtgacgggagagtcggtcatcctattacagaagctaagccatagtccaacattgtttggtcaccatgggggtccttttgtaactgccttatgactcaacattaccaataaagtgatgatcctggtctgcgtttatacatacgcttgttcggtcctgttcctgacacgtgggttgagtcaccacagctctgtgtggggaacgtgggagacaggagtggctcctgccgggggaagctgggcctgccattggccctgtgtctatcatgaggggagagctaagaaagaaattctcctaggaagagctcatggcccagtacatcctagtaattattttaattagtttttgttctgacagcttgtcaggaagggcacagaatgggacagagataaaccagacagtcattttgatctgctctctacggtttttcaagtcagaggcaattgatgcttgtctaatgcatccacacactgcatgtctgactggcgatgccgcgctcctaagtagttctgccatgaaacataaaagacaaaggaaaagccgttacacatcacacagagaacattttcgggtcccacagcggtggtggcaggaagctcactctcgcgtcagtattagagtgtgtgtgtgggtctcggggatctcggtggctcccatcttccttcattgttctgaacatcctgtattgtaaaccatggctggggtgctaaagtgcctgtgaatcccgatgtggaaaaagctggaggtgaaagctcagcataccatgtatttactttaaaaacagaaaaaaagacatgtatggatatgtctattttttttttattggcacattgtatttttgtgttgacttgtttttagaaatgatgtgtccacacacgtacccgtgtctcttctgcatttctgtgtcatggttctgtttcttaatcacgtgcggcggtgtctaagtggtgttaccagtgtacgcgcagtgaccttggatgacagtggctctttctcacagcctcccctgagctgtgagaaacagctttctctgtacatatgcaactcctaataaaaggcatatttcttcctgttc

SEQ ID NO: 163645 - DNA, 5962 bp, Homo sapiens
  Payload ID: 12225
  Gene Symbol: PARD3
  Gene Name: par-3 family cell polarity regulator
  Uniprot ID: Q8TEW0
  ENST ID: ENST00000545693
  CDS Start-End: 331-4353
cccagcggccccgagcgagcgccagcgccacacagccccgggcagccgccggcgagcgcgccgcgacgccgaacaggtggccggaggctgcgggcgccgcggcggggagaggcgaggcaagccccgggcgaagcgaggcgaggcgagggcggccgggccgggcatgcgagctgagcggccccccggcgtcgccgccgcctgcccgcgcccctagccgcccgcgcgcccgagtccccagcggctcctccgcgcccagcgtcctcggtcccggcctcggctgctccggctgcgctcggcgaggggcgcgggcccgcccgcggcggcggcggcatgaaagtgaccgtgtgcttcggacggacccgggtggtcgtgccgtgcggggacggccacatgaaagttttcagcctcatccagcaggcggtgacccgctaccggaaggccatcgccaaggatccaaactactggatacaggtgcatcgcttggaacatggagatggaggaatactagaccttgatgacattctttgtgatgtagcagacgataaagacagactggtagcagtgtttgatgagcaggatccacatcacggaggtgatggcaccagtgccagttccacgggtacccagagcccagagatatttggtagtgagcttggcaccaacaatgtctcagcctttcagccttaccaagcaacaagtgaaattgaggtcacaccttcagtccttcgagcaaatatgcctcttcatgttcgacgcagtagtgacccagctctaattggcctctccacttctgtcagtgatagtaatttttcctctgaagagccttcaaggaaaaatcccacacgctggtcaacaacagctggcttcctcaagcagaacactgctgggagtcctaaaacctgcgacaggaagaaagatgaaaactacagaagcctcccgcgggatactagtaactggtctaaccaatttcagagagacaatgctcgctcgtctctgagtgccagtcacccaatggtgggcaagtggctggagaaacaagaacaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccacgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagagtatgtcagaaaaacgcacaaagcaattttcagatgccagtcaattggatttcgttaaaacacgaaaatcaaaaagcatggatttaggtatagctgacgagactaaactcaatacagtggatgaccagaaagcaggttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcaggtttggcaaacatcgaaaagatgacaagattgagaaaacgggtaaaataaaaatacaggaatcctttacatcagaagaggagaggatacgaatgaagcaggagcaggagaggattcaagccaaaactcgagaatttagggaacgacaagctcgagagcgtgactatgctgaaattcaagattttcatcggacatttggctgtgatgatgagttaatgtatgggggagtttcttcttatgaaggttccatggctctcaacgctagacctcagagcccacgagaagggcatatgatggatgctttgtatgcccaagtcaagaagccgcggaattccaaaccctcacctgtagacagtaacagatcaactcctagcaatcatgatcggatacagcgtctgaggcaagaatttcagcaagcaaagcaagatgaagatgtagaagatcgtcggcggacctatagttttgagcaaccctggccgaacgcacggccggcgacgcagagcgggcgacactcggtgtccgtggaggtgcagatgcagcggcagcggcaggaggagcgcgagagctcccagcaggcccagcgccagtacagctctctgcctcggcaaagcaggaaaaatgccagctcggtctcccaggactcttgggagcagaactactcccctggggaaggcttccagagtgccaaagagaaccccaggtactccagctaccaaggctccaggaacggctacctgggaggacatggcttcaacgccagggtcatgctggaaactcaggagctccttcgccaggaacagaggcggaaggagcagcagatgaagaagcagcctccttccgaggggcccagcaactatgactcgtataagaaagtccaggaccccagttacgcccctcccaaggggcccttccggcaagatgtgcccccctccccttctcaggttgcgaggctgaacagacttcagactcctgagaaagggaggcccttctattcctgagcacgcaaataacggatgcttcatgtcgcgcaataaaagacattttcctatgaagacttgtattttgggagtttttttaaaacctcgatggtactatggagtatttctgttgttggtatcagtgcctttaagcggtgtaggcaaagaaatggaaggccttaatgtctttgccactatgtctcaagtgtctgtttcatggaaggatttcccaccctgtgacaatcatctgtttgaggtgttcatatgctctgcgcctctccacagtaccaggaatctcggccctactcatgagttgtccgcggcttggttgtaacatccctgcaccacttgcagtgacaaattcacctgaagtggaggatgacgtgcggccctgtttctccctctaagttctcttagctatgggatgacatcttagtctctggtggaggaaaagtgggcgacatacaccaaaaattggggctttctggtacttcacagcacagccatttgtcgtactttgtcatcactgtggttttctctttcctttctcagctctttgtgacgggagagtcggtcatcctattacagaagctaagccatagtccaacattgtttggtcaccatgggggtccttttgtaactgccttatgactcaacattaccaataaagtgatgatcctggtctgcgtttatacatacgcttgttcggtcctgttcctgacacgtgggttgagtcaccacagctctgtgtggggaacgtgggagacaggagtggctcctgccgggggaagctgggcctgccattggccctgtgtctatcatgaggggagagctaagaaagaaattctcctaggaagagctcatggcccagtacatcctagtaattattttaattagtttttgttctgacagcttgtcaggaagggcacagaatgggacagagataaaccagacagtcattttgatctgctctctacggtttttcaagtcagaggcaattgatgcttgtctaatgcatccacacactgcatgtctgactggcgatgccgcgctcctaagtagttctgccatgaaacataaaagacaaaggaaaagccgttacacatcacacagagaacattttcgggtcccacagcggtggtggcaggaagctcactctcgcgtcagtattagagtgtgtgtgtgggtctcggggatctcggtggctcccatcttccttcattgttctgaacatcctgtattgtaaaccatggctggggtgctaaagtgcctgtgaatcccgatgtggaaaaagctggaggtgaaagctcagcataccatgtatttactttaaaaacagaaaaaaagacatgtatggatatgtctattttttttttattggcacattgtatttttgtgttgacttgtttttagaaatgatgtgtccacacacgtacccgtgtctcttctgcatttctgtgtcatggttctgtttcttaatcacgtgcggcggtgtctaagtggtgttaccagtgtacgcgcagtgaccttggatgacagtggctctttctcacagcctcccctgagctgtgagaaacagctttctctgtacatatgcaactcctaataaaaggcatatttcttcctgttc

SEQ ID NO: 163646 - DNA, 2475 bp, Homo sapiens
  Payload ID: 12225
  Gene Symbol: PARD3
  Gene Name: par-3 family cell polarity regulator
  ENST ID: ENST00000544292
  CDS Start-End: 144-2387
cttttaactgtaacttattgaaggtctcctacatttttaacactgaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccacgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagagtatgtcagaaaaacgcacaaagcaattttcagatgccagtcaattggatttcgttaaaacacgaaaatcaaaaagcatggatttagtagctgacgagactaaactcaatacagtggatgaccagaaagcaggttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcagccttgccaaactgaagcccgagaagagatgaacaacaaagcgattcaaaacatgtcttgaacagcacatattgcacagttgttgttttttttaaacaaacaataaatttacttttaatg

SEQ ID NO: 163647 - DNA, 3411 bp, Homo sapiens
  Payload ID: 12226
  Gene Symbol: PARD3B
  Gene Name: par-3 family cell polarity regulator beta
  Uniprot ID: Q8TEW8
  ENST ID: ENST00000351153
  CDS Start-End: 1-3411
atgaaagtgaccgtgtgcttcggcaggacgggcatcgtggtgccctgcaaggagggccagctgcgcgtcggcgagctcacccagcaggcgctgcagcggtacctgaagacccgggagaagggtcctggttactgggtgaagattcatcacttagaatatacagatggaggaatcctggatccagatgatgtcttggcagatgttgttgaagataaagacaagctgattgctgtgtttgaagaacaagaaccactccacaagattgagagccccagtggaaaccctgcagatcggcagagcccagatgcttttgagacagaagtggccgcccaactggccgcatttaagccaattggtggggagattgaagtaaccccttctgctctaaaactaggcactccactgctggtgaggagaagcagtgacccagtgccaggcccacctgctgatacccagccaagcgcttcacaccctggtggccagagtctgaaactggttgttccagattccacgcagaacttggaagacagagaagttttgaatggtgtacagacagaactactaacttcgccaagaactaaggacacattgagtgatatgacaagaacagtggagatttctggggaaggaggcccattgggaatacatgtagtgcccttcttttcatctctgagtggaaggattctaggactcttcatccgaggcattgaagacaacagcaggtccaagcgggagggactatttcacgaaaatgaatgtattgtaaaaatcaacaatgtggatctcgtagacaaaacctttgctcaggctcaagatgtcttccgccaggcaatgaaatctccaagtgtgctcctccacgtgcttcctccacaaaaccgtgaacagtatgaaaagtcagtcattggctctcttaacatttttggtaataatgatggcgttttgaaaaccaaagtgccgcctcctgtccatggaaaatcgggactaaagacagcaaatctcacaggaaccgatagtcctgaaacagatgcatcagcttccctgcaacaaaacaagagtccccgagtaccaaggctgggaggaaaaccatcctctccctcactctcgcctctcatgggatttggcagcaataaaaatgcaaagaaaattaagattgacctaaagaaaggccctgaaggacttggtttcactgtggttaccagagactcttccatacatggtcccggtcccatttttgtaaaaaacattttaccaaagggagcagcaataaaagatggccgcctacaatcaggggacagaattttggaggtaaatgggagagatgtcaccggacgaacccaggaagagcttgtggccatgctcaggagcaccaagcagggggagacagcatcgctggtcattgcccgccaagaaggacattttctgccccgagagttgaaaggagaacctgactgctgtgcactctctctggagacaagcgagcagctcacctttgagatccccctgaatgattcaggttctgctggcctcggggtgagcttaaaagggaacaaatccagagaaactggaacagacttggggatttttatcaaatccatcattcatggaggcgctgcttttaaggatggtcgtctgcgaatgaatgaccagctgattgcagttaatggggaatctcttttgggaaagtccaaccacgaagctatggaaacacttaggcggtcaatgtccatggagggaaacatccgagggatgatccagttggtgattctgaggaggccagagagaccaatggaggatcctgcagagtgtggggcattttccaagccatgctttgagaactgtcaaaatgctgtaaccacctctaggcgaaatgataatagtatcctgcatccacttggcacttgcagtccacaagacaaacagaaaggtctattgctgcccaatgacggatgggccgagagtgaagttccaccttctccaacaccacattctgctctgggattgggcctcgaagattacagccacagctctggggtggattcagcagtatattttccagatcagcacatcaacttcagatctgtgacaccggccaggcagcctgaatcaattaatttgaaagcctcgaagagcatggaccttgtgccagatgaaagcaaggttcactcattggctggacaaaaatcggacggtctgtctgataagagctctcactctggccaaggagctctgaattgtgagtctgcccctcaggggaattcggagctagaggacatggaaaataaagccaggaaagtcaaaaaaacgaaagagaaggagaagaaaaaggaaaagggcaaattgaaagtcaaggagaaaaagcgcaaagaggagaatgaagatccagaaaggaaaataaagaagaagggcttcggcgccatgctgagatttggaaagaagaaagaggataagggtggaaaggctgagcagaaaggtactctgaaacatggtggcctgagagaagaagagctggagaaaatgaaagaagagcgtgaaaggattggagcaaaacatcaggagctaagggaaaagcaggcaagaggtcttcttgattatgctactggtgcaattggatcagtgtatgatatggatgatgatgaaatggaccccaattatgccagagtgaaccactttcgggaaccatgcacatcagcaaatgtctttagatctccatctccccctcgagctggaccatttggttaccctcgggatggccatccactgtctccagaaagagaccacttagagggtctctatgccaaggtcaacaagccataccatccactggttccagctgacagtggccgtcctacgggtggaagcactgaccgtatccagaagttgcggaaagagtattatcaggctcggagggaaggtttccctttatatgaagacgacgaaggaagagcaaggccatctgagtatgacctactctgggtgcctggaaggggtccagatgggaatgcacacaacctccgctttgaagggatggagaggcagtacgcatccttacccaggggaggacccgcagatcctgtagactatctgccagcagcacctcgggggctctacaaggaaagggagcttccctattatccaggggctcatcctatgcaccctcccaaagggagctatccccgccccacagagctcagggtggcagatctccggtatcctcagcactacccacccccgccagctccccagcacaaaggaccctttcgacaagacgttccgccttcccctccccagcaccaaagaatgccagcctatcaggaaacaggcagaccagggccccgtgggggcagcccagaccagtacccttaccgaacccaggattcccggcagaagaaccccatgactgcagccgtatag

SEQ ID NO: 163648 - DNA, 3315 bp, Homo sapiens
  Payload ID: 12226
  Gene Symbol: PARD3B
  Gene Name: par-3 family cell polarity regulator beta
  Uniprot ID: Q8TEW8
  ENST ID: ENST00000349953
  CDS Start-End: 1-3315
atgaaagtgaccgtgtgcttcggcaggacgggcatcgtggtgccctgcaaggagggccagctgcgcgtcggcgagctcacccagcaggcgctgcagcggtacctgaagacccgggagaagggtcctggttactgggtgaagattcatcacttagaatatacagatggaggaatcctggatccagatgatgtcttggcagatgttgttgaagataaagacaagctgattgctgtgtttgaagaacaagaaccactccacaagattgagagccccagtggaaaccctgcagatcggcagagcccagatgcttttgagacagaagtggccgcccaactggccgcatttaagccaattggtggggagattgaagtaaccccttctgctctaaaactaggcactccactgctggtgaggagaagcagtgacccagtgccaggcccacctgctgatacccagccaagcgcttcacaccctggtggccagagtctgaaactggttgttccagattccacgcagaacttggaagacagagaagttttgaatggtgtacagacagaactactaacttcgccaagaactaaggacacattgagtgatatgacaagaacagtggagatttctggggaaggaggcccattgggaatacatgtagtgcccttcttttcatctctgagtggaaggattctaggactcttcatccgaggcattgaagacaacagcaggtccaagcgggagggactatttcacgaaaatgaatgtattgtaaaaatcaacaatgtggatctcgtagacaaaacctttgctcaggctcaagatgtcttccgccaggcaatgaaatctccaagtgtgctcctccacgtgcttcctccacaaaaccgtgaacagtatgaaaagtcagtcattggctctcttaacatttttggtaataatgatggcgttttgaaaaccaaagtgccgcctcctgtccatggaaaatcgggactaaagacagcaaatctcacaggaaccgatagtcctgaaacagatgcatcagcttccctgcaacaaaacaagagtccccgagtaccaaggctgggaggaaaaccatcctctccctcactctcgcctctcatgggatttggcagcaataaaaatgcaaagaaaattaagattgacctaaagaaaggccctgaaggacttggtttcactgtggttaccagagactcttccatacatggtcccggtcccatttttgtaaaaaacattttaccaaagggagcagcaataaaagatggccgcctacaatcaggggacagaattttggaggtaaatgggagagatgtcaccggacgaacccaggaagagcttgtggccatgctcaggagcaccaagcagggggagacagcatcgctggtcattgcccgccaagaaggacattttctgccccgagagttgaaaggagaacctgactgctgtgcactctctctggagacaagcgagcagctcacctttgagatccccctgaatgattcaggttctgctggcctcggggtgagcttaaaagggaacaaatccagagaaactggaacagacttggggatttttatcaaatccatcattcatggaggcgctgcttttaaggatggtcgtctgcgaatgaatgaccagctgattgcagttaatggggaatctcttttgggaaagtccaaccacgaagctatggaaacacttaggcggtcaatgtccatggagggaaacatccgagggatgatccagttggtgattctgaggaggccagagagaccaatggaggatcctgcagagtgtggggcattttccaagccatgctttgagaactgtcaaaatgctgtaaccacctctaggcgaaatgataatagtatcctgcatccacttggcacttgcagtccacaagacaaacagaaaggtctattgctgcccaatgacggatgggccgagagtgaagttccaccttctccaacaccacattctgctctgggattgggcctcgaagattacagccacagctctggggtggattcagcagtatattttccagatcagcacatcaacttcagatctgtgacaccggccaggcagcctgaatcaattaatttgaaagcctcgaagagcatggaccttgtgccagatgaaagcaaggttcactcattggctggacaaaaatcggaatctccaagcaaagattttggtccaactctgggtttgaaaaagtccagctccttggagagtctgcagactgcagtggccgaggtcaggaagaatgaccttccctttcacaggccccggccgcacatggttcgaggccgaggctgcaatgagagctttagagcagccattgacaaatcctacgatggacctgaagaaatagaagctgacggtctgtctgataagagctctcactctggccaaggagctctgaattgtgagtctgcccctcaggggaattcggagctagaggacatggaaaataaagccaggaaagtcaaaaaaacgaaagagaaggagaagaaaaaggaaaagggcaaattgaaagtcaaggagaaaaagcgcaaagaggagaatgaagatccagaaaggaaaataaagaagaagggcttcggcgccatgctgagatttggaaagaagaaagaggataagggtggaaaggctgagcagaaaggtactctgaaacatggtggcctgagagaagaagagctggagaaaatgaaagaagagcgtgaaagtggccgtcctacgggtggaagcactgaccgtatccagaagttgcggaaagagtattatcaggctcggagggaaggtttccctttatatgaagacgacgaaggaagagcaaggccatctgagtatgacctactctgggtgcctggaaggggtccagatgggaatgcacacaacctccgctttgaagggatggagaggcagtacgcatccttacccaggggaggacccgcagatcctgtagactatctgccagcagcacctcgggggctctacaaggaaagggagcttccctattatccaggggctcatcctatgcaccctcccaaagggagctatccccgccccacagagctcagggtggcagatctccggtatcctcagcactacccacccccgccagctccccagcacaaaggaccctttcgacaagacgttccgccttcccctccccagcaccaaagaatgccagcctatcaggaaacaggcagaccagggccccgtgggggcagcccagaccagtacccttaccgaacccaggattcccggcagaagaaccccatgactgcagccgtatag

SEQ ID NO: 163649 - DNA, 3432 bp, Homo sapiens
  Payload ID: 12226
  Gene Symbol: PARD3B
  Gene Name: par-3 family cell polarity regulator beta
  Uniprot ID: Q8TEW8
  ENST ID: ENST00000358768
  CDS Start-End: 1-3432
atgaaagtgaccgtgtgcttcggcaggacgggcatcgtggtgccctgcaaggagggccagctgcgcgtcggcgagctcacccagcaggcgctgcagcggtacctgaagacccgggagaagggtcctggttactgggtgaagattcatcacttagaatatacagatggaggaatcctggatccagatgatgtcttggcagatgttgttgaagataaagacaagctgattgctgtgtttgaagaacaagaaccactccacaagattgagagccccagtggaaaccctgcagatcggcagagcccagatgcttttgagacagaagtggccgcccaactggccgcatttaagccaattggtggggagattgaagtaaccccttctgctctaaaactaggcactccactgctggtgaggagaagcagtgacccagtgccaggcccacctgctgatacccagccaagcgcttcacaccctggtggccagagtctgaaactggttgttccagattccacgcagaacttggaagacagagaagttttgaatggtgtacagacagaactactaacttcgccaagaactaaggacacattgagtgatatgacaagaacagtggagatttctggggaaggaggcccattgggaatacatgtagtgcccttcttttcatctctgagtggaaggattctaggactcttcatccgaggcattgaagacaacagcaggtccaagcgggagggactatttcacgaaaatgaatgtattgtaaaaatcaacaatgtggatctcgtagacaaaacctttgctcaggctcaagatgtcttccgccaggcaatgaaatctccaagtgtgctcctccacgtgcttcctccacaaaaccgtgaacagtatgaaaagtcagtcattggctctcttaacatttttggtaataatgatggcgttttgaaaaccaaagtgccgcctcctgtccatggaaaatcgggactaaagacagcaaatctcacaggaaccgatagtcctgaaacagatgcatcagcttccctgcaacaaaacaagagtccccgagtaccaaggctgggaggaaaaccatcctctccctcactctcgcctctcatgggatttggcagcaataaaaatgcaaagaaaattaagattgacctaaagaaaggccctgaaggacttggtttcactgtggttaccagagactcttccatacatggtcccggtcccatttttgtaaaaaacattttaccaaagggagcagcaataaaagatggccgcctacaatcaggggacagaattttggaggtaaatgggagagatgtcaccggacgaacccaggaagagcttgtggccatgctcaggagcaccaagcagggggagacagcatcgctggtcattgcccgccaagaaggacattttctgccccgagagttggatggtcgtctgcgaatgaatgaccagctgattgcagttaatggggaatctcttttgggaaagtccaaccacgaagctatggaaacacttaggcggtcaatgtccatggagggaaacatccgagggatgatccagttggtgattctgaggaggccagagagaccaatggaggatcctgcagagtgtggggcattttccaagccatgctttgagaactgtcaaaatgctgtaaccacctctaggcgaaatgataatagtatcctgcatccacttggcacttgcagtccacaagacaaacagaaaggtctattgctgcccaatgacggatgggccgagagtgaagttccaccttctccaacaccacattctgctctgggattgggcctcgaagattacagccacagctctggggtggattcagcagtatattttccagatcagcacatcaacttcagatctgtgacaccggccaggcagcctgaatcaattaatttgaaagcctcgaagagcatggaccttgtgccagatgaaagcaaggttcactcattggctggacaaaaatcggaatctccaagcaaagattttggtccaactctgggtttgaaaaagtccagctccttggagagtctgcagactgcagtggccgaggtcaggaagaatgaccttccctttcacaggccccggccgcacatggttcgaggccgaggctgcaatgagagctttagagcagccattgacaaatcctacgatggacctgaagaaatagaagctgacggtctgtctgataagagctctcactctggccaaggagctctgaattgtgagtctgcccctcaggggaattcggagctagaggacatggaaaataaagccaggaaagtcaaaaaaacgaaagagaaggagaagaaaaaggaaaagggcaaattgaaagtcaaggagaaaaagcgcaaagaggagaatgaagatccagaaaggaaaataaagaagaagggcttcggcgccatgctgagatttggaaagaagaaagaggataagggtggaaaggctgagcagaaaggtactctgaaacatggtggcctgagagaagaagagctggagaaaatgaaagaagagcgtgaaaggattggagcaaaacatcaggagctaagggaaaagcaggcaagaggtcttcttgattatgctactggtgcaattggatcagtgtatgatatggatgatgatgaaatggaccccaattatgccagagtgaaccactttcgggaaccatgcacatcagcaaatgtctttagatctccatctccccctcgagctggaccatttggttaccctcgggatggccatccactgtctccagaaagagaccacttagagggtctctatgccaaggtcaacaagccataccatccactggttccagctgacagtggccgtcctacgggtggaagcactgaccgtatccagaagttgcggaaagagtattatcaggctcggagggaaggtttccctttatatgaagacgacgaaggaagagcaaggccatctgagtatgacctactctgggtgcctggaaggggtccagatgggaatgcacacaacctccgctttgaagggatggagaggcagtacgcatccttacccaggggaggacccgcagatcctgtagactatctgccagcagcacctcgggggctctacaaggaaagggagcttccctattatccaggggctcatcctatgcaccctcccaaagggagctatccccgccccacagagctcagggtggcagatctccggtatcctcagcactacccacccccgccagctccccagcacaaaggaccctttcgacaagacgttccgccttcccctccccagcaccaaagaatgccagcctatcaggaaacaggcagaccagggccccgtgggggcagcccagaccagtacccttaccgaacccaggattcccggcagaagaaccccatgactgcagccgtatag

SEQ ID NO: 163650 - DNA, 8174 bp, Homo sapiens
  Payload ID: 12226
  Gene Symbol: PARD3B
  Gene Name: par-3 family cell polarity regulator beta
  Uniprot ID: Q8TEW8
  ENST ID: ENST00000406610
  CDS Start-End: 208-3825
gcggccgcccctccccgattcccgccacctgccgcctggccaggtggaaggggcgctgccgcgagcctccgggcctcagggtgttccggggagcggcgccccgggtctctgggcccacccgccccgggcgtcctccgagagtgggggctgcgcccgcggggtcagacacctgttcggcccggcccggcgtggtcgccgggggccaggatgaaagtgaccgtgtgcttcggcaggacgggcatcgtggtgccctgcaaggagggccagctgcgcgtcggcgagctcacccagcaggcgctgcagcggtacctgaagacccgggagaagggtcctggttactgggtgaagattcatcacttagaatatacagatggaggaatcctggatccagatgatgtcttggcagatgttgttgaagataaagacaagctgattgctgtgtttgaagaacaagaaccactccacaagattgagagccccagtggaaaccctgcagatcggcagagcccagatgcttttgagacagaagtggccgcccaactggccgcatttaagccaattggtggggagattgaagtaaccccttctgctctaaaactaggcactccactgctggtgaggagaagcagtgacccagtgccaggcccacctgctgatacccagccaagcgcttcacaccctggtggccagagtctgaaactggttgttccagattccacgcagaacttggaagacagagaagttttgaatggtgtacagacagaactactaacttcgccaagaactaaggacacattgagtgatatgacaagaacagtggagatttctggggaaggaggcccattgggaatacatgtagtgcccttcttttcatctctgagtggaaggattctaggactcttcatccgaggcattgaagacaacagcaggtccaagcgggagggactatttcacgaaaatgaatgtattgtaaaaatcaacaatgtggatctcgtagacaaaacctttgctcaggctcaagatgtcttccgccaggcaatgaaatctccaagtgtgctcctccacgtgcttcctccacaaaaccgtgaacagtatgaaaagtcagtcattggctctcttaacatttttggtaataatgatggcgttttgaaaaccaaagtgccgcctcctgtccatggaaaatcgggactaaagacagcaaatctcacaggaaccgatagtcctgaaacagatgcatcagcttccctgcaacaaaacaagagtccccgagtaccaaggctgggaggaaaaccatcctctccctcactctcgcctctcatgggatttggcagcaataaaaatgcaaagaaaattaagattgacctaaagaaaggccctgaaggacttggtttcactgtggttaccagagactcttccatacatggtcccggtcccatttttgtaaaaaacattttaccaaagggagcagcaataaaagatggccgcctacaatcaggggacagaattttggaggtaaatgggagagatgtcaccggacgaacccaggaagagcttgtggccatgctcaggagcaccaagcagggggagacagcatcgctggtcattgcccgccaagaaggacattttctgccccgagagttgaaaggagaacctgactgctgtgcactctctctggagacaagcgagcagctcacctttgagatccccctgaatgattcaggttctgctggcctcggggtgagcttaaaagggaacaaatccagagaaactggaacagacttggggatttttatcaaatccatcattcatggaggcgctgcttttaaggatggtcgtctgcgaatgaatgaccagctgattgcagttaatggggaatctcttttgggaaagtccaaccacgaagctatggaaacacttaggcggtcaatgtccatggagggaaacatccgagggatgatccagttggtgattctgaggaggccagagagaccaatggaggatcctgcagagtgtggggcattttccaagccatgctttgagaactgtcaaaatgctgtaaccacctctaggcgaaatgataatagtatcctgcatccacttggcacttgcagtccacaagacaaacagaaaggtctattgctgcccaatgacggatgggccgagagtgaagttccaccttctccaacaccacattctgctctgggattgggcctcgaagattacagccacagctctggggtggattcagcagtatattttccagatcagcacatcaacttcagatctgtgacaccggccaggcagcctgaatcaattaatttgaaagcctcgaagagcatggaccttgtgccagatgaaagcaaggttcactcattggctggacaaaaatcggaatctccaagcaaagattttggtccaactctgggtttgaaaaagtccagctccttggagagtctgcagactgcagtggccgaggtcaggaagaatgaccttccctttcacaggccccggccgcacatggttcgaggccgaggctgcaatgagagctttagagcagccattgacaaatcctacgatggacctgaagaaatagaagctgacggtctgtctgataagagctctcactctggccaaggagctctgaattgtgagtctgcccctcaggggaattcggagctagaggacatggaaaataaagccaggaaagtcaaaaaaacgaaagagaaggagaagaaaaaggaaaagggcaaattgaaagtcaaggagaaaaagcgcaaagaggagaatgaagatccagaaaggaaaataaagaagaagggcttcggcgccatgctgagatttggaaagaagaaagaggataagggtggaaaggctgagcagaaaggtactctgaaacatggtggcctgagagaagaagagctggagaaaatgaaagaagagcgtgaaaggattggagcaaaacatcaggagctaagggaaaagcaggcaagaggtcttcttgattatgctactggtgcaattggatcagtgtatgatatggatgatgatgaaatggaccccaattatgccagagtgaaccactttcgggaaccatgcacatcagcaaatgtctttagatctccatctccccctcgagctggaccatttggttaccctcgggatggccatccactgtctccagaaagagaccacttagagggtctctatgccaaggtcaacaagccataccatccactggttccagctgacagtggccgtcctacgggtggaagcactgaccgtatccagaagttgcggaaagagtattatcaggctcggagggaaggtttccctttatatgaagacgacgaaggaagagcaaggccatctgagtatgacctactctgggtgcctggaaggggtccagatgggaatgcacacaacctccgctttgaagggatggagaggcagtacgcatccttacccaggggaggacccgcagatcctgtagactatctgccagcagcacctcgggggctctacaaggaaagggagcttccctattatccaggggctcatcctatgcaccctcccaaagggagctatccccgccccacagagctcagggtggcagatctccggtatcctcagcactacccacccccgccagctccccagcacaaaggaccctttcgacaagacgttccgccttcccctccccagcaccaaagaatgccagcctatcaggaaacaggcagaccagggccccgtgggggcagcccagaccagtacccttaccgaacccaggattcccggcagaagaaccccatgactgcagccgtatagctgagtgccaccgaggccagcccggtccagaaaggaaggtgtctactctacctttgccctttctaaacctgaagacctccttggtgttaggaattctccatgttactgataagctttttctcactgacattgtaacgcatgactgctaatcagagagaaaaagaaggggaagggaattggggaggaaaaaaaatcagaaggaagacgaaagatggggctataaaaacaaaactacctgatagttgaaacgctttcagagttgttcaaatcagtgagagtggcaacggaacacacaaacaactaattatggaactctactctggggatcctctctggctagataacctgtgctgatgtgcagacacgtggacatccccctctgagactggcggtccagaggcagtctctgccaggcagcattacccgctccgaggtggagcctcagcccccttcttagagctgttaagtctaaggtgtggcagagcagacagagatagaggcatctgaagtgagtataggttttttgactaagaaaaaaaacaacagcaaacatgactagtgatcttgaaatattttgtaccgagagaaagactgcatttatttgtagaatttatcaggtttctgataccactcattggatgtaaacatttcatgtttcctcacttttgatatgaaagtcggtaaaatgcagtattagtcccgggaggatgtgcacagctggtcagagcttccagaaggaatatcttccgaggactaaggtgatcaggttaagagggttcaacatcccacggccctcaccttcctccctcccacattccaggcatggagatatctggtttcagagtcagccccaaatctcctgcctataattactttaactggggtctctaaggttcccacttgagggctaaaatgtagttgggaaagagggcctactggggaggtctcacaggaggcagtgccctgggaaatgccaagtccagactcagtgccaagcagtaaccatctgcactcggggacagcgaggagctgaccatggcctctgatgaccagcaggtattagatggaagtgaatgagagagagagagagagagagtatgtgtgtgtgtgtgtatgtgtgtgttcgaacacatatgattgccagtatggagaatgaaagattaataatgctttctggagagtttgatgcaaaagtgggggaaacggagaaaaggcgctaaggctaaatccatctgcatttgctatatttcattagctaaagtcaggtcagggcagggccaaggcctccaattggcaaaggacagtgttatggctttaaaaagctgaaaccccaacctctaagtagatcacaatgttttctgagctttgcagtaattttctatggaaactaaaacctctaaaacatacaagctggcccaaatgagaacacaagcaaaagatgtggaagacagcaaaacctgagcactggtttgaaccaggcactgacatttgaaatgctttaagccttttcacattccttctttattccctccaaaaaaaaaagtcttgagtttaatttaggtctattttggctgagattagcatacctctgactcacaggatttaataaattatagtattattgaatacataggacatccctctaccccagcttactcttatctttttaatttaaaatagtattctgctaccaagaaggatgcaactgctagttttagatgtaaatagtgttatttactggactttgtgatattattttcttaactacactttactatggccctgttgaaaacagactatcaagttttttgtctctgttctgtcatctctcttaagccaggcacctttagagtgtttgcaatttgttcgaagtggttgaggatctcaggccctgctcacgtgaggtggagtgcaggggagctaccggtttccctgctgacctgctgaatgctaccttcccctcgagttgaatacaccttaaggaaaatgataacacgagggacgtgtaacttgttttgaagcattaaaaaccagcagctcttcactatgttccatattttaaccaaactactgtagactactaaacatagccaagccagaacattccttctggattaagcctaggccacttgaggggcagccaggggtgatggtgtcaggtgagaatcctgtgtcttgaaggagtggcctttacaggaagagtgcccatgttttcacctgcagcgttgccaccagagtgtgcaatacctcctgcacacaggctcagggtaaactgctccaaagctgggttttgtgttgcatacaaagtcaataaaatagttgctaatcctgaatggcagccagtgatgtgaaggtactattaaagtgaacaaaaactagattgcaacagttttctttccttgcttgaagtataacacacgctccatttgatcctgcctgaaagaagctaacattatatttgtgacagacagaggctccatcaagccaagcaacaattaacagctcaagtgtaagatttataaatgcccgtgtactcacccttcaattgttaccacccagaggttacaggactctttcccagcatttaggggaacaggcttttagagtatttagaagaccaggctataatcagtaatgtgcctgggagcaggaaatagctcccaatttatttatggccttgggaaaactcaatccggtgtctccttgtagctcagaacactaatagcccccctggaagagagtggcacattgagctccaaacccaatcaacatacatccacttggctgcagatctgactgctgggtcatgaaggccgtgaaatgatgtttgccctcaagtcactagatattttaagaagccctatttttctccctttttgcaggagtagagagatgaaagaggacagaccattgaaaacttttagatgcaggagaattgagacttccacaagggagagaaacacagcctccccagaatccattatgccatcgggttgtggcactctcacccttgccataataccgtttcctaacaatatcaaatcagtggatgaaatacaagctcagaaacaggaacattttcctaaatcataacctaatagcaaacaaaaattgaaaaaacaattattctgaagctcattattcttagatctgtagatatatatgtgttgactcccacaggatggcaccaagtaaagatcttaagagcatagtaggggttctgagaccgactgtcacccgtggatcctgatggggaagaacagaggcttcactgtagctatagttttccaccaagtcaatcaaattaaaacatgactcattgtcccctccaaagattcataaaattcttgagctaaagtgatcttctgaagaaaagccacctaacaatgttaggaggctcataaagctcatttctcttttccctggtatgcacaaatatcaagcctataaaaaagtaattatttccccaaacctgtaaccactgcattcgttttctttggaggaacattgtagcatttcaggagggtcgagagatctaaagagtttggtctgaatgtgtgtctgtacaattccctttggcattaaactctgaaacctacaatcaatggccttcaaattggtgttaaattgggagaacaccctactgctttctgagtctacgagcaacagaaagactggtcttagtgcaattaggcaggagggatttggactcagaaacagccacagaagtatttctcagcactcccagttcctgccaacttagctggaaacgatgccacagcgagaccagaaagaggagtcgccttaaggtatccctacaaagtcacctttctgataaaaaggagggaaaaaaaagttagatatctaaaataagcctagaatctcacacacagctgtgacttctaagtgaaactcttttctccctcatgtccttaaatagtcacagaatcacacacagcctgacttttaaagacaagcttggctacaggaaatgaaccaaccccaaagactcttctaacctgtctcctgactgggctccttcagaaagtgttctcctgttccatctgtagggctgcttactactggaacctaaaacaaaacctgttgtttgtaccatcactttttctggtgtttcctgtgcttttgtgattccaagtctgttcataagttctgaagataaattatgtgaaatcatattttggcatatgggggtggaggatgaattctttacagactttttaagatgatccatttgtaccacagaaaacattttggaagttgttatatatgagtatataaatttttcttttcatattttacattaaaataaagctttattcagtcattaa

SEQ ID NO: 163651 - DNA, 1668 bp, Homo sapiens
  Payload ID: 12226
  Gene Symbol: PARD3B
  Gene Name: par-3 family cell polarity regulator beta
  Uniprot ID: Q8TEW8
  ENST ID: ENST00000415947
  CDS Start-End: 208-447
gcggccgcccctccccgattcccgccacctgccgcctggccaggtggaaggggcgctgccgcgagcctccgggcctcagggtgttccggggagcggcgccccgggtctctgggcccacccgccccgggcgtcctccgagagtgggggctgcgcccgcggggtcagacacctgttcggcccggcccggcgtggtcgccgggggccaggatgaaagtgaccgtgtgcttcggcaggacgggcatcgtggtgccctgcaaggagggccagctgcgcgtcggcgagctcacccagcaggcgctgcagcggtacctgaagacccgggagaaggtgagcgcggcgcggaggagtggggcgcggctgcagccaaggcacctgccagggtcctggttactgggtgaagattcatcacttagaatatacagatggaggaatcctggatccagatgatgtcttggcagatgttgttgaagataaagacaagctgattgctgtgtttgaagaacaagaaccactccacaagattgagagccccagtggaaaccctgcagatcggcagagcccagatgcttttgagacagaagtggccgcccaactggccgcatttaagccaattggtggggagattgaagtaaccccttctgctctaaaactaggcactccactgctggtgaggagaagcagtgacccagtgccaggcccacctgctgatacccagccaagcgcttcacaccctggtggccagagtctgaaactggttgttccagtaggtatcctgctgcttgtagttctaatgaaagatcaaagtgctgtacccataggttaagtgggactttgcagttttaaacacattgataactagatagagatcttttgatagtatatatagtattagttatactaatagctagtatgggctattacttgtatatagttatagcgatagctattacgtatatggcactgattatgtgccaagtactattttacctgttttatattaagtcatctaaacttccacatcaaggtaagcacatgtttttatctccatttaactgataatgaaattgaggcagaggaaggtttagtaatttgtttaaggtcacatagctaataagtggcaaagcaaggaatttcacccaggtgttctggctccaaaatccttgcttctggccagtacactatactgttacatttccttcatcttccagtttcgtaatgtccaaggatatcattatatttttgttgtgttaacccaatgctttgcaaaaccataccatgtgagtggtgtacattttcaagctcccaatatcacgaaaatgtggtgccaggattggatgtgtagaactcagcattcagattgaagaaaaacaaaatcattgaccaaaagtgcttataaccagatatacttataactaataggttaagtggagaataatttcctgaagagatgatattctccttccatataggactgtgggatcttcctgctaaatcctcagttgctttgaagagctgtaattgtgaataatcctctcagatagcctgagaattcaattttggctaatgactatataccattgcaataggtaatcttcgataacatagccatattaaaaattccctaaaagcaagactctttctcactttaagtctcactgtctataacgc

SEQ ID NO: 163652 - DNA, 2968 bp, Homo sapiens
  Payload ID: 12226
  Gene Symbol: PARD3B
  Gene Name: par-3 family cell polarity regulator beta
  ENST ID: ENST00000462231
  CDS Start-End: 161-2968
aaggggcgctgccgcgagcctccgggcctcagggtgttccggggagcggcgccccgggtctctgggcccacccgccccgggcgtcctccgagagtgggggctgcgcccgcggggtcagacacctgttcggcccggcccggcgtggtcgccgggggccaggatgaaagtgaccgtgtgcttcggcaggacgggcatcgtggtgccctgcaaggagggccagctgcgcgtcggcgagctcacccagcaggcgctgcagcggtacctgaagacccgggagaagggtcctggttactgggtgaagattcatcacttagaatatacagatggaggaatcctggatccagatgatgtcttggcagatgttgttgaagataaagacaagctgattgctgtgtttgaagaacaagaaccactccacaagattgagagccccagtggaaaccctgcagatcggcagagcccagatgcttttgagacagaagtggccgcccaactggccgcatttaagccaattggtggggagattgaagtaaccccttctgctctaaaactaggcactccactgctggtgaggagaagcagtgacccagtgccaggcccacctgctgatacccagccaagcgcttcacaccctggtggccagagtctgaaactggttgttccagattccacgcagaacttggaagacagagaagttttgaatggtgtacagacagaactactaacttcgccaagaactaaggacacattgagtgatatgacaagaacagtggagatttctggggaaggaggcccattgggaatacatgtagtgcccttcttttcatctctgagtggaaggattctaggactcttcatccgaggcattgaagacaacagcaggtccaagcgggagggactatttcacgaaaatgaatgtattgtaaaaatcaacaatgtggatctcgtagacaaaacctttgctcaggctcaagatgtcttccgccaggcaatgaaatctccaagtgtgctcctccacgtgcttcctccacaaaaccgtgaacagtatgaaaagtcagtcattggctctcttaacatttttggtaataatgatggcgttttgaaaaccaaagtgccgcctcctgtccatggaaaatcgggactaaagacagcaaatctcacaggaaccgatagtcctgaaacagatgcatcagcttccctgcaacaaaacaagagtccccgagtaccaaggctgggaggaaaaccatcctctccctcactctcgcctctcatgggatttggcagcaataaaaatgcaaagaaaattaagattgacctaaagaaaggccctgaaggacttggtttcactgtggttaccagagactcttccatacatggtcccggtcccatttttgtaaaaaacattttaccaaagggagcagcaataaaagatggccgcctacaatcaggggacagaattttggaggtaaatgggagagatgtcaccggacgaacccaggaagagcttgtggccatgctcaggagcaccaagcagggggagacagcatcgctggtcattgcccgccaagaaggacattttctgccccgagagttgaaaggagaacctgactgctgtgcactctctctggagacaagcgagcagctcacctttgagatccccctgaatgattcaggttctgctggcctcggggtgagcttaaaagggaacaaatccagagaaactggaacagacttggggatttttatcaaatccatcattcatggaggcgctgcttttaaggatggtcgtctgcgaatgaatgaccagctgattgcagttaatggggaatctcttttgggaaagtccaaccacgaagctatggaaacacttaggcggtcaatgtccatggagggaaacatccgagggatgatccagttggtgattctgaggaggccagagagaccaatggaggatcctgcagagtgtggggcattttccaagccatgctttgagaactgtcaaaatgctgtaaccacctctaggcgaaatgataatagtatcctgcatccacttggcacttgcagtccacaagacaaacagaaaggtctattgctgcccaatgacggatgggccgagagtgaagttccaccttctccaacaccacattctgctctgggattgggcctcgaagattacagccacagctctggggtggattcagcagtatattttccagatcagcacatcaacttcagatctgtgacaccggccaggcagcctgaatcaattaatttgaaagcctcgaagagcatggaccttgtgccagatgaaagcaaggttcactcattggctggacaaaaatcggaatctccaagcaaagattttggtccaactctgggtttgaaaaagtccagctccttggagagtctgcagactgcagtggccgaggtcaggaagaatgaccttccctttcacaggccccggccgcacatggttcgaggccgaggctgcaatgagagctttagagcagccattgacaaatcctacgatggacctgaagaaatagaagctgacggtctgtctgataagagctctcactctggccaaggagctctgaattgtgagtctgcccctcaggggaattcggagctagaggacatggaaaataaagccaggaaagtcaaaaaaacgaaagagaaggagaagaaaaaggaaaagggcaaattgaaagtcaaggagaaaaagcgcaaagaggagaatgaagatccagaaaggaaaataaagaagaagggcttcggcgccatgctgaggtatgggcctgctttgaaggcaaagttggttctcattttgtctctcctgaaaaaagcgcacgcttttcctcgtcttcagccaaatgcatacggctctcaattctgtgctcgttctctttctgcagaggcagaggagctttttggggaaagttacagtgatgacaggacactgtcttaa

SEQ ID NO: 163653 - DNA, 7538 bp, Homo sapiens
  Payload ID: 12226
  Gene Symbol: PARD3B
  Gene Name: par-3 family cell polarity regulator beta
  ENST ID: ENST00000614500
  CDS Start-End: 1-3189
ctgattgctgtgtttgaagaacaagaaccactccacaagattgagagccccagtggaaaccctgcagatcggcagagcccagatgcttttgagacagaagtggccgcccaactggccgcatttaagccaattggtggggagattgaagtaaccccttctgctctaaaactaggcactccactgctggtgaggagaagcagtgacccagtgccaggcccacctgctgatacccagccaagcgcttcacaccctggtggccagagtctgaaactggttgttccagattccacgcagaacttggaagacagagaagttttgaatggtgtacagacagaactactaacttcgccaagaactaaggacacattgagtgatatgacaagaacagtggagatttctggggaaggaggcccattgggaatacatgtagtgcccttcttttcatctctgagtggaaggattctaggactcttcatccgaggcattgaagacaacagcaggtccaagcgggagggactatttcacgaaaatgaatgtattgtaaaaatcaacaatgtggatctcgtagacaaaacctttgctcaggctcaagatgtcttccgccaggcaatgaaatctccaagtgtgctcctccacgtgcttcctccacaaaaccgtgaacagtatgaaaagtcagtcattggctctcttaacatttttggtaataatgatggcgttttgaaaaccaaagtgccgcctcctgtccatggaaaatcgggactaaagacagcaaatctcacaggaaccgatagtcctgaaacagatgcatcagcttccctgcaacaaaacaagagtccccgagtaccaaggctgggaggaaaaccatcctctccctcactctcgcctctcatgggatttggcagcaataaaaatgcaaagaaaattaagattgacctaaagaaaggccctgaaggacttggtttcactgtggttaccagagactcttccatacatggtcccggtcccatttttgtaaaaaacattttaccaaagggagcagcaataaaagatggccgcctacaatcaggggacagaattttggaggtaaatgggagagatgtcaccggacgaacccaggaagagcttgtggccatgctcaggagcaccaagcagggggagacagcatcgctggtcattgcccgccaagaaggacattttctgccccgagagttgaaaggagaacctgactgctgtgcactctctctggagacaagcgagcagctcacctttgagatccccctgaatgattcaggttctgctggcctcggggtgagcttaaaagggaacaaatccagagaaactggaacagacttggggatttttatcaaatccatcattcatggaggcgctgcttttaaggatggtcgtctgcgaatgaatgaccagctgattgcagttaatggggaatctcttttgggaaagtccaaccacgaagctatggaaacacttaggcggtcaatgtccatggagggaaacatccgagggatgatccagttggtgattctgaggaggccagagagaccaatggaggatcctgcagagtgtggggcattttccaagccatgctttgagaactgtcaaaatgctgtaaccacctctaggcgaaatgataatagtatcctgcatccacttggcacttgcagtccacaagacaaacagaaaggtctattgctgcccaatgacggatgggccgagagtgaagttccaccttctccaacaccacattctgctctgggattgggcctcgaagattacagccacagctctggggtggattcagcagtatattttccagatcagcacatcaacttcagatctgtgacaccggccaggcagcctgaatcaattaatttgaaagcctcgaagagcatggaccttgtgccagatgaaagcaaggttcactcattggctggacaaaaatcggacggtctgtctgataagagctctcactctggccaaggagctctgaattgtgagtctgcccctcaggggaattcggagctagaggacatggaaaataaagccaggaaagtcaaaaaaacgaaagagaaggagaagaaaaaggaaaagggcaaattgaaagtcaaggagaaaaagcgcaaagaggagaatgaagatccagaaaggaaaataaagaagaagggcttcggcgccatgctgagatttggaaagaagaaagaggataagggtggaaaggctgagcagaaaggtactctgaaacatggtggcctgagagaagaagagctggagaaaatgaaagaagagcgtgaaaggattggagcaaaacatcaggagctaagggaaaagcaggcaagaggtcttcttgattatgctactggtgcaattggatcagtgtatgatatggatgatgatgaaatggaccccaattatgccagagtgaaccactttcgggaaccatgcacatcagcaaatgtctttagatctccatctccccctcgagctggaccatttggttaccctcgggatggccatccactgtctccagaaagagaccacttagagggtctctatgccaaggtcaacaagccataccatccactggttccagctgacagtggccgtcctacgggtggaagcactgaccgtatccagaagttgcggaaagagtattatcaggctcggagggaaggtttccctttatatgaagacgacgaaggaagagcaaggccatctgagtatgacctactctgggtgcctggaaggggtccagatgggaatgcacacaacctccgctttgaagggatggagaggcagtacgcatccttacccaggggaggacccgcagatcctgtagactatctgccagcagcacctcgggggctctacaaggaaagggagcttccctattatccaggggctcatcctatgcaccctcccaaagggagctatccccgccccacagagctcagggtggcagatctccggtatcctcagcactacccacccccgccagctccccagcacaaaggaccctttcgacaagacgttccgccttcccctccccagcaccaaagaatgccagcctatcaggaaacaggcagaccagggccccgtgggggcagcccagaccagtacccttaccgaacccaggattcccggcagaagaaccccatgactgcagccgtatagctgagtgccaccgaggccagcccggtccagaaaggaaggtgtctactctacctttgccctttctaaacctgaagacctccttggtgttaggaattctccatgttactgataagctttttctcactgacattgtaacgcatgactgctaatcagagagaaaaagaaggggaagggaattggggaggaaaaaaaatcagaaggaagacgaaagatggggctataaaaacaaaactacctgatagttgaaacgctttcagagttgttcaaatcagtgagagtggcaacggaacacacaaacaactaattatggaactctactctggggatcctctctggctagataacctgtgctgatgtgcagacacgtggacatccccctctgagactggcggtccagaggcagtctctgccaggcagcattacccgctccgaggtggagcctcagcccccttcttagagctgttaagtctaaggtgtggcagagcagacagagatagaggcatctgaagtgagtataggttttttgactaagaaaaaaaacaacagcaaacatgactagtgatcttgaaatattttgtaccgagagaaagactgcatttatttgtagaatttatcaggtttctgataccactcattggatgtaaacatttcatgtttcctcacttttgatatgaaagtcggtaaaatgcagtattagtcccgggaggatgtgcacagctggtcagagcttccagaaggaatatcttccgaggactaaggtgatcaggttaagagggttcaacatcccacggccctcaccttcctccctcccacattccaggcatggagatatctggtttcagagtcagccccaaatctcctgcctataattactttaactggggtctctaaggttcccacttgagggctaaaatgtagttgggaaagagggcctactggggaggtctcacaggaggcagtgccctgggaaatgccaagtccagactcagtgccaagcagtaaccatctgcactcggggacagcgaggagctgaccatggcctctgatgaccagcaggtattagatggaagtgaatgagagagagagagagagagagtatgtgtgtgtgtgtgtatgtgtgtgttcgaacacatatgattgccagtatggagaatgaaagattaataatgctttctggagagtttgatgcaaaagtgggggaaacggagaaaaggcgctaaggctaaatccatctgcatttgctatatttcattagctaaagtcaggtcagggcagggccaaggcctccaattggcaaaggacagtgttatggctttaaaaagctgaaaccccaacctctaagtagatcacaatgttttctgagctttgcagtaattttctatggaaactaaaacctctaaaacatacaagctggcccaaatgagaacacaagcaaaagatgtggaagacagcaaaacctgagcactggtttgaaccaggcactgacatttgaaatgctttaagccttttcacattccttctttattccctccaaaaaaaaaagtcttgagtttaatttaggtctattttggctgagattagcatacctctgactcacaggatttaataaattatagtattattgaatacataggacatccctctaccccagcttactcttatctttttaatttaaaatagtattctgctaccaagaaggatgcaactgctagttttagatgtaaatagtgttatttactggactttgtgatattattttcttaactacactttactatggccctgttgaaaacagactatcaagttttttgtctctgttctgtcatctctcttaagccaggcacctttagagtgtttgcaatttgttcgaagtggttgaggatctcaggccctgctcacgtgaggtggagtgcaggggagctaccggtttccctgctgacctgctgaatgctaccttcccctcgagttgaatacaccttaaggaaaatgataacacgagggacgtgtaacttgttttgaagcattaaaaaccagcagctcttcactatgttccatattttaaccaaactactgtagactactaaacatagccaagccagaacattccttctggattaagcctaggccacttgaggggcagccaggggtgatggtgtcaggtgagaatcctgtgtcttgaaggagtggcctttacaggaagagtgcccatgttttcacctgcagcgttgccaccagagtgtgcaatacctcctgcacacaggctcagggtaaactgctccaaagctgggttttgtgttgcatacaaagtcaataaaatagttgctaatcctgaatggcagccagtgatgtgaaggtactattaaagtgaacaaaaactagattgcaacagttttctttccttgcttgaagtataacacacgctccatttgatcctgcctgaaagaagctaacattatatttgtgacagacagaggctccatcaagccaagcaacaattaacagctcaagtgtaagatttataaatgcccgtgtactcacccttcaattgttaccacccagaggttacaggactctttcccagcatttaggggaacaggcttttagagtatttagaagaccaggctataatcagtaatgtgcctgggagcaggaaatagctcccaatttatttatggccttgggaaaactcaatccggtgtctccttgtagctcagaacactaatagcccccctggaagagagtggcacattgagctccaaacccaatcaacatacatccacttggctgcagatctgactgctgggtcatgaaggccgtgaaatgatgtttgccctcaagtcactagatattttaagaagccctatttttctccctttttgcaggagtagagagatgaaagaggacagaccattgaaaacttttagatgcaggagaattgagacttccacaagggagagaaacacagcctccccagaatccattatgccatcgggttgtggcactctcacccttgccataataccgtttcctaacaatatcaaatcagtggatgaaatacaagctcagaaacaggaacattttcctaaatcataacctaatagcaaacaaaaattgaaaaaacaattattctgaagctcattattcttagatctgtagatatatatgtgttgactcccacaggatggcaccaagtaaagatcttaagagcatagtaggggttctgagaccgactgtcacccgtggatcctgatggggaagaacagaggcttcactgtagctatagttttccaccaagtcaatcaaattaaaacatgactcattgtcccctccaaagattcataaaattcttgagctaaagtgatcttctgaagaaaagccacctaacaatgttaggaggctcataaagctcatttctcttttccctggtatgcacaaatatcaagcctataaaaaagtaattatttccccaaacctgtaaccactgcattcgttttctttggaggaacattgtagcatttcaggagggtcgagagatctaaagagtttggtctgaatgtgtgtctgtacaattccctttggcattaaactctgaaacctacaatcaatggccttcaaattggtgttaaattgggagaacaccctactgctttctgagtctacgagcaacagaaagactggtcttagtgcaattaggcaggagggatttggactcagaaacagccacagaagtatttctcagcactcccagttcctgccaacttagctggaaacgatgccacagcgagaccagaaagaggagtcgccttaaggtatccctacaaagtcacctttctgataaaaaggagggaaaaaaaagttagatatctaaaataagcctagaatctcacacacagctgtgacttctaagtgaaactcttttctccctcatgtccttaaatagtcacagaatcacacacagcctgacttttaaagacaagcttggctacaggaaatgaaccaaccccaaagactcttctaacctgtctcctgactgggctccttcagaaagtgttctcctgttccatctgtagggctgcttactactggaacctaaaacaaaacctgttgtttgtaccatcactttttctggtgtttcctgtgcttttgtgattccaagtctgttcataagttctgaagataaattatgtgaaatcatattttggcatatgggggtggaggatgaattctttacagactttttaagatgatccatttgtaccacagaaaacattttggaagttgttatatatgagtatataaatttttcttttcatattttacattaaaataaagctttattcagtcattaa

SEQ ID NO: 163654 - DNA, 7442 bp, Homo sapiens
  Payload ID: 12226
  Gene Symbol: PARD3B
  Gene Name: par-3 family cell polarity regulator beta
  ENST ID: ENST00000622699
  CDS Start-End: 1-3093
ctgattgctgtgtttgaagaacaagaaccactccacaagattgagagccccagtggaaaccctgcagatcggcagagcccagatgcttttgagacagaagtggccgcccaactggccgcatttaagccaattggtggggagattgaagtaaccccttctgctctaaaactaggcactccactgctggtgaggagaagcagtgacccagtgccaggcccacctgctgatacccagccaagcgcttcacaccctggtggccagagtctgaaactggttgttccagattccacgcagaacttggaagacagagaagttttgaatggtgtacagacagaactactaacttcgccaagaactaaggacacattgagtgatatgacaagaacagtggagatttctggggaaggaggcccattgggaatacatgtagtgcccttcttttcatctctgagtggaaggattctaggactcttcatccgaggcattgaagacaacagcaggtccaagcgggagggactatttcacgaaaatgaatgtattgtaaaaatcaacaatgtggatctcgtagacaaaacctttgctcaggctcaagatgtcttccgccaggcaatgaaatctccaagtgtgctcctccacgtgcttcctccacaaaaccgtgaacagtatgaaaagtcagtcattggctctcttaacatttttggtaataatgatggcgttttgaaaaccaaagtgccgcctcctgtccatggaaaatcgggactaaagacagcaaatctcacaggaaccgatagtcctgaaacagatgcatcagcttccctgcaacaaaacaagagtccccgagtaccaaggctgggaggaaaaccatcctctccctcactctcgcctctcatgggatttggcagcaataaaaatgcaaagaaaattaagattgacctaaagaaaggccctgaaggacttggtttcactgtggttaccagagactcttccatacatggtcccggtcccatttttgtaaaaaacattttaccaaagggagcagcaataaaagatggccgcctacaatcaggggacagaattttggaggtaaatgggagagatgtcaccggacgaacccaggaagagcttgtggccatgctcaggagcaccaagcagggggagacagcatcgctggtcattgcccgccaagaaggacattttctgccccgagagttgaaaggagaacctgactgctgtgcactctctctggagacaagcgagcagctcacctttgagatccccctgaatgattcaggttctgctggcctcggggtgagcttaaaagggaacaaatccagagaaactggaacagacttggggatttttatcaaatccatcattcatggaggcgctgcttttaaggatggtcgtctgcgaatgaatgaccagctgattgcagttaatggggaatctcttttgggaaagtccaaccacgaagctatggaaacacttaggcggtcaatgtccatggagggaaacatccgagggatgatccagttggtgattctgaggaggccagagagaccaatggaggatcctgcagagtgtggggcattttccaagccatgctttgagaactgtcaaaatgctgtaaccacctctaggcgaaatgataatagtatcctgcatccacttggcacttgcagtccacaagacaaacagaaaggtctattgctgcccaatgacggatgggccgagagtgaagttccaccttctccaacaccacattctgctctgggattgggcctcgaagattacagccacagctctggggtggattcagcagtatattttccagatcagcacatcaacttcagatctgtgacaccggccaggcagcctgaatcaattaatttgaaagcctcgaagagcatggaccttgtgccagatgaaagcaaggttcactcattggctggacaaaaatcggaatctccaagcaaagattttggtccaactctgggtttgaaaaagtccagctccttggagagtctgcagactgcagtggccgaggtcaggaagaatgaccttccctttcacaggccccggccgcacatggttcgaggccgaggctgcaatgagagctttagagcagccattgacaaatcctacgatggacctgaagaaatagaagctgacggtctgtctgataagagctctcactctggccaaggagctctgaattgtgagtctgcccctcaggggaattcggagctagaggacatggaaaataaagccaggaaagtcaaaaaaacgaaagagaaggagaagaaaaaggaaaagggcaaattgaaagtcaaggagaaaaagcgcaaagaggagaatgaagatccagaaaggaaaataaagaagaagggcttcggcgccatgctgagatttggaaagaagaaagaggataagggtggaaaggctgagcagaaaggtactctgaaacatggtggcctgagagaagaagagctggagaaaatgaaagaagagcgtgaaagtggccgtcctacgggtggaagcactgaccgtatccagaagttgcggaaagagtattatcaggctcggagggaaggtttccctttatatgaagacgacgaaggaagagcaaggccatctgagtatgacctactctgggtgcctggaaggggtccagatgggaatgcacacaacctccgctttgaagggatggagaggcagtacgcatccttacccaggggaggacccgcagatcctgtagactatctgccagcagcacctcgggggctctacaaggaaagggagcttccctattatccaggggctcatcctatgcaccctcccaaagggagctatccccgccccacagagctcagggtggcagatctccggtatcctcagcactacccacccccgccagctccccagcacaaaggaccctttcgacaagacgttccgccttcccctccccagcaccaaagaatgccagcctatcaggaaacaggcagaccagggccccgtgggggcagcccagaccagtacccttaccgaacccaggattcccggcagaagaaccccatgactgcagccgtatagctgagtgccaccgaggccagcccggtccagaaaggaaggtgtctactctacctttgccctttctaaacctgaagacctccttggtgttaggaattctccatgttactgataagctttttctcactgacattgtaacgcatgactgctaatcagagagaaaaagaaggggaagggaattggggaggaaaaaaaatcagaaggaagacgaaagatggggctataaaaacaaaactacctgatagttgaaacgctttcagagttgttcaaatcagtgagagtggcaacggaacacacaaacaactaattatggaactctactctggggatcctctctggctagataacctgtgctgatgtgcagacacgtggacatccccctctgagactggcggtccagaggcagtctctgccaggcagcattacccgctccgaggtggagcctcagcccccttcttagagctgttaagtctaaggtgtggcagagcagacagagatagaggcatctgaagtgagtataggttttttgactaagaaaaaaaacaacagcaaacatgactagtgatcttgaaatattttgtaccgagagaaagactgcatttatttgtagaatttatcaggtttctgataccactcattggatgtaaacatttcatgtttcctcacttttgatatgaaagtcggtaaaatgcagtattagtcccgggaggatgtgcacagctggtcagagcttccagaaggaatatcttccgaggactaaggtgatcaggttaagagggttcaacatcccacggccctcaccttcctccctcccacattccaggcatggagatatctggtttcagagtcagccccaaatctcctgcctataattactttaactggggtctctaaggttcccacttgagggctaaaatgtagttgggaaagagggcctactggggaggtctcacaggaggcagtgccctgggaaatgccaagtccagactcagtgccaagcagtaaccatctgcactcggggacagcgaggagctgaccatggcctctgatgaccagcaggtattagatggaagtgaatgagagagagagagagagagagtatgtgtgtgtgtgtgtatgtgtgtgttcgaacacatatgattgccagtatggagaatgaaagattaataatgctttctggagagtttgatgcaaaagtgggggaaacggagaaaaggcgctaaggctaaatccatctgcatttgctatatttcattagctaaagtcaggtcagggcagggccaaggcctccaattggcaaaggacagtgttatggctttaaaaagctgaaaccccaacctctaagtagatcacaatgttttctgagctttgcagtaattttctatggaaactaaaacctctaaaacatacaagctggcccaaatgagaacacaagcaaaagatgtggaagacagcaaaacctgagcactggtttgaaccaggcactgacatttgaaatgctttaagccttttcacattccttctttattccctccaaaaaaaaaagtcttgagtttaatttaggtctattttggctgagattagcatacctctgactcacaggatttaataaattatagtattattgaatacataggacatccctctaccccagcttactcttatctttttaatttaaaatagtattctgctaccaagaaggatgcaactgctagttttagatgtaaatagtgttatttactggactttgtgatattattttcttaactacactttactatggccctgttgaaaacagactatcaagttttttgtctctgttctgtcatctctcttaagccaggcacctttagagtgtttgcaatttgttcgaagtggttgaggatctcaggccctgctcacgtgaggtggagtgcaggggagctaccggtttccctgctgacctgctgaatgctaccttcccctcgagttgaatacaccttaaggaaaatgataacacgagggacgtgtaacttgttttgaagcattaaaaaccagcagctcttcactatgttccatattttaaccaaactactgtagactactaaacatagccaagccagaacattccttctggattaagcctaggccacttgaggggcagccaggggtgatggtgtcaggtgagaatcctgtgtcttgaaggagtggcctttacaggaagagtgcccatgttttcacctgcagcgttgccaccagagtgtgcaatacctcctgcacacaggctcagggtaaactgctccaaagctgggttttgtgttgcatacaaagtcaataaaatagttgctaatcctgaatggcagccagtgatgtgaaggtactattaaagtgaacaaaaactagattgcaacagttttctttccttgcttgaagtataacacacgctccatttgatcctgcctgaaagaagctaacattatatttgtgacagacagaggctccatcaagccaagcaacaattaacagctcaagtgtaagatttataaatgcccgtgtactcacccttcaattgttaccacccagaggttacaggactctttcccagcatttaggggaacaggcttttagagtatttagaagaccaggctataatcagtaatgtgcctgggagcaggaaatagctcccaatttatttatggccttgggaaaactcaatccggtgtctccttgtagctcagaacactaatagcccccctggaagagagtggcacattgagctccaaacccaatcaacatacatccacttggctgcagatctgactgctgggtcatgaaggccgtgaaatgatgtttgccctcaagtcactagatattttaagaagccctatttttctccctttttgcaggagtagagagatgaaagaggacagaccattgaaaacttttagatgcaggagaattgagacttccacaagggagagaaacacagcctccccagaatccattatgccatcgggttgtggcactctcacccttgccataataccgtttcctaacaatatcaaatcagtggatgaaatacaagctcagaaacaggaacattttcctaaatcataacctaatagcaaacaaaaattgaaaaaacaattattctgaagctcattattcttagatctgtagatatatatgtgttgactcccacaggatggcaccaagtaaagatcttaagagcatagtaggggttctgagaccgactgtcacccgtggatcctgatggggaagaacagaggcttcactgtagctatagttttccaccaagtcaatcaaattaaaacatgactcattgtcccctccaaagattcataaaattcttgagctaaagtgatcttctgaagaaaagccacctaacaatgttaggaggctcataaagctcatttctcttttccctggtatgcacaaatatcaagcctataaaaaagtaattatttccccaaacctgtaaccactgcattcgttttctttggaggaacattgtagcatttcaggagggtcgagagatctaaagagtttggtctgaatgtgtgtctgtacaattccctttggcattaaactctgaaacctacaatcaatggccttcaaattggtgttaaattgggagaacaccctactgctttctgagtctacgagcaacagaaagactggtcttagtgcaattaggcaggagggatttggactcagaaacagccacagaagtatttctcagcactcccagttcctgccaacttagctggaaacgatgccacagcgagaccagaaagaggagtcgccttaaggtatccctacaaagtcacctttctgataaaaaggagggaaaaaaaagttagatatctaaaataagcctagaatctcacacacagctgtgacttctaagtgaaactcttttctccctcatgtccttaaatagtcacagaatcacacacagcctgacttttaaagacaagcttggctacaggaaatgaaccaaccccaaagactcttctaacctgtctcctgactgggctccttcagaaagtgttctcctgttccatctgtagggctgcttactactggaacctaaaacaaaacctgttgtttgtaccatcactttttctggtgtttcctgtgcttttgtgattccaagtctgttcataagttctgaagataaattatgtgaaatcatattttggcatatgggggtggaggatgaattctttacagactttttaagatgatccatttgtaccacagaaaacattttggaagttgttatatatgagtatataaatttttcttttcatattttacattaaaataaagctttattcagtcattaa

SEQ ID NO: 163655 - DNA, 7559 bp, Homo sapiens
  Payload ID: 12226
  Gene Symbol: PARD3B
  Gene Name: par-3 family cell polarity regulator beta
  ENST ID: ENST00000613457
  CDS Start-End: 1-3210
ctgattgctgtgtttgaagaacaagaaccactccacaagattgagagccccagtggaaaccctgcagatcggcagagcccagatgcttttgagacagaagtggccgcccaactggccgcatttaagccaattggtggggagattgaagtaaccccttctgctctaaaactaggcactccactgctggtgaggagaagcagtgacccagtgccaggcccacctgctgatacccagccaagcgcttcacaccctggtggccagagtctgaaactggttgttccagattccacgcagaacttggaagacagagaagttttgaatggtgtacagacagaactactaacttcgccaagaactaaggacacattgagtgatatgacaagaacagtggagatttctggggaaggaggcccattgggaatacatgtagtgcccttcttttcatctctgagtggaaggattctaggactcttcatccgaggcattgaagacaacagcaggtccaagcgggagggactatttcacgaaaatgaatgtattgtaaaaatcaacaatgtggatctcgtagacaaaacctttgctcaggctcaagatgtcttccgccaggcaatgaaatctccaagtgtgctcctccacgtgcttcctccacaaaaccgtgaacagtatgaaaagtcagtcattggctctcttaacatttttggtaataatgatggcgttttgaaaaccaaagtgccgcctcctgtccatggaaaatcgggactaaagacagcaaatctcacaggaaccgatagtcctgaaacagatgcatcagcttccctgcaacaaaacaagagtccccgagtaccaaggctgggaggaaaaccatcctctccctcactctcgcctctcatgggatttggcagcaataaaaatgcaaagaaaattaagattgacctaaagaaaggccctgaaggacttggtttcactgtggttaccagagactcttccatacatggtcccggtcccatttttgtaaaaaacattttaccaaagggagcagcaataaaagatggccgcctacaatcaggggacagaattttggaggtaaatgggagagatgtcaccggacgaacccaggaagagcttgtggccatgctcaggagcaccaagcagggggagacagcatcgctggtcattgcccgccaagaaggacattttctgccccgagagttggatggtcgtctgcgaatgaatgaccagctgattgcagttaatggggaatctcttttgggaaagtccaaccacgaagctatggaaacacttaggcggtcaatgtccatggagggaaacatccgagggatgatccagttggtgattctgaggaggccagagagaccaatggaggatcctgcagagtgtggggcattttccaagccatgctttgagaactgtcaaaatgctgtaaccacctctaggcgaaatgataatagtatcctgcatccacttggcacttgcagtccacaagacaaacagaaaggtctattgctgcccaatgacggatgggccgagagtgaagttccaccttctccaacaccacattctgctctgggattgggcctcgaagattacagccacagctctggggtggattcagcagtatattttccagatcagcacatcaacttcagatctgtgacaccggccaggcagcctgaatcaattaatttgaaagcctcgaagagcatggaccttgtgccagatgaaagcaaggttcactcattggctggacaaaaatcggaatctccaagcaaagattttggtccaactctgggtttgaaaaagtccagctccttggagagtctgcagactgcagtggccgaggtcaggaagaatgaccttccctttcacaggccccggccgcacatggttcgaggccgaggctgcaatgagagctttagagcagccattgacaaatcctacgatggacctgaagaaatagaagctgacggtctgtctgataagagctctcactctggccaaggagctctgaattgtgagtctgcccctcaggggaattcggagctagaggacatggaaaataaagccaggaaagtcaaaaaaacgaaagagaaggagaagaaaaaggaaaagggcaaattgaaagtcaaggagaaaaagcgcaaagaggagaatgaagatccagaaaggaaaataaagaagaagggcttcggcgccatgctgagatttggaaagaagaaagaggataagggtggaaaggctgagcagaaaggtactctgaaacatggtggcctgagagaagaagagctggagaaaatgaaagaagagcgtgaaaggattggagcaaaacatcaggagctaagggaaaagcaggcaagaggtcttcttgattatgctactggtgcaattggatcagtgtatgatatggatgatgatgaaatggaccccaattatgccagagtgaaccactttcgggaaccatgcacatcagcaaatgtctttagatctccatctccccctcgagctggaccatttggttaccctcgggatggccatccactgtctccagaaagagaccacttagagggtctctatgccaaggtcaacaagccataccatccactggttccagctgacagtggccgtcctacgggtggaagcactgaccgtatccagaagttgcggaaagagtattatcaggctcggagggaaggtttccctttatatgaagacgacgaaggaagagcaaggccatctgagtatgacctactctgggtgcctggaaggggtccagatgggaatgcacacaacctccgctttgaagggatggagaggcagtacgcatccttacccaggggaggacccgcagatcctgtagactatctgccagcagcacctcgggggctctacaaggaaagggagcttccctattatccaggggctcatcctatgcaccctcccaaagggagctatccccgccccacagagctcagggtggcagatctccggtatcctcagcactacccacccccgccagctccccagcacaaaggaccctttcgacaagacgttccgccttcccctccccagcaccaaagaatgccagcctatcaggaaacaggcagaccagggccccgtgggggcagcccagaccagtacccttaccgaacccaggattcccggcagaagaaccccatgactgcagccgtatagctgagtgccaccgaggccagcccggtccagaaaggaaggtgtctactctacctttgccctttctaaacctgaagacctccttggtgttaggaattctccatgttactgataagctttttctcactgacattgtaacgcatgactgctaatcagagagaaaaagaaggggaagggaattggggaggaaaaaaaatcagaaggaagacgaaagatggggctataaaaacaaaactacctgatagttgaaacgctttcagagttgttcaaatcagtgagagtggcaacggaacacacaaacaactaattatggaactctactctggggatcctctctggctagataacctgtgctgatgtgcagacacgtggacatccccctctgagactggcggtccagaggcagtctctgccaggcagcattacccgctccgaggtggagcctcagcccccttcttagagctgttaagtctaaggtgtggcagagcagacagagatagaggcatctgaagtgagtataggttttttgactaagaaaaaaaacaacagcaaacatgactagtgatcttgaaatattttgtaccgagagaaagactgcatttatttgtagaatttatcaggtttctgataccactcattggatgtaaacatttcatgtttcctcacttttgatatgaaagtcggtaaaatgcagtattagtcccgggaggatgtgcacagctggtcagagcttccagaaggaatatcttccgaggactaaggtgatcaggttaagagggttcaacatcccacggccctcaccttcctccctcccacattccaggcatggagatatctggtttcagagtcagccccaaatctcctgcctataattactttaactggggtctctaaggttcccacttgagggctaaaatgtagttgggaaagagggcctactggggaggtctcacaggaggcagtgccctgggaaatgccaagtccagactcagtgccaagcagtaaccatctgcactcggggacagcgaggagctgaccatggcctctgatgaccagcaggtattagatggaagtgaatgagagagagagagagagagagtatgtgtgtgtgtgtgtatgtgtgtgttcgaacacatatgattgccagtatggagaatgaaagattaataatgctttctggagagtttgatgcaaaagtgggggaaacggagaaaaggcgctaaggctaaatccatctgcatttgctatatttcattagctaaagtcaggtcagggcagggccaaggcctccaattggcaaaggacagtgttatggctttaaaaagctgaaaccccaacctctaagtagatcacaatgttttctgagctttgcagtaattttctatggaaactaaaacctctaaaacatacaagctggcccaaatgagaacacaagcaaaagatgtggaagacagcaaaacctgagcactggtttgaaccaggcactgacatttgaaatgctttaagccttttcacattccttctttattccctccaaaaaaaaaagtcttgagtttaatttaggtctattttggctgagattagcatacctctgactcacaggatttaataaattatagtattattgaatacataggacatccctctaccccagcttactcttatctttttaatttaaaatagtattctgctaccaagaaggatgcaactgctagttttagatgtaaatagtgttatttactggactttgtgatattattttcttaactacactttactatggccctgttgaaaacagactatcaagttttttgtctctgttctgtcatctctcttaagccaggcacctttagagtgtttgcaatttgttcgaagtggttgaggatctcaggccctgctcacgtgaggtggagtgcaggggagctaccggtttccctgctgacctgctgaatgctaccttcccctcgagttgaatacaccttaaggaaaatgataacacgagggacgtgtaacttgttttgaagcattaaaaaccagcagctcttcactatgttccatattttaaccaaactactgtagactactaaacatagccaagccagaacattccttctggattaagcctaggccacttgaggggcagccaggggtgatggtgtcaggtgagaatcctgtgtcttgaaggagtggcctttacaggaagagtgcccatgttttcacctgcagcgttgccaccagagtgtgcaatacctcctgcacacaggctcagggtaaactgctccaaagctgggttttgtgttgcatacaaagtcaataaaatagttgctaatcctgaatggcagccagtgatgtgaaggtactattaaagtgaacaaaaactagattgcaacagttttctttccttgcttgaagtataacacacgctccatttgatcctgcctgaaagaagctaacattatatttgtgacagacagaggctccatcaagccaagcaacaattaacagctcaagtgtaagatttataaatgcccgtgtactcacccttcaattgttaccacccagaggttacaggactctttcccagcatttaggggaacaggcttttagagtatttagaagaccaggctataatcagtaatgtgcctgggagcaggaaatagctcccaatttatttatggccttgggaaaactcaatccggtgtctccttgtagctcagaacactaatagcccccctggaagagagtggcacattgagctccaaacccaatcaacatacatccacttggctgcagatctgactgctgggtcatgaaggccgtgaaatgatgtttgccctcaagtcactagatattttaagaagccctatttttctccctttttgcaggagtagagagatgaaagaggacagaccattgaaaacttttagatgcaggagaattgagacttccacaagggagagaaacacagcctccccagaatccattatgccatcgggttgtggcactctcacccttgccataataccgtttcctaacaatatcaaatcagtggatgaaatacaagctcagaaacaggaacattttcctaaatcataacctaatagcaaacaaaaattgaaaaaacaattattctgaagctcattattcttagatctgtagatatatatgtgttgactcccacaggatggcaccaagtaaagatcttaagagcatagtaggggttctgagaccgactgtcacccgtggatcctgatggggaagaacagaggcttcactgtagctatagttttccaccaagtcaatcaaattaaaacatgactcattgtcccctccaaagattcataaaattcttgagctaaagtgatcttctgaagaaaagccacctaacaatgttaggaggctcataaagctcatttctcttttccctggtatgcacaaatatcaagcctataaaaaagtaattatttccccaaacctgtaaccactgcattcgttttctttggaggaacattgtagcatttcaggagggtcgagagatctaaagagtttggtctgaatgtgtgtctgtacaattccctttggcattaaactctgaaacctacaatcaatggccttcaaattggtgttaaattgggagaacaccctactgctttctgagtctacgagcaacagaaagactggtcttagtgcaattaggcaggagggatttggactcagaaacagccacagaagtatttctcagcactcccagttcctgccaacttagctggaaacgatgccacagcgagaccagaaagaggagtcgccttaaggtatccctacaaagtcacctttctgataaaaaggagggaaaaaaaagttagatatctaaaataagcctagaatctcacacacagctgtgacttctaagtgaaactcttttctccctcatgtccttaaatagtcacagaatcacacacagcctgacttttaaagacaagcttggctacaggaaatgaaccaaccccaaagactcttctaacctgtctcctgactgggctccttcagaaagtgttctcctgttccatctgtagggctgcttactactggaacctaaaacaaaacctgttgtttgtaccatcactttttctggtgtttcctgtgcttttgtgattccaagtctgttcataagttctgaagataaattatgtgaaatcatattttggcatatgggggtggaggatgaattctttacagactttttaagatgatccatttgtaccacagaaaacattttggaagttgttatatatgagtatataaatttttcttttcatattttacattaaaataaagctttattcagtcattaa

SEQ ID NO: 163656 - DNA, 1248 bp, Homo sapiens
  Payload ID: 12227
  Gene Symbol: PARD6A
  Gene Name: par-6 family cell polarity regulator alpha
  Uniprot ID: Q9NPB6
  ENST ID: ENST00000219255
  CDS Start-End: 81-1121
cgcgggcgggccggccgggctgtgcacctgcgcctcggcgggccgcctggggcaccgtccccggcccgcccggccccgccatggcccggccgcagaggactccggcgcgcagtcccgatagcatcgtcgaggtgaagagcaaatttgacgccgagttccgacgcttcgcgctgcctcgcgcttcggtgagcggcttccaggagttctcgcggttgctgcgggcggtgcaccagatcccgggcctggacgtgctacttggctatacggatgctcatggcgacctgctgcccctcaccaacgacgacagcctgcaccgggccctggccagcgggcccccgccactgcgcctactggtgcagaagcgggcagaagctgactccagcggcctggcttttgcctccaactctctgcagcggcgcaagaaagggctcttgctgcggccagtggcacccctgcgcacccggccacccttgctaatcagcctgccccaagatttccgccaggtttcctcagtcatagacgtggacctactgcctgagacccaccgacgggtgcggctgcacaagcatggttcagaccgccccctgggcttctacatccgagatggcatgagcgtgcgtgtggctccccagggcctggagcgggttccaggaatcttcatctcccgcctggtacgtgggggtctggctgagagtacagggctgctggcggtcagtgatgagatcctcgaggtcaatggcattgaagtagccgggaagaccttggaccaagtgacggacatgatggttgccaacagccataacctcattgtcactgtcaagcccgccaaccagcgcaataacgtggtgcgaggggcatctgggcgtttgacaggtcctccctctgcagggcctgggcctgctgagcctgatagtgacgatgacagcagtgacctggtcattgagaaccgccagcctcccagttccaatgggctgtctcaggggcccccgtgctgggacctgcaccctggctgccgacatcctggtacccgcagctctctgccctccctggatgaccaggagcaggccagttctggctgggggagtcgcattcgaggagatggtagtggcttcagcctctgacagtcaggatgaagccccatgccactccacactgctgggacatggcagggacttcacagtgggggtttttagctggctcacagggctccctcagcctggggaacattaaaggttttctacaaataca

SEQ ID NO: 163657 - DNA, 1260 bp, Homo sapiens
  Payload ID: 12227
  Gene Symbol: PARD6A
  Gene Name: par-6 family cell polarity regulator alpha
  Uniprot ID: Q9NPB6
  ENST ID: ENST00000458121
  CDS Start-End: 92-1129
gggcggggcggcgcgggcgggccggccgggctgtgcacctgcgcctcggcgggccgcctggggcaccgtccccggcccgcccggccccgccatggcccggccgcagaggactccggcgcgcagtcccgatagcatcgtcgaggtgaagagcaaatttgacgccgagttccgacgcttcgcgctgcctcgcgcttcggtgagcggcttccaggagttctcgcggttgctgcgggcggtgcaccagatcccgggcctggacgtgctacttggctatacggatgctcatggcgacctgctgcccctcaccaacgacgacagcctgcaccgggccctggccagcgggcccccgccactgcgcctactggtgcagaagcgggaagctgactccagcggcctggcttttgcctccaactctctgcagcggcgcaagaaagggctcttgctgcggccagtggcacccctgcgcacccggccacccttgctaatcagcctgccccaagatttccgccaggtttcctcagtcatagacgtggacctactgcctgagacccaccgacgggtgcggctgcacaagcatggttcagaccgccccctgggcttctacatccgagatggcatgagcgtgcgtgtggctccccagggcctggagcgggttccaggaatcttcatctcccgcctggtacgtgggggtctggctgagagtacagggctgctggcggtcagtgatgagatcctcgaggtcaatggcattgaagtagccgggaagaccttggaccaagtgacggacatgatggttgccaacagccataacctcattgtcactgtcaagcccgccaaccagcgcaataacgtggtgcgaggggcatctgggcgtttgacaggtcctccctctgcagggcctgggcctgctgagcctgatagtgacgatgacagcagtgacctggtcattgagaaccgccagcctcccagttccaatgggctgtctcaggggcccccgtgctgggacctgcaccctggctgccgacatcctggtacccgcagctctctgccctccctggatgaccaggagcaggccagttctggctgggggagtcgcattcgaggagatggtagtggcttcagcctctgacagtcaggatgaagccccatgccactccacactgctgggacatggcagggacttcacagtgggggtttttagctggctcacagggctccctcagcctggggaacattaaaggttttctacaaatacagtca

SEQ ID NO: 163658 - DNA, 1171 bp, Homo sapiens
  Payload ID: 12227
  Gene Symbol: PARD6A
  Gene Name: par-6 family cell polarity regulator alpha
  ENST ID: ENST00000602551
  CDS Start-End: 94-1044
aggggcggggcggcgcgggcgggccggccgggctgtgcacctgcgcctcggcgggccgcctggggcaccgtccccggcccgcccggccccgccatggcccggccgcagaggactccggcgcgcagtcccgatagcatcgtcgaggtgaagagcaaatttgacgccgagttccgacgcttcgcgctgcctcgcgcttcggtgagcggcttccaggagttctcgcggttgctgcgggcggtgcaccagatcccgggcctggacgtgctacttggctatacggatgctcatgcagaagctgactccagcggcctggcttttgcctccaactctctgcagcggcgcaagaaagggctcttgctgcggccagtggcacccctgcgcacccggccacccttgctaatcagcctgccccaagatttccgccaggtttcctcagtcatagacgtggacctactgcctgagacccaccgacgggtgcggctgcacaagcatggttcagaccgccccctgggcttctacatccgagatggcatgagcgtgcgtgtggctccccagggcctggagcgggttccaggaatcttcatctcccgcctggtacgtgggggtctggctgagagtacagggctgctggcggtcagtgatgagatcctcgaggtcaatggcattgaagtagccgggaagaccttggaccaagtgacggacatgatggttgccaacagccataacctcattgtcactgtcaagcccgccaaccagcgcaataacgtggtgcgaggggcatctgggcgtttgacaggtcctccctctgcagggcctgggcctgctgagcctgatagtgacgatgacagcagtgacctggtcattgagaaccgccagcctcccagttccaatgggctgtctcaggggcccccgtgctgggacctgcaccctggctgccgacatcctggtacccgcagctctctgccctccctggatgaccaggagcaggccagttctggctgggggagtcgcattcgaggagatggtagtggcttcagcctctgacagtcaggatgaagccccatgccactccacactgctgggacatggcagggacttcacagtgggggtttttagctggctcacagggctccctcagcctggggaacattaaaggttttctacaaataca

SEQ ID NO: 163659 - DNA, 4615 bp, Homo sapiens
  Payload ID: 12228
  Gene Symbol: PARD6B
  Gene Name: par-6 family cell polarity regulator beta
  Uniprot ID: Q9BYG5
  ENST ID: ENST00000371610
  CDS Start-End: 244-1362
gagggagggagctgcttccccgcctgccgcgccaccagtccgaccctcggtcccgccgtgtgagcagctggtggagtggagctcagcgcggacgccggagctgcggccgccccctctgcaggtgcctgtgaggaggcgcccgggccgcaaccgctttccgagatccccagtcgcgcactcgctccccgcgctcctgaggggccgcccggccggaggaggccgtcgcggggctcggcgttcagcatgaaccgcagccaccggcacggggcgggcagcggctgcctgggcactatggaggtgaagagcaagtttggagctgaatttcgtcggttttcgctggaaagatcaaaacctggaaaatttgaggagttttatggattactacaacatgttcataagatccccaatgttgacgttttggtaggctatgcagacatccatggagacttactacctataaataatgatgataattatcacaaagctgtttcaacggccaatccactgcttaggatatttatacaaaagaaggaagaagcagactacagtgcctttggtacagacacgctaataaagaagaagaatgttttaaccaacgtattgcgtcctgacaaccatagaaaaaagccacatatagtcattagtatgccccaagactttagacctgtgtcttctattatagacgtggatattctcccagaaacgcatcgtagggtacgtctttacaaatacggcacggagaaacccctaggattctacatccgggatggctccagtgtcagggtaacaccacatggcttagaaaaggttccagggatctttatatccaggcttgtcccaggaggtctggctcaaagtacaggactattagctgttaatgatgaagttttagaagttaatggcatagaagtttcagggaagagccttgatcaagtaacagacatgatgattgcaaatagccgtaacctcatcataacagtgagaccggcaaaccagaggaataatgttgtgaggaacagtcggacttctggcagttccggtcagtctactgataacagccttcttggctacccacagcagattgaaccaagctttgagccagaggatgaagacagcgaagaagatgacattatcattgaagacaatggagtgccacagcagattccaaaagctgttcctaatactgagagcctggagtcattaacacagatagagctaagctttgagtctggacagaatggctttattccctctaatgaagtgagcttagcagccatagcaagcagctcaaacacggaatttgaaacacatgctccagatcaaaaactcttagaagaagatggaacaatcataacattatgaaaccgtggtttgaatgttttcagagtgaggatgccatgaggacttgtacatttggctagtttaaaagcatatatacctctgaccagtgacgtggaataggcatgagacgagtaacgttgcaagcttacaatattattaaagtagtagtttgataattgttaatataaactttggtggatcagaggtgaatttaagtccaaaacaaaggggcctttgctgatgaagttacgtgcttttgctgttttgtctgtggagaatcagatgttaaagcacattcttggaactatgtgagaagactagatcatttctgttggaagtggttgcatatttaacctgctgtgcagagcccagttaatttttcctttaactgtatttttaaaattctaatgtgaagtctgattctctcttgtggtacattggggacctcagctcttaaaggtctcatgttcccaatattttattttgattttttttttttttttttttttttttttttttagtgactgggtctcactctgttgcccacactggaatgcagtggcatgatcacagctctctgcagcctcaatcccctgggctcaagcagtcctcccacctcagcctcctgagtagctgggaccataggcacataccaccacatctgtctactttttgtattttttgtagagacagggtttcgccatgttgcccaagttggtcttgaactcctgggcttaagcagtcctgcctcggcttcccaaaatgctaggattagagccaccatgcccagcctattttgatttttgtttttttatgttcctttctaataaattgtaacaaatgatgttctcaagtacatttccagtttcttttcttttctttctttttttttttttttttttttttgagatggagtctcgctctatcgcccaggctggagtgcagtggcgcgatcttggctcactgcaagctctacctcctgggttcacaccattctcctgcctcagcctcccaagtagctgggactacaggcgcctgccaccatgcctggctaatttttagtagagacggggtttcgcagtgttagccaggaaggtctcaatctcctgacctcctgatccgcccgcctcggcctcccaaagtgctgggattacaggcgtgagccaccgcgcccagttgtgcatttctggtttctaagaatcaaaccacttggctgtttttaggagttacttcccatgttataaagctgaggaagctttttttttttttttttgagacagagtctctgtcacccaggctggagtgcagtggtgcaatctcagctcccgggttcaagcaattctcctgcctcagccttctgagtagctaagattacaggtgtgcgccaacacgtctggcttatttttttgtatttttagtagagatggagtttcaccatgttggtcaggtgggtctcaaactcctgacctcaagtgatccgcccatctcctcccaaagtgctggattgcaggcatgagcgcctagccaggaagctatcttttcttgagttatgaaactttgcaacagttgttcaaattggtgtttgtccttcctatagctttcatattttcaaattaattctgtatggctatataatttatgttttaaaaggcaattctcttgactttggaaatatggaagtctctcctttaacctattcttgttcccattcccagtctcatttgaaatcattccttttattgttagtgtgtgtatttttgttggtgtgcttttaatgcatccaagtatgcatcattttggataaaaaatacatccaaattaagatgttttaacacataggacaaacttgtgcactttttatgccaaaaaaaaaaaaaattgggttttccttcatgggatttctagaaacactgcctacactttatgaaaactacatagtattcacctgtgacaggtagagtttatcactattaattttatgaggctatttattactttccaatgcatccacttagaacaagctaagagtaaggctgctaactttaattccttgcctgattttattgtacagtgtgcacaagcacaatggtatgcttgtatatagaaactaaaaatactatgaagtacataagttccctatggcttatggagagttatttattaattaactttatggtagggctagtatgaatacctttttaacaattgtgtgctattacaacaatgaagattcaaatgactccgctttgaaggatgttttctctatatggtaaaatatatatgaagaagtcttgattacgtgaagatcacttgactcagaatacttcaatgtattttgttcacattaccactaagcatattatcagtaaactattaactgactgcacattatgtaatacgttgtactttttgttgaattcaccgaagttcttccatttatatgctatttttaatggcattccggctttaacattctgtgagtcttacaaatttgactcttgaatggcaaaataatgttagtatgtagaaggttaactttcatttataatataagtggtgcaggggttcaacattttaagtaaaaatatttttacacactacctctctctttttttttttaaagttttaacatcagaacttttgggggaaaaactacttcagggcttgactttttgtacaaattttaactgtaaaatacagatttatcttgtacgcattcatggaaatggaaatcaaagctgctattgctttttattttaattatcctgttaagggtatctatcaatggtattttcaagtagatctctgtttcttaaattattggtgaaataattgattactagatatattgtaaaaccaatagatcctggttatacgataaaatatcagctcattggtaggctgaatcaattatttcaagtgcaccttattaacaaaagtatcagtggatccaacataaaattttatagtactaaatgtcaagcctaactgtgaattttgttctgtatcttaagtaaatttatgataatgttctcgagctatcaacaaaatatatgtacttttgtgagctatgaattttctaattaaattttacatgctataacatgatttttacatgaatgatactttgtttataactatcaaatgtcagtattttactacaattttattataaagtgtacattatcactaaatgaacttcgattttaaaaatcaaattagctttagttgtatattattttttacaaataaagatagacttgtataaaggcta

SEQ ID NO: 163660 - DNA, 522 bp, Homo sapiens
  Payload ID: 12228
  Gene Symbol: PARD6B
  Gene Name: par-6 family cell polarity regulator beta
  Uniprot ID: Q9BYG5
  ENST ID: ENST00000396039
  CDS Start-End: 123-470
gtgcctgtgaggaggcgcccgggccgcaaccgctttccgagatccccagtcgcgcactcgctccccgcgctcctgaggggccgcccggccggaggaggccgtcgcggggctcggcgttcagcatgaaccgcagccaccggcacggggcgggcagcggctgcctgggcactatggaggtgaagagcaagtttggagctgaatttcgtcggttttcgctggaaagatcaaaacctggaaaatttgaggagttttatggattactacaacatgttcataagatccccaatgttgacgttttggtaggctatgcagacatccatggagacttactacctataaataatgatgataattatcacaaagctgtttcaacggccaatccactgcttaggatatttatacaaaagaagggatgtgtattggaacattccaaaaacaatgtcaggatgccctgtttgaaaacactgtgaagtgctttacttttcacttgagatatttgccatgggaaagactatcatattt

SEQ ID NO: 163661 - DNA, 3868 bp, Homo sapiens
  Payload ID: 12229
  Gene Symbol: PARD6G
  Gene Name: par-6 family cell polarity regulator gamma
  Uniprot ID: Q9BYG4
  ENST ID: ENST00000353265
  CDS Start-End: 199-1329
cgctcctcccgcgcgcggcccctggagtccctgaggcgcgcggccagcccagctcgggcccgcagcaccgggagcagcccgccggccaagcgagcgcgggccggggccggggccggggcctgggggcgccgcccccgggagtctttctgcggcccctgaggagcgagggcgacggcgaggctgaccggggccgaaaccatgaaccgaagttttcacaagtctcagaccttgcgattctacgattgcagcgcagtggaagtcaagagcaagtttggggcggaattccgaaggttctctctggaccgtcataagcctgggaagtttgaagatttctacaagctggttgtgcacacccaccatatctccaacagtgatgtaactattggctatgcagatgtgcacggagacctgctgcccatcaacaatgatgacaacttctgcaaggcggtttctagtgcaaatcccctgctcagggtcttcatccagaaacgagaggaggccgagcgtggcagcctcggcgcgggctcgctgtgcaggcggaggcgggcgctgggcgcgctgcgtgatgaaggaccccggcggcgtgcacacctggacatcggcctcccgcgcgacttccgccccgtatcatccatcatcgatgtggacctggtccccgagacgcaccggcgagtgcggctgcaccggcacggctgcgagaagccgctgggcttctacatccgcgatggcgccagcgtgcgcgtgaccccgcacgggctggagaaggtgcccggcatcttcatctcgcgcatggtacccgggggcctggcggagagcaccgggctgctggctgtgaatgacgaggtcctggaggtgaacggcattgaggtggccgggaagacgctggaccaggtcacggacatgatgatcgccaacagccacaacctcatcgtcaccgtcaagcccgccaaccagcgcaacaacgtggtgcgcggcggccgcgcgttgggcagctcgggaccgccctcggacggcaccgcgggcttcgtgggtccccccgccccgcgcgtcctgcagaacttccaccccgacgaggcggagagcgatgaggacaacgacgtcgtcatcgagggcacactggagcctgcacgtcccccccagaccccgggcgcgcccgcaggcagcctctcccgggtcaatggcgcgggcctggcgcagcggctgcagcgggacctggccctggacggcggcctccagcggctgctcagctccctgcgggccgacccccgtcacagcctggcgctgccgccaggcggcgtggaggagcacgggcccgcggtcacgctctagactcccgagaggcccccaaatcctagctccagttccccggtaaggacagggacaggacctgcagactgcatccgctcattttttgttgtttttgtgaccacaaaaacaacgctgctctttgtttcaacttccggatataaaaacacaagtattgcctatttttatagaatttcgccacagaacttaaaatgaacgcctgtagagacactctataccaggcctgagtgcaggtcttggcgcctttgcaaagtgatagaaaagatctgaccaagtgcaaaaaaatgctttttaaaatttttacaaatactttgtttttaaagtgaagctttaaaattacttttttaaaatagtcaaattcatgtttttaagtaagttggcccatgcaacatatctcagcattcttgctgtgctctctgctgacttgcaggcgaggccgactgtgctgatgtacgtgacaagaggctggtttttaataacgaatgcagccaggtgcagtggctcacgtctgtaatcccagcactttgggaggcctacgtgggctgatcacgaggtcaggaggtcgagaccagcatggccaacatggtgaaaccctgtctctactaaaaatataaaaattagccaggtgtggtggcaggcgcctgtaatcccagctaccttgggaggctgaggcaggagaatcgcttgaacccgggaggcagaggttgcagtgagctgagatcgcaccactgcactccagcctgggtgacagagcaagactctgtctcgggaaaaaaaaaaaatacacccaaacctgtccatgtacaaccatggagatgaattccagattttcacactgttcatagtcataattcggttgggacaggagagctcccaccagcacacttatggcacccgcagctgtggaattgttccggggcttttttttgtttgttttgagacatagtgtcttgttctgtcatccaagctggagggatctcagctcactgcaacctccgcctcctgggttcaagcaattctcctgcctcagcctcccaaggagctgggacaggcacatgccaccatacccagctaatttttgtatttttagtagagatgggatttcaccacgttggtcaggctggtcttgaactcctgacctcaggtgatacggtcccccctcagcctccaaaaatgctaggattatagacgtgagccacagcaccagaccaggggctatttttgtgacccacataggtggcccattcagcctcaaggggaaatccagggtaggaagcagcagctctgctggactgggctcagcagtcccatttgggatgtaagcctctattgcctctaagatgacccttttcctgtgggttgactgactctgagggcgatttcggaaatgttttcagcagaaatgaaggataagcatcgcacatgtccagcaatgtctttgagaatgcagtcatttgcacgtgagttctcatctttgttttctgaaacagacgtttcttttagtaagtcacaatacatgctaattttcatttctagaatggtcactggcagttctcacttttaactataagaagtcacgtggaacttagtgatttttaacaaatactaaattcatcctcactttatgttgatcttccagcaacgtttatatatttagtaattttaaaaattcctatttgatacaattaaattttatataatgtgttttgcttgaataaaatgttacatttatactttgagaactctgaccaaatctttcatacagatacaggtaaagaaatatttttctaggttgtcggagctgcgtacctcccgctgcttctccttgtggtccagcaccacctgctggtcagtggcagaactgtcctgacttcgtgaacatggaactgctaagagggaaaactgcatctcagcattttcattttttctgaatattaagtgaaaagcaagttctatttttaagaaatagcttttgctgaggagttgtgaattcctgcacctgtgtttgatgttatttgtatgcaatggattgctggccctttgttcctaagcaagagaagaccaaagatgcttccccatgacctctccggtgaggatccgcaccccccggacttgctctctgatgaagggcatgtcgttcagtgccccagcagtcagaagcagtttttgtggaactaaaactaataatgttaccctcacaaaggaaatgttcttttactaagttattgctgattcttgaatgtctgttatataactgggtcggctatcaagaaggaaggttatatttcttatcacattttaagttgttaagcaaatgtgagtttttttttaagaaatgaggctttcactgagatttgtgtgctattcataattttaggaattactgcttagaacagctgcttgggtgtatttttctacacaggtctgtacttctgccactttctccttttaaaaaaacaaaactatgcatattatgtattaaagttttcttggttttatatatcagagaataaaaacttttttgacttttgagtaaacaaaa

SEQ ID NO: 163662 - DNA, 522 bp, Homo sapiens
  Payload ID: 12229
  Gene Symbol: PARD6G
  Gene Name: par-6 family cell polarity regulator gamma
  ENST ID: ENST00000463384
  CDS Start-End: 1-186
tttgaagatttctacaagctggttgtgcacacccaccatatctccaacagtgatgtaactattggctatgcagatgtgcacggagacctgctgcccatcaacaatgatgacaacttctgcaaggcggtttctagtgcaaatcccctgctcagggtcttcatccagaaacgaggtggtgaacactgaccacctcaaggaaccaagcagccagtggtgacagttgcaagatgacggagccctgcgaccaggaacctgactcttcagctcaaatcttggtttgaaagggggacttctctgtgcccctgttgtcggcatgccatggtagagaatggatggcccacgcagctggcccctcatgagaccccagccatctcattccactgggagccacgtcaggacgaaggaggactgggaggggcgtctggctgcgtggtgtggggcctgcagtgttgtggcacacgcagcttcagccaaacatctagccctgtacctagaactaagaaataaaactataacatcaga

SEQ ID NO: 163663 - DNA, 596 bp, Homo sapiens
  Payload ID: 12229
  Gene Symbol: PARD6G
  Gene Name: par-6 family cell polarity regulator gamma
  Uniprot ID: Q9BYG4
  ENST ID: ENST00000470488
  CDS Start-End: 1-324
atgaaccgaagttttcacaagtctcagaccttgcgattctacgattgcagcgcagtggaagtcaagagcaagtttggggcggaattccgaaggttctctctggaccgtcataagcctgggaagtttgaagatttctacaagctggttgtgcacacccaccatatctccaacagtgatgtaactattggctatgcagatgtgcacggagacctgctgcccatcaacaatgatgacaacttctgcaaggcggtttctagtgcaaatcccctgctcagggtcttcatccagaaacgagatgacggagccctgcgaccaggaacctgactcttcagctcaaatcttggtttgaaagggggacttctctgtgcccctgttgtcggcatgccatggtagagaatggatggcccacgcagctggcccctcatgagaccccagccatctcattccactgggagccacgtcaggacgaaggaggactgggaggggcgtctggctgcgtggtgtggggcctgcagtgttgtggcacacgcagcttcagccaaacatctagccctgtacctagaactaagaaataaaactataacatcagatttaaa

SEQ ID NO: 163664 - DNA, 2755 bp, Homo sapiens
  Payload ID: 12230
  Gene Symbol: PALM
  Gene Name: paralemmin
  Uniprot ID: O75781
  ENST ID: ENST00000264560
  CDS Start-End: 209-1240
ccgccgccgcccggacaataaacagcagctttgcgcggggcgatgcccgagccggtgccgccgcccccgcgccgcgcagccccggccgccaggccttagcccgccccggcccccgccaggccgcgtccccctcccctcccctcccccgcgcgccacccgcgcccgcccccgcccggcaccgcggacccacccggacctcggcggggagatggaggtcctggcggcagagaccacgtcccagcaggagcggctgcaggccatcgcagagaagcggaagcggcaggcggagatcgagaacaagcgccggcagctggaggacgagcggaggcagctgcagcacctgaagtccaaggcactgcgggagcgctggctgctggaggggacgccgtcctcggcctcagagggggatgaggacctgaggaggcagatgcaggacgacgagcagaagacacggctgctggaggactcggtgtccaggttggagaaggaaattgaggtgctggagcgtggagactccgccccagccactgccaaggagaacgcggcggccccgagcccagtccgggccccagccccgagtccagccaaggaggagcgcaagacagaggtggtgatgaattcacagcagacgccggtgggcacgcccaaagacaagcgagtctccaacacgcccctgaggacggttgacggctcccccatgatgaaggcagtggtccatgctgtggacggcaccgccgagaacgggatccaccccctgagctcctccgaggtggacgaactcatccacaaagcggacgaggtcacgctgagcgaggcagggtccacggccggggcggcagagacccggggggctgtggagggggcagcccggaccacgccctcccggcgggagatcaccggtgtgcaggcacagccaggcgaggccacgtccggcccgccggggatccagcccggccaggagcccccggtcacaatgatcttcatgggttaccagaacgtggaggatgaggccgagaccaagaaggtgctgggccttcaagataccatcacggcggagctggtggtcatcgaagacgcggctgagcccaaggagcctgcaccacccaacggcagtgctgccgagcctcccacggaggccgcctccagggaagagaatcaggcggggcccgaggccaccaccagcgacccccaggacctcgacatgaagaagcaccgttgtaaatgctgctccatcatgtgagccggcccccgagaccccggcccccaccccacaccacagacacccaccagcccggcccctcccggcgcctgcccaccctccacccacagcctcacgggtccaggacttggcgtgttgttacatgttccttccgagttttctttcgctggaaagagggacaggggcccccacccgtcaccacgccccaacactccccccgaaccagagccgtgcacttgtgcctggtaggagagagacaggacagacccgcttttcccgagacaaggaccccccatgtcacggcagcttcacagacgcggctcgcgcccaccggggtcctggcgggtgggacccgcagcctccacgcggcccaggccagcctgccaccctctgggcctcctacctgtgcctttctctgaggggacaccccgccagagagggccccgggagccgggggtgggtactgaggcctgctcaggccctggaagtgaggctctatggggttccctggccaaggcgctggccccccaatctcaggcagttggggtgaggccgtgcctctttgggggctaaaggtcttgggtggaggacaggcccctctgctgtgcccctatgccctgtgtgggcccaaccagtggacaatggagtctgggggagggggaaccccggggacatgcccccacccgggaggggccggtaacccctgggctatcttctagacggggcgaaccaggggtcattgacctgccccctgcacagggcagggaccgagtgagccactccttgtcccgagctcccgcccccactgggccctccttcctcctggtgctaatttggggaccccaggggccgcccccggcctcttctccatcctgcttggaccagggtcctgggtcttcccaaccataccccgagatcaggccccacctgccagctctactgggcttggagcacgtccgggcagtggagggagggacacagcctgggacaggaagcctcttgggttggagcaggagaccctcatttgccacccagaccaatgtgagcctgcccccagccccctctcattggaagtggcaaggggcttccctcctgggggcagctacactcgtccccagaggcacattcgtgcacattctcacagacaccgtctcacacgttggctttggacaaccaggccccaacttggtccctgccctagggacctccagcctggtgcccagtgctcaggccacctcctggtccagtcaccacctgcagcctcggcagggcaggtacaggggccacctcggatgggagcctgggtccctgcctccgctctgcccctgggtggctgggaggagaggccctctcgggggtgacctgggcgtcagccgtggaaccccctcctcctccctggagtctgcctgagtccctcgagccgcgagccttcgctgaagtgcccttgctataaccccctctgcttctggtgtgtgacgaggcccccgatgttcttgattttcccagagaagcaaataaacagcgtgaacagcccca

SEQ ID NO: 163665 - DNA, 2725 bp, Homo sapiens
  Payload ID: 12230
  Gene Symbol: PALM
  Gene Name: paralemmin
  Uniprot ID: O75781
  ENST ID: ENST00000338448
  CDS Start-End: 47-1210
ccgcccccgcccggcaccgcggacccacccggacctcggcggggagatggaggtcctggcggcagagaccacgtcccagcaggagcggctgcaggccatcgcagagaagcggaagcggcaggcggagatcgagaacaagcgccggcagctggaggacgagcggaggcagctgcagcacctgaagtccaaggcactgcgggagcgctggctgctggaggggacgccgtcctcggcctcagagggggatgaggacctgaggaggcagatgcaggacgacgagcagaagacacggctgctggaggactcggtgtccaggttggagaaggaaattgaggtgctggagcgtggagactccgccccagccactgccaaggagaacgcggcggccccgagcccagtccgggccccagccccgagtccagccaaggaggagcgcaagacagaggtggtgatgaattcacagcagacgccggtgggcacgcccaaagacaagcgagtctccaacacgcccctgaggacggttgacggctcccccatgatgaaggcagccatgtactcggttgagatcactgtggagaaggacaaggtgacaggggagaccagggtgctgtccagcaccacgctgctccctcggcagccgctccctctgggcatcaaagtctacgaggacgagaccaaagtggtccatgctgtggacggcaccgccgagaacgggatccaccccctgagctcctccgaggtggacgaactcatccacaaagcggacgaggtcacgctgagcgaggcagggtccacggccggggcggcagagacccggggggctgtggagggggcagcccggaccacgccctcccggcgggagatcaccggtgtgcaggcacagccaggcgaggccacgtccggcccgccggggatccagcccggccaggagcccccggtcacaatgatcttcatgggttaccagaacgtggaggatgaggccgagaccaagaaggtgctgggccttcaagataccatcacggcggagctggtggtcatcgaagacgcggctgagcccaaggagcctgcaccacccaacggcagtgctgccgagcctcccacggaggccgcctccagggaagagaatcaggcggggcccgaggccaccaccagcgacccccaggacctcgacatgaagaagcaccgttgtaaatgctgctccatcatgtgagccggcccccgagaccccggcccccaccccacaccacagacacccaccagcccggcccctcccggcgcctgcccaccctccacccacagcctcacgggtccaggacttggcgtgttgttacatgttccttccgagttttctttcgctggaaagagggacaggggcccccacccgtcaccacgccccaacactccccccgaaccagagccgtgcacttgtgcctggtaggagagagacaggacagacccgcttttcccgagacaaggaccccccatgtcacggcagcttcacagacgcggctcgcgcccaccggggtcctggcgggtgggacccgcagcctccacgcggcccaggccagcctgccaccctctgggcctcctacctgtgcctttctctgaggggacaccccgccagagagggccccgggagccgggggtgggtactgaggcctgctcaggccctggaagtgaggctctatggggttccctggccaaggcgctggccccccaatctcaggcagttggggtgaggccgtgcctctttgggggctaaaggtcttgggtggaggacaggcccctctgctgtgcccctatgccctgtgtgggcccaaccagtggacaatggagtctgggggagggggaaccccggggacatgcccccacccgggaggggccggtaacccctgggctatcttctagacggggcgaaccaggggtcattgacctgccccctgcacagggcagggaccgagtgagccactccttgtcccgagctcccgcccccactgggccctccttcctcctggtgctaatttggggaccccaggggccgcccccggcctcttctccatcctgcttggaccagggtcctgggtcttcccaaccataccccgagatcaggccccacctgccagctctactgggcttggagcacgtccgggcagtggagggagggacacagcctgggacaggaagcctcttgggttggagcaggagaccctcatttgccacccagaccaatgtgagcctgcccccagccccctctcattggaagtggcaaggggcttccctcctgggggcagctacactcgtccccagaggcacattcgtgcacattctcacagacaccgtctcacacgttggctttggacaaccaggccccaacttggtccctgccctagggacctccagcctggtgcccagtgctcaggccacctcctggtccagtcaccacctgcagcctcggcagggcaggtacaggggccacctcggatgggagcctgggtccctgcctccgctctgcccctgggtggctgggaggagaggccctctcgggggtgacctgggcgtcagccgtggaaccccctcctcctccctggagtctgcctgagtccctcgagccgcgagccttcgctgaagtgcccttgctataaccccctctgcttctggtgtgtgacgaggcccccgatgttcttgattttcccagagaagcaaataaacagcgtgaacagcccca

SEQ ID NO: 163666 - DNA, 2272 bp, Homo sapiens
  Payload ID: 12230
  Gene Symbol: PALM
  Gene Name: paralemmin
  ENST ID: ENST00000592155
  CDS Start-End: 29-757
gtgaaaatcactgggctgaggatgaggaatgaactacaagcgagtctccaacacgcccctgaggacggttgacggctcccccatgatgaaggcagccatgtactcggttgagatcactgtggagaaggacaaggtgacaggggagaccagggtgctgtccagcaccacgctgctccctcggcagccgctccctctgggcatcaaagtctacgaggacgagaccaaagtggtccatgctgtggacggcaccgccgagaacgggatccaccccctgagctcctccgaggtggacgaactcatccacaaagcggacgaggtcacgctgagcgaggcagggtccacggccggggcggcagagacccggggggctgtggagggggcagcccggaccacgccctcccggcgggagatcaccggtgtgcaggcacagccaggcgaggccacgtccggcccgccggggatccagcccggccaggagcccccggtcacaatgatcttcatgggttaccagaacgtggaggatgaggccgagaccaagaaggtgctgggccttcaagataccatcacggcggagctggtggtcatcgaagacgcggctgagcccaaggagcctgcaccacccaacggcagtgctgccgagcctcccacggaggccgcctccagggaagagaatcaggcggggcccgaggccaccaccagcgacccccaggacctcgacatgaagaagcaccgttgtaaatgctgctccatcatgtgagccggcccccgagaccccggcccccaccccacaccacagacacccaccagcccggcccctcccggcgcctgcccaccctccacccacagcctcacgggtccaggacttggcgtgttgttacatgttccttccgagttttctttcgctggaaagagggacaggggcccccacccgtcaccacgccccaacactccccccgaaccagagccgtgcacttgtgcctggtaggagagagacaggacagacccgcttttcccgagacaaggaccccccatgtcacggcagcttcacagacgcggctcgcgcccaccggggtcctggcgggtgggacccgcagcctccacgcggcccaggccagcctgccaccctctgggcctcctacctgtgcctttctctgaggggacaccccgccagagagggccccgggagccgggggtgggtactgaggcctgctcaggccctggaagtgaggctctatggggttccctggccaaggcgctggccccccaatctcaggcagttggggtgaggccgtgcctctttgggggctaaaggtcttgggtggaggacaggcccctctgctgtgcccctatgccctgtgtgggcccaaccagtggacaatggagtctgggggagggggaaccccggggacatgcccccacccgggaggggccggtaacccctgggctatcttctagacggggcgaaccaggggtcattgacctgccccctgcacagggcagggaccgagtgagccactccttgtcccgagctcccgcccccactgggccctccttcctcctggtgctaatttggggaccccaggggccgcccccggcctcttctccatcctgcttggaccagggtcctgggtcttcccaaccataccccgagatcaggccccacctgccagctctactgggcttggagcacgtccgggcagtggagggagggacacagcctgggacaggaagcctcttgggttggagcaggagaccctcatttgccacccagaccaatgtgagcctgcccccagccccctctcattggaagtggcaaggggcttccctcctgggggcagctacactcgtccccagaggcacattcgtgcacattctcacagacaccgtctcacacgttggctttggacaaccaggccccaacttggtccctgccctagggacctccagcctggtgcccagtgctcaggccacctcctggtccagtcaccacctgcagcctcggcagggcaggtacaggggccacctcggatgggagcctgggtccctgcctccgctctgcccctgggtggctgggaggagaggccctctcgggggtgacctgggcgtcagccgtggaaccccctcctcctccctggagtctgcctgagtccctcgagccgcgagccttcgctgaagtgcccttgctataaccccctctgcttctggtgtgtgacgaggcccccgatgttcttgattttcccagagaagcaaataaacagcgtgaacagcccca

SEQ ID NO: 163667 - DNA, 2137 bp, Homo sapiens
  Payload ID: 12230
  Gene Symbol: PALM
  Gene Name: paralemmin
  ENST ID: ENST00000590161
  CDS Start-End: 26-622
aaaatcactgggctgaggatgaggaatgaactacaagcgagtctccaacacgcccctgaggacggttgacggctcccccatgatgaaggcagtggtccatgctgtggacggcaccgccgagaacgggatccaccccctgagctcctccgaggtggacgaactcatccacaaagcggacgaggtcacgctgagcgaggcagggtccacggccggggcggcagagacccggggggctgtggagggggcagcccggaccacgccctcccggcgggagatcaccggtgtgcaggcacagccaggcgaggccacgtccggcccgccggggatccagcccggccaggagcccccggtcacaatgatcttcatgggttaccagaacgtggaggatgaggccgagaccaagaaggtgctgggccttcaagataccatcacggcggagctggtggtcatcgaagacgcggctgagcccaaggagcctgcaccacccaacggcagtgctgccgagcctcccacggaggccgcctccagggaagagaatcaggcggggcccgaggccaccaccagcgacccccaggacctcgacatgaagaagcaccgttgtaaatgctgctccatcatgtgagccggcccccgagaccccggcccccaccccacaccacagacacccaccagcccggcccctcccggcgcctgcccaccctccacccacagcctcacgggtccaggacttggcgtgttgttacatgttccttccgagttttctttcgctggaaagagggacaggggcccccacccgtcaccacgccccaacactccccccgaaccagagccgtgcacttgtgcctggtaggagagagacaggacagacccgcttttcccgagacaaggaccccccatgtcacggcagcttcacagacgcggctcgcgcccaccggggtcctggcgggtgggacccgcagcctccacgcggcccaggccagcctgccaccctctgggcctcctacctgtgcctttctctgaggggacaccccgccagagagggccccgggagccgggggtgggtactgaggcctgctcaggccctggaagtgaggctctatggggttccctggccaaggcgctggccccccaatctcaggcagttggggtgaggccgtgcctctttgggggctaaaggtcttgggtggaggacaggcccctctgctgtgcccctatgccctgtgtgggcccaaccagtggacaatggagtctgggggagggggaaccccggggacatgcccccacccgggaggggccggtaacccctgggctatcttctagacggggcgaaccaggggtcattgacctgccccctgcacagggcagggaccgagtgagccactccttgtcccgagctcccgcccccactgggccctccttcctcctggtgctaatttggggaccccaggggccgcccccggcctcttctccatcctgcttggaccagggtcctgggtcttcccaaccataccccgagatcaggccccacctgccagctctactgggcttggagcacgtccgggcagtggagggagggacacagcctgggacaggaagcctcttgggttggagcaggagaccctcatttgccacccagaccaatgtgagcctgcccccagccccctctcattggaagtggcaaggggcttccctcctgggggcagctacactcgtccccagaggcacattcgtgcacattctcacagacaccgtctcacacgttggctttggacaaccaggccccaacttggtccctgccctagggacctccagcctggtgcccagtgctcaggccacctcctggtccagtcaccacctgcagcctcggcagggcaggtacaggggccacctcggatgggagcctgggtccctgcctccgctctgcccctgggtggctgggaggagaggccctctcgggggtgacctgggcgtcagccgtggaaccccctcctcctccctggagtctgcctgagtccctcgagccgcgagccttcgctgaagtgcccttgctataaccccctctgcttctggtgtgtgacgaggcccccgatgttcttgattttcccagagaagcaaataaacagcgtgaacagcccca

SEQ ID NO: 163668 - DNA, 594 bp, Homo sapiens
  Payload ID: 12230
  Gene Symbol: PALM
  Gene Name: paralemmin
  ENST ID: ENST00000586055
  CDS Start-End: 557-594
ggcgctgggctcggcgcctgcccgggcagggaccccctcgttctggctggagctgcccgggcgtgggttctggaaggacgagtgcgacgcccccatcccacacacgcccctcccgcctcggacagggcccgccctgctcgctgggtgaccttggccgttgcgtaacctctctgggcccttccaacaccaacgccccgcaccgcggaggcctctgcggggctcccgtcgggtttgggcctcatgaactcatctcctggagcaggactatctcacgcgctccagacgacgccctcgccgggccccgagccgcccacaccgccacacgccgtaaaaagcatcgcggggacgggaggcctgtgcgcgccggggtgggcgtcgggcggggggcgtggcgctccaggggctctgcgcggctgccgggagccagggaggctcggagacccagcacctgccccgggacccccagcacctgccctgggacccccagcagcaccaggaccgccgccgccctgagcttttccacgcctttgcccgggactcagctcctccgcccagcatggtcctggcggcagagaccacgtcccagcaggagcg

SEQ ID NO: 163669 - DNA, 1332 bp, Homo sapiens
  Payload ID: 12231
  Gene Symbol: PALM2
  Gene Name: paralemmin 2
  Uniprot ID: Q8IXS6
  ENST ID: ENST00000314527
  CDS Start-End: 51-1286
gcgtgtgttttttctttcctctttcccctgcctgtgtgcccttctccaggatggcagaggcggaattgcacaaggaaaggctgcaagccatagcagaaaaaagaaagaggcagactgaaatagaaggcaagcgacaacagcttgacgagcagatacttctgctgcagcattccaagtccaaagtgcttcgggagaaatggctgctgcagggcatacccgctggaactgccgaagaggaggaagccaggaggcggcagtctgaagaggatgagttcagagtcaagcaacttgaagataacattcagaggctggagcaagaaatacaaacgctagaaagtgaagagtcccagatatctgccaaagagcaaatcatcctagagaaactgaaggaaacagaaaaatccttcaaggactttcagaagggtttctccagtacggatggagatgcagtaaattacatttcctcccagcttcccgacctgccaatcctctgttcacgaacagcagaaccatcacctgggcaggacgggaccagcagagcggctgctgtgtacgccatggaaattaatgtggagaaagacaaacaaacaggagagaccaagattctctctacatctaccattggcccagagggggtccatcagaaaggagtcaaagtctatgatgatggtaccaaagtagtgtatgaggtgcgctcaggaggcaccgtagtagaaaatggagtgcacaaattaagcacaaaggatgtagaagagcttattcagaaggctggacaatcaagcttaggaggagggcacgtgtctgaaaggactgtgattgcagatgggagcctcagccatcccaaggaacacatgctctgcaaagaagctaagttagaaatggtacataagtctaggaaagaccattcttccgggaacccagggcagcaggcccaagcccccagcgctgcagggccggaggcaaacttggatcagcccgtcaccatgatttttatgggctaccaaaatatcgaggatgaagaggagacgaaaaaggtgctaggctatgatgaaaccatcaaggctgaattggtcctcattgatgaagatgatgagaagtcattgagggagaagacagtgacggacgtgtccactattgacgggaacgcggctgagcttgtgtccgggaggccggtctcagacaccacagagccctcatccccagaagggaaggaagagagcctagctacagagccagccccaggtacccaaaagaaaaagcgctgtcaatgctgtgttgtcatgtgaccacttctttcttctcctttcttctgggcagcctgtactctccacc

SEQ ID NO: 163670 - DNA, 4492 bp, Homo sapiens
  Payload ID: 12231
  Gene Symbol: PALM2
  Gene Name: paralemmin 2
  Uniprot ID: Q8IXS6
  ENST ID: ENST00000374531
  CDS Start-End: 75-1214
gtgcactcggctccgggagaggcgagcagcgccggtgagccccgcagcagcgcacccggccgcggagccccgcgatggagatggcagaggcggaattgcacaaggaaaggctgcaagccatagcagaaaaaagaaagaggcagactgaaatagaaggcaagcgacaacagcttgacgagcagatacttctgctgcagcattccaagtccaaagtgcttcgggagaaatggctgctgcagggcatacccgctggaactgccgaagaggaggaagccaggaggcggcagtctgaagaggatgagttcagagtcaagcaacttgaagataacattcagaggctggagcaagaaatacaaacgctagaaagtgaagagtcccagatatctgccaaagagcaaatcatcctagagaaactgaaggaaacagaaaaatccttcaaggactttcagaagggtttctccagtacggatggagctgtgtacgccatggaaattaatgtggagaaagacaaacaaacaggagagaccaagattctctctacatctaccattggcccagagggggtccatcagaaaggagtcaaagtctatgatgatggtaccaaagtagtgtatgaggtgcgctcaggaggcaccgtagtagaaaatggagtgcacaaattaagcacaaaggatgtagaagagcttattcagaaggctggacaatcaagcttaggaggagggcacgtgtctgaaaggactgtgattgcagatgggagcctcagccatcccaaggaacacatgctctgcaaagaagctaagttagaaatggtacataagtctaggaaagaccattcttccgggaacccagggcagcaggcccaagcccccagcgctgcagggccggaggcaaacttggatcagcccgtcaccatgatttttatgggctaccaaaatatcgaggatgaagaggagacgaaaaaggtgctaggctatgatgaaaccatcaaggctgaattggtcctcattgatgaagatgatgagaagtcattgagggagaagacagtgacggacgtgtccactattgacgggaacgcggctgagcttgtgtccgggaggccggtctcagacaccacagagccctcatccccagaagggaaggaagagagcctagctacagagccagccccaggtacccaaaagaaaaagcgctgtcaatgctgtgttgtcatgtgaccacttctttcttctcctttcttctgggcagcctgtactctccaccactcacgtagacctcactgtaccactaactgcaatactgtgaactggaagcaaacacctgccttgccttgcagttgaattgctttgatctctctcattttttttccttttcctcacctgagagacaacgtgcatgtgtgtgcttcattctctccaagaacttgcttttcctctaaacctttccttgtgtcttcaagagtgaatcacttccttcctgctcgattggaatggactcttcgtatcagccagtgatatggtagccttaactcacttgactggaattgaacccattggcactgggggtttcattttgtagtgtgttcctgtaacgtagtcacacactgccatgtctctggtttctcacttgcctcctttgctgtggatctttgtttttatatcttgtgtggcaaaatgctgttggctctagccggttgctagtgtagccaaaagtggaccttacttagtctgtccgatctagggtgatgctttttgctgccttacataagcttccagattacagtattgtgcattcatggctttctttctgttaaaactgaaatgaagtcaatgtagaagaacccagagcttgtcacagctgaaatgtagggactgattccataacctgcccatcagcggttgtctctctttctatggtttaaccgatgaaccctttatataagaagcaccattttaaaatttctaaggacatgaaacaaacattgtttgaagcatcagtagcaattgatctccaaacttaggcaaattcacaagccttgtttctattctcttaaaaaaatgtaaatttttatattgtttcttttttctggatattttctggtcatgttaatctattttcaatgaggagatcatcttgagaagtatctttgcagtgaccatatttctaaaacagtctgtccaacctacaatggttgccatgatgctcccacttcatcatggatggtgctgtaatgcattaactgttcatctcctccccagttgattacaaagccttgcatccatactcttttctttctggccccatgagaaagagaatgttttaggtaacttcaacttgtaggtttatctgcccttcaaaaaaaaaaactttaaaaaacttttaaaaattaagaaagacctatcttctcaatgttaagcacttaatttcataacaaatattaagtggcacatagctgagcttcttagggcattgttttgtttttagcttctggagattccagaagagcaaagaatattttttatctagaacacaatgaacagtttttgaaataccttctcagcactcccccaaagcaaaaagccacatatgtagtaaaaccaaagggaaacaatttaataaaataacaatagtatagtaatgaaataaagatataacatgattactggttttaataagagttatcttaactttaagttatttgcccatttatagcattgttatgaattattcataaaattatgtcccacagtatatagttttgaaaaaacatatgatatactacatccagtctaacttctgtggaaagtagatcagaaaaaataagatagtcttgagagaattttattatagaagctgtctaatttgacctattttgcttgctcagtgctaaatctattgcttttttttaatctcctggcttgaaattatatttacttcaataggaaaggtaaaaacatcagtttttacttttcaaagttaattttctgaaataattgcattttaatgagcacaaaatgggtcattttatttttattatactcatcttgtttacacctatacataaacagaaaacgttaaagaagagaaaaataaaggagctaagttctgctgttgaagattatttcatccaaggcttggttttgaataactgagggaaatatctctaaatctcaagttcatcaaagcagctgcaatggaataaaattgctattttatcgagaaacctggtttggatgcttataaattccactactctcagcttcattttcctgagtacgtggtcactgaagcatcatttagacattacataaactggcatgcagataaacctatttacatagagggagaaaacagtttcaatgtcttggacaatctgttattttaatgatttacttaagaaagaaacaatctgaaagcttaccatagcttatcttttctactcacttggagattcaagctattcaatgtgagttttaaaaagttaagcacagttagtgagtgaaatggtagaatgtagaacctttaagcttgctggttgataaacagaatcaatcttccaggacagataattccctgaagggacctatccttgcataagtgaactagttactcatacagaaaatgatctgcacatcttactacaacactacacacaagaactaaaagattaatgattatctgtattctcttcactaattactattatgggggaataatgattagcaaattatatgaattcgagttctctctatacttttattagtaaagcttatcatttaatggactgaagtaagatgtgttacctttattcgagctatttgtagccacactaaatgaaggtgtgtttgaatatggcgcatatatttgcatatgtcccatcattttcttgtcataatggggaattcaggcttagccagtacttctatgggatgagacctataatcccacctatagcagcaagtaactacccttcatgatgatagtgtacatggagctgtgattatgaacatgctgcctttcctgctgccattggcattctctctgtaaattttattatgtgtggtatcacactctccaaaaatgcagggtatttggttacataaccaaactaattaaagaatcagtaatgaaattgcaaaaccatgatcttttttgagctaatgattagttgggctttcctttaaaataatataatcaggccgagtgcagcggctcacacctgtaatctcggcactttggaagtccgcggcgggtggttcacctgaggtcgggagttcaagaccagcctgaccaacatggagaaacccccatctctactaaaaaaaaaatacaaaattagccaggcgtgatggcgcatgcctgtaatcccagctactcgggagactgaggcaggagaatcgcttgaacctgggaggcaggggttgcaatgagccgagatgtgcactccagcctgggcaacaaagagcgaaactccatctcaaaaaaaaaaaaaaaa

SEQ ID NO: 163671 - DNA, 1418 bp, Homo sapiens
  Payload ID: 12231
  Gene Symbol: PALM2
  Gene Name: paralemmin 2
  ENST ID: ENST00000483909
  CDS Start-End: 87-1220
ccccggggtgcccatcagtttccttgggtgactacagcgtgtgttttttctttcctctttcccctgcctgtgtgcccttctccaggatggcagaggcggaattgcacaaggaaaggctgcaagccatagcagaaaaaagaaagaggcagactgaaatagaaggcaagcgacaacagcttgacgagcagatacttctgctgcagcattccaagtccaaagtgcttcgggagaaatggctgctgcagggcatacccgctggaactgccgaagaggaggaagccaggaggcggcagtctgaagaggatgagttcagagtcaagcaacttgaagataacattcagaggctggagcaagaaatacaaacgctagaaagtgaagagtcccagatatctgccaaagagcaaatcatcctagagaaactgaaggaaacagaaaaatccttcaaggactttcagaagggtttctccagtacggatggagctgtgtacgccatggaaattaatgtggagaaagacaaacaaacaggagagaccaagattctctctacatctaccattggcccagagggggtccatcagaaaggagtcaaagtctatgatgatggtaccaaagtagtgtatgaggtgcgctcaggaggcaccgtagtagaaaatggagtgcacaaattaagcacaaaggatgtagaagagcttattcagaaggctggacaatcaagcttaggaggagggcacgtgtctgaaaggactgtgattgcagatgggagcctcagccatcccaaggaacacatgctctgcaaagaagctaagttagaaatggtacataagtctaggaaagaccattcttccgggaacccagggcagcaggcccaagcccccagcgctgcagggccggaggcaaacttggatcagcccgtcaccatgatttttatgggctaccaaaatatcgaggatgaagaggagacgaaaaaggtgctaggctatgatgaaaccatcaaggctgaattggtcctcattgatgaagatgatgagaagtcattgagggagaagacagtgacggacgtgtccactattgacgggaacgcggctgagcttgtgtccgggaggccggtctcagacaccacagagccctcatccccagaagggaaggaagagagcctagctacagagccagccccaggtacccaaaagaaaaagcgctgtcaatgctgtgttgtcatgtgaccacttctttcttctcctttcttctgggcagcctgtactctccaccactcacgtagacctcactgtaccactaactgcaatactgtgaactggaagcaaacacctgccttgccttgcagttgaattgctttgatctctctcattttttttccttttcctcacctgagagacaacgtgcatgtgtgtgcttcattctct

SEQ ID NO: 163672 - DNA, 583 bp, Homo sapiens
  Payload ID: 12231
  Gene Symbol: PALM2
  Gene Name: paralemmin 2
  ENST ID: ENST00000497711
  CDS Start-End: 42-583
atcaaataaatctcacccagaatttcccactgtcttattctatggaaaaaagaaagaggcagactgaaatagaaggcaagcgacaacagcttgacgagcagatacttctgctgcagcattccaagtccaaagtgcttcgggagaaatggctgctgcagggcatacccgctggaactgccgaagaggaggaagccaggaggcggcagtctgaagaggatgagttcagagtcaagcaacttgaagataacattcagaggctggagcaagaaatacaaacgctagaaagtgaagagtcccagatatctgccaaagagcaaatcatcctagagaaactgaaggaaacagaaaaatccttcaaggactttcagaagggtttctccagtacggatggagatgcagtaaattacatttcctcccagcttcccgacctgccaatcctctgttcacgaacagcagaaccatcacctgggcaggacgggaccagcagagcggctgctgtgtacgccatggaaattaatgtggagaaagacaaacaaacaggagagaccaagattctctctacatctaccattggcccagaggg

SEQ ID NO: 163673 - DNA, 2262 bp, Homo sapiens
  Payload ID: 12232
  Gene Symbol: PALM3
  Gene Name: paralemmin 3
  Uniprot ID: A6NDB9
  ENST ID: ENST00000340790
  CDS Start-End: 1-2022
atggcggagagctccctctaccggcagcggctagaagtcatcgctgagaagcggcggctgcaggaggagatccgcgccgcgcgccgggaggtggaggaggagaaactccgcgtggagcgtctcaagaggaagtctctccgggaacgttggctaatggatggggcagctgcagtgccagagccatccgaagaccccacctcgaaggacccccagtcacccgagggccaggctcaggcccgaatccggaacctggaagacagtttgttcacactccagtcccagctgcaactgttgcaaagtgcttccacaggtgcccagcacaagccctcaggcaggcccagctggcgcagacagggtcaccgtcctctctcccagtccattgtcgaggcaggttctgtaggccagactgatctgaacaagagagcctccctgccggctggactagtgggcacgcctccagagtccccctctgagcccagggaggatgtcttggggtttctgccaggcccgaggcaggtccccggggcagcaggagactcctcagaagccaatggcccatgccccagccccatccccactccagagcaggggctaagtcagagggcagtgccatccgaagggcgggtgggtgaggccaaaggagggggcgtggtgagtgtggtgtgggaagggctgagggccacagaggactgtgccacaggggccacgggccccgagctggaggctaaggtggaggaagtggtgctggaagccatcggagacaggaagggagctggtagcctggagctcccggcctgggtgaaggaggacaggggcatcgtggaggtggtctgggagggggtgggtggcagtgatgcagaggccatgggggagataggcagggtccctgaggtcgtgcagactagctcgcctaggctccaggagagattagaggcagcagcttccatagaaggggaagatgtgccccagggcagccctgagggtgatgggcagggaggctctggaggagaggagggatccttcatttgggtggagagagtgaccctcagtgaagagtgggaggagctgctggtggaggggttggaagggcccgaggtggcagggagggagagaggagatgaaagcccgctgggggccgagggggccaagacgggaggaggcgaggagacctgggaggcagagaagagaaaagcggaagaatccatgggaataggaagtgaggaaaagccagggacagggagggatgaagcggagatgtcaccagtggtagagaggaaaggaggagagaagaagttggagctggagagcagaggaagtgcagaaaagctgggaacagagagggaaggaggtgaggaaccactgggcatagagagaaaagttgagggacatttgagggcagagaaggaaggagatgaggaaaagcgaggggcagaggaggaggaggtagaagaaccattgggagtagagaagaaaggaggtgaggaagagccagaggcaaccaaagaaccactggaggcagagagaaagggaggggaggagacactggaggcagagaaaaggggaggtgaggaatcattggagacagagaagacccaagggacggagggagatctgaatctagaacaagggtctagggaaggaagtgaatcccaggcagaggagatgaatgaggcagggcctccccttgaggctaacacggagacaaggccagagaaggaaggaccccagccccaggagaagccagtaggagccctggaggaggaaggagtgaagccccaaaccgctgctgagggccaaggccccttgggggatgccacacctcttctggcagagaccccagccccagagcagcccgccgaatgccagccactgcttcagggggaggggcccagcgccaaccccagtgcccaccctgtgcccacctacgcgcctgcccggcagcctgagccatctgcccccaccgagggtgaagaggcaagtggccctaagcaaaagacgtgccagtgttgtgcggtcatgtgaacccatgcccctccaccccatgtccagctcctctcacagctacctcggcctcttggcacccagaagagggtcccaggcacagacagggaccacaggactggccatggcacctgggagccagctagcctgcacgtccacctaaacctgggcttccagaccccttgcccactgcctgtaaccctggcctccttctgcgatgaagcctttatacttgaaaataaaatgtgaaagcactcaaga

SEQ ID NO: 163674 - DNA, 855 bp, Homo sapiens
  Payload ID: 12232
  Gene Symbol: PALM3
  Gene Name: paralemmin 3
  ENST ID: ENST00000589048
  CDS Start-End: 277-855
ccccgccctgggtgcagacccgcgctgggccacccccgccgggctcgctgcctcgggagccccgggagctccggtgagccccgcggaggagggaggggaaagggagggaagaggaggtggtggaggccgcgcccggccggcgggcagctccgggtcctctgtgcgcaggagaagcggcggctgcaggaggagatccgcgccgcgcgccgggaggtggaggaggagaaactccgcgtggagcgtctcaagaggaagtctctccgggaacgttggctaatggatggggcagctgcagtgccagagccatccgaagaccccacctcgaaggacccccagtcacccgagggccaggctcaggcccgaatccggaacctggaagacagtttgttcacactccagtcccagctgcaactgttgcaaagtgcttccacaggtgcccagcacaagccctcaggcaggcccagctggcgcagacagggtcaccgtcctctctcccagtccattgtcgaggcaggttctgtaggccagactgatctgaacaagagagcctccctgccggctggactagtgggcacgcctccagagtccccctctgagcccagggaggatgtcttggggtttctgccaggcccgaggcaggtccccggggcagcaggagactcctcagaagccaatggcccatgccccagccccatccccactccagagcaggggctaagtcagagggcagtgccatccgaagggcgggtgggtgaggccaaaggagggggcgtggtgagtgtggtgtgggaagggctgagggccacagaggactgtgccacaggggccacgggccccgagctggaggctaaggtg

SEQ ID NO: 163675 - DNA, 2590 bp, Homo sapiens
  Payload ID: 12233
  Gene Symbol: PNMA1
  Gene Name: paraneoplastic Ma antigen 1
  Uniprot ID: Q8ND90
  ENST ID: ENST00000316836
  CDS Start-End: 734-1795
gcggcgggttgcgggtaggactggacgccagagcagccgcgcagcgcctgaaccgctgcgggccgccgcggccgccccttcccaccctcgcctctgctgtctccagcctcgcttctccgactttcctgctcctctgctgccttcgtttctggtcctcggccgtcctcgccgcccgcccagaggagtccccgcgcccgccaagaagccgctttccgctggcccgcagccgccgcgacttcggcacagtttctccctctggctagtctcccaaacggccgctcctcgcccgcgggaagaccaggctgcgaccgcgaacgcccgatcctctccaggagccgcagcgagcgcccggcggccacgccccgcgaccacaccccggcggctctcggcccagcgcgcctgccttcgccgcccgccgtcgctcctcgcccgctgcacgacgacgcgacgcccctgctgcaggcggcggacccgaccggacccagacccagacgcaagatggcgacggccgcgtgactgcctcagcgtccccgagctcggctccgagtgcacctacggactgactgtgggggcagagaagggcgagatcaggactctgtctttgttaatcgtgactgcatgaaggtcgcctccctcgggcctacttggtgggagtgtctggtattgttctaaggccaggagcacggtgagccacagtctgttggtagaatttggcgtcttgatagttgagaaaatggcgatgacactgttggaagactggtgccgggggatggatgtgaactcccagagagctctgttagtctggggcatcccagtgaactgtgatgaggctgaaatcgaagagaccctccaggctgcgatgccccaggtctcctaccgaatgcttgggagaatgttctggagggaagaaaatgcgaaagcagccttattagagctcactggcgctgtagattacgccgcgatccccagggagatgccgggcaaaggaggggtctggaaagtgttatttaagcccccaacttctgatgctgaatttttagaaagattgcacctcttcctagctagagaggggtggaccgtgcaagatgttgcccgtgtccttgggtttcagaaccctactccgaccccgggcccagagatgccagcagagatgctaaactatattttggataatgttattcagcctcttgttgagtccatatggtacaagaggctgacacttttctcggggagggacatcccagggcctggagaggaaacctttgatccctggctggagcacactaatgaggtcctagaggagtggcaggtgtccgatgtagaaaagaggcggcggttgatggagagtcttagaggccccgccgctgatgttattcgcatccttaagtccaacaaccccgcgataaccactgccgaatgcctgaaggcgcttgagcaggtgtttgggagcgttgagagctctagggatgcccagatcaaatttctgaacacttatcagaacccgggagaaaaattgtctgcttatgtcattcgtctggagcctctgctacagaaggtggtagagaagggggccattgataaagataatgtgaaccaggcccgcctagagcaggtcattgccggggccaaccacagcggggccatccgaaggcagctgtggcttaccggggctggggaagggccagccccaaacctctttcagttgctggtgcagatccgtgaggaggaagccaaggaggaggaggaggaggctgaggccacccttctgcagttaggcctggaagggcacttctgagtgccaggaaaggcagctttagtgcagacctagatcacagctacttttcttgtccctgtggggtcttacagatgtgtctctgagtagtaaaggcttagccttgttctgttttgttgttttttggaggggaaggttagtcaggcctgagtattcatgtaacattctaaaattgtgccagcgagcaccgtgaacgactgcaatgcaagcgggtcttgctggctaaaatgccaggtaaagggttggttggacacagcgcttagtgcacgctgtcatcatggacatcataatcagttgtgaaaaacacgcgaacctatgacacttcttattccacactgaatgtgaaattgcatgttcagatgtttactacgaggcctggctcacaggaagtgttcagtaaaagtatgcactgttagattactgataacgcggatagatttttgtttaccataaattgttccagatttatattaatggaaggaagtgtgcatttattagctattactcaactttacaatgcaaacatcttatttctcatctttaaacatgtcgaccagtttaattgaaaagtattctgagactgcaaaatggggtgttaaaaaatactgcagttacggagctgtgtaaaccagtttctcattgcataagatacagatgtaaattgcatggagaggttgatatgcacctgtacagtaattcactcccccatttcacatctttgtcagagaatagttcttgttcatactgagtgttctaaatttgaagttatatatacaaattaaaatattttaaaaattc

SEQ ID NO: 163676 - DNA, 4965 bp, Homo sapiens
  Payload ID: 12234
  Gene Symbol: PNMA2
  Gene Name: paraneoplastic Ma antigen 2
  Uniprot ID: Q9UL42
  ENST ID: ENST00000522362
  CDS Start-End: 896-1990
gctcggggaagcggcaaagttggatctgggagggcgtccgctgcggctgcgggagccgaaaggctgccagttcccggcagcgctgggaggagggaggcgcgggcggggcgcggcgccggggaggggagcggtgctcaggggagggctggaggggagggaaggagagagagaggggagggcggcaccgcccctagccccgcgctccggaagtgaagcggccagaccaccagctaatggatgcggagcggagggcccgctgaccgctctccgcgcctggagcagcttggcttggctggagctaagagccagacacaccactgtgtggaggtgggtgatgtcttcctgtgctaaaaggtgaataaataagctcctcacctctcgcggaacactcgggaacacatcaacaggggtccaagccgccctgctgggaggcttctcttcaagagttctgggtcccagagtggaaggcattttcccatcaactggagagagacgaaacatcagagaccaggaggctgtggagaaagcagctgtcccaggtgcctcaactatcagagaagggtcagcgtcacgtggctgccagcatctttgagaaaatcactggcaatcggacttcagagctgcgggcacaggtgtggttagaactgagatacgacctgcccacctgggtcaggcctaaagacaagaagtcctgagttcttgccactgagtaggccagggtcatttgtccagaaaactttgtgactgtctttgagtgacctagtctgggacccattcattggtgggttctaaggttagaagctcatccaggatattttcaatattaagtcagtgcatagctgcaccactaacaaattggtgcctgtagagtcagagtgggtcaattcttaggacaatggcgctggcactgttagaggactggtgcaggataatgagtgtggatgagcagaagtcactgatggttacggggataccggcggactttgaggaggctgagattcaggaggtccttcaggagactttaaagtctctgggcaggtatagactgcttggcaagatattccggaagcaggagaatgccaatgctgtcttactagagcttctggaagatactgatgtctcggccattcccagtgaggtccagggaaaggggggtgtctggaaggtgatctttaagacccctaatcaggacactgagtttcttgaaagattgaacctgtttctagaaaaagaggggcagacggtctcgggtatgtttcgagccctggggcaggagggcgtgtctccagccacagtgccctgcatctcaccagaattactggcccatttgttgggacaggcaatggcacatgcgcctcagcccctgctacccatgagataccggaaactgcgagtattctcagggagtgctgtcccagccccagaggaagagtcctttgaggtctggttggaacaggccacggagatagtcaaagagtggccagtaacagaggcagaaaagaaaaggtggctggcggaaagcctgcggggccctgccctggacctcatgcacatagtgcaggcagacaacccgtccatcagtgtagaagagtgtttggaggcctttaagcaagtgtttgggagcctagagagccgcaggacagcccaggtgaggtatctgaagacctatcaggaggaaggagagaaggtctcagcctatgtgttacggctagaaaccctgctccggagagcggtggagaaacgcgccatccctcggcgtattgcggaccaggtccgcctggagcaggtcatggctggggccactcttaaccagatgctgtggtgccggcttagggagctgaaggatcagggcccgccccccagcttccttgagctaatgaaggtaatacgggaagaagaggaggaagaggcctcctttgagaatgagagtatcgaagagccagaggaacgagatggctatggccgctggaatcatgagggagacgactgaaaaccacctgggggcaggacccacagccagtgggctaagacctttaaaaaatttttttctttaatgtatgggactgaaatcaaaccatgaaagccaattattgaccttccttccttccttccttccctcccttcctccttctctccttctctcctcctctctcctctcctctcctctctttccttccttccttccttttttctttttctctttcttctttatttcttgggtctcactctcatcacccaggctagagtgcagtggcacaaaaatctcggctcactgcagccttgacttcccaggctcaggctcaggtgatcctcacaccttagcctcccaagtacctgggactacaggcacgcaccaccatgcctagctattcttttgtatttttggtagagacagggttttgctgtgttgctcaggctggtctggaacccctaggctcaaatgatgtgcccaactcggcctcccaaagtgctgggattacaggcatgaaccgccatgcctggcccttgatttttctttttaagaaaaaaatatctaggagtttcttagaccctatgtagattattaatgaacaaaagattaaactccaaatattaaatagtaagcctgaaggaatctgaaacacttgtacttccaattttctttaaataatcccaaatagaccagaattggcccataccatagaagaaagaattggcagtcaaaaaaaaaaataccttttgtaatgtttgaaaaataaagctgtttgacttgtcaggtgttttcctttctcaaatcagcaaattctctctgagtgcctggctttgtgagacactgtacaaggagttacaagactacagctataacctgcagttgagcagttataaacctacaaaatgggccctgccctcagagaggttccagtctagatgaggagctgatctagacaggtaaaaggctaactaaccctttgtgtaaataagttcatcaccccagtaaaagtgtcatcacccagtgaataggaccacctctgcctgcagatttttgttgttgttgttgtcattgttgttgttgttttaacctgggaagtgttcttcctgcctttctgctaggtgtcagatagatggtcccagagctaggtgctgtgtcaggccctgaagacacagatgactcaacctaagctttactttccagaggtccacagcctgagaggtgtccccaaagaaagggggacatgaggggactgcatgcttgagagcagggttgtttagggcaggtttggatttagtgagcaggctggtttgcttagagaaggcttttagtggcaacaaaggatgaagaggagagaaaaggaactcacatttattgagggcctactgtgtgcaaagtgtttcatgtatatctcattgaatgtatacagccaccctgttgtggtataattttgctctttataaagagaaagaccgaagctcagatgagttaagtggtctcctcaacaccaaaatgccaagaagtgatggagcctagacagaagcccagaactttctgactcacactagtccatcctctaccatcacgatgactttcaaattgtgctctgcagttctgcagattttctagcagtgccatctccaaaatgtgttttaaactctttatttttttaattattattagtattattttgagactgagtcttgctctatcacccaggctggagtgcagtggtgcaatctcagctcactgcaacctccgcctcccaggttcaagcgatttcgtgcctcagcctcccgagtagctgggattacaggcacccaccaccacgcccagctaatttttgtatttttagtagaaatggggtttcaccatgttggccaggctggtctcgaactcctgacctcaagtgatccactcacctcggcctcccaaagtgctgggattacaggtgtgagccaccatgcctgggctaaactctttaagtctctagtaaatgcagctagattcaaatgggctgataaccaaattttaacacatcagcattcaccaccaggtttacttttattttcagattggctcattttgtgcagaccttagagcaaagtttcctttatggtatctgtgtacgtatccaaacttcttttaattgttcacagattttaaaagcggtagcaccacatggttgtgtagatcagacctgtgtatttagatcagacctgtgtatcacgtaagtgtgtgagtgcagtgcagatgagcaccatttagttatatgtgctaggcaaatctccaacacagttgatgtgtagtcttgtggtagatttgtgcatactgtaagcaaattgcttagcttctctagacatcagtttccacatctgaaaaataagaagatgagagtacacggttgttatgaacaaatgacttaatgctttttaagcacgttgcatgacatctggaacacagaaagccctcaatacattgaagctcttaggattttcacgatgttcctgtctgctcaatgcatgctttctttattgttctgacagttgtgtggtaacaagctaatatgcttccagttgacttccagtctaccctggtgttagaaaccgtttcatctcttattgtaaatttgagtgcttgttgttttttatatttgtgatgactcttccagcagttgttgacaattgttagaggtttgacttttaaataattacttattttttctgattgtggttcagtttaactgaagaatatcctgagattgtaagaaaagcattttttaaaaggtatcacttgtgatcatttatctttctaaattctatttttaatactgttccaccaaagtgatgcagtggttaccatgacaccctaatttcatgtgtttttgtatttatgaaaatagtttcattgtcatttattggcggtatacaaagtaaaatgttataaatgtgaagttataaaataaatatatgctaataaaatcctgagtttttctg

SEQ ID NO: 163677 - DNA, 3158 bp, Homo sapiens
  Payload ID: 12235
  Gene Symbol: PNMA3
  Gene Name: paraneoplastic Ma antigen 3
  Uniprot ID: Q9UL41
  ENST ID: ENST00000424805
  CDS Start-End: 264-1655
gtgctgcgcgagcgagggagagccacagtctgagcgaacgtccgcgctgggagccaggggtgcccgacccccgtccgccgccgccgccgccgccgcgcatagcccccggagagccctctggggaccccgaccagaagggaccttgccctgggagaaggctgtggagacctgggccttctgcgatcaccctaggagttgatccagatatgtgcctcacgccctgatcactccccccaaattagtatccgcagagattcgaggacatgccgttgaccttgttacaggactggtgtcggggggaacacctgaacacccggaggtgcatgctcatcctggggatccccgaggactgtggcgaggatgagtttgaggagacactccaggaggcttgcaggcacctgggcagatacagggtgattggcaggatgtttaggagggaggagaacgcccaggcgattctactggagctggcacaagatatcgactatgctttgctcccaagggaaataccaggaaagggggggccctgggaagtgattgtaaaaccccgtaactcagatggggaatttctcaacagactgaaccgcttcttagaggaggagaggcggaccgtgtcagatatgaaccgagtcctcgggtcggacaccaattgttcggctccaagagtgactatatcaccagagttctggacctgggcccagactctgggggcagcagtgcagcctctgctagaacaaatgttgtaccgagaactaagagtgttttctgggaacaccatatccatcccaggtgcactggcctttgatgcctggcttgagcacaccactgagatgctacagatgtggcaggtgcccgagggggaaaagaggcggaggctgatggaatgcttacggggccctgctctccaggtggtcagtgggctccgggccagcaatgcttccataactgtggaggagtgcctggctgccttgcagcaggtgttcggacctgtggagagccataaaattgcccaggtgaagttgtgtaaagcctatcaggaggcaggagagaaagtatctagctttgtgttacgtttggaacccctgctccaaagagctgtagaaaacaatgtggtatcacgtagaaacgtgaatcagactcgcctgaaacgagtcttaagtggggccacccttcctgacaaactccgagataagcttaagctgatgaaacagcgaaggaagcctcctggtttcctggccctggtgaagctcctgcgtgaggaggaggaatgggaggccactttaggtccagatagggagagtctggaggggctggaagtagccccaaggccacctgccaggatcactggggttggggcagtacctctccctgcctctggcaacagttttgatgcgaggccttcccagggctaccggcgccggaggggcagaggccaacaccgaaggggtggtgtggcaagggctggctctcgaggctcaagaaaacggaaacgccacacattctgctatagctgtggggaagacggccacatcagggtacagtgcatcaacccctccaacctgctcttggtaaagcagaagaaacaggctgcagttgagtcgggaaacgggaactgggcttgggacaagagccatcccaagtccaaggccaagtaggctcgggagaacagggcaacatttcctaccacaggccaaggagacaaaagagatattggaaggaggggaaagagaagcccagacaaacagcagatgagttgagtggggcagagggacagggcagccagaccaaggccaagccttctcacccttggccagctggaagggacttcagcaaccaagaccacctggcaacaggctcagtgggggtcaggtccaggtccccgaagaggtgctggagaggaaagcagggagccactgcatccagcacatggggtgcctgggcctcagatggggaccccaaagaagcagaagctgaagaagggccaccagactcctggagagatcaagcaaggagaacctggggctgccatggccaaagcaactcaacagatgccaatgccaattccaaggccagccacaaccctgccaccttggggaatccagcctggaggcatcccctaagcagccagccatggcctgggtggaggcacctgaagacgtctgtcccaaactcccccagccctgagctgggagatgacagggggaaagaggccctctcaagggtgccagatgcctgggtctcccaagaggggtcccccaactcactgttcccgggacaggctgccccctgttccaggaagctcatcctcacctgtgtaggcccctgtagtgacccacgcgtccagcagacgcccacccaccgctagccgttgttcctgtgcaaagtagtgtgctatgcacccacccaggtggccgcctctgggcccaaggcacatgctgtgagcttcctgtgagcccaggctctgctcactgctgtcccgcgtcatgagcaccacctctgctttccctgtgtagatctaggccagtggctgcttgttcttgtggagctgtgtgtgttcttctctgagcagctcctccccggagtcccccagcacagtcccaggagatgacaggaaggaagcaccagggcaaggcggacgctcaccctgtgaccacgatggtgaccgtgactgtgggaggaagaactggacccaggacggagcggggctgccctgcctgaggctcccgaggagctttgtgctttggtgttccacccctgttgttactcatgactcagtttccttaacctggtagggtgttccctgctgtgttttccagtgtcctgtgactgtcctgtgcgggccatagggcagggccctgccccagcagatgggcttgggaggggactccctaaagccagtggacactgccagagtctaccttcctggcaagaggcagaccccggggccctcaggaaggagggagttggcagcgggggctgcagcaggagtaggagcagatgaggcgtcttgccaggaacctcaggaggagggggcccgggacctgtgtgggacctgtgtcctgtggtggccgtttgcagtttctctctgtgttgtgattcccttctcttcaacgttttcagtacgtgtttctcttcaataaacttcattcagtgttcca

SEQ ID NO: 163678 - DNA, 1432 bp, Homo sapiens
  Payload ID: 12235
  Gene Symbol: PNMA3
  Gene Name: paraneoplastic Ma antigen 3
  Uniprot ID: Q9UL41
  ENST ID: ENST00000593810
  CDS Start-End: 21-1412
atccgcagagattcgaggacatgccgttgaccttgttacaggactggtgtcggggggaacacctgaacacccggaggtgcatgctcatcctggggatccccgaggactgtggcgaggatgagtttgaggagacactccaggaggcttgcaggcacctgggcagatacagggtgattggcaggatgtttaggagggaggagaacgcccaggcgattctactggagctggcacaagatatcgactatgctttgctcccaagggaaataccaggaaagggggggccctgggaagtgattgtaaaaccccgtaactcagatggggaatttctcaacagactgaaccgcttcttagaggaggagaggcggaccgtgtcagatatgaaccgagtcctcgggtcggacaccaattgttcggctccaagagtgactatatcaccagagttctggacctgggcccagactctgggggcagcagtgcagcctctgctagaacaaatgttgtaccgagaactaagagtgttttctgggaacaccatatccatcccaggtgcactggcctttgatgcctggcttgagcacaccactgagatgctacagatgtggcaggtgcccgagggggaaaagaggcggaggctgatggaatgcttacggggccctgctctccaggtggtcagtgggctccgggccagcaatgcttccataactgtggaggagtgcctggctgccttgcagcaggtgttcggacctgtggagagccataaaattgcccaggtgaagttgtgtaaagcctatcaggaggcaggagagaaagtatctagctttgtgttacgtttggaacccctgctccaaagagctgtagaaaacaatgtggtatcacgtagaaacgtgaatcagactcgcctgaaacgagtcttaagtggggccacccttcctgacaaactccgagataagcttaagctgatgaaacagcgaaggaagcctcctggtttcctggccctggtgaagctcctgcgtgaggaggaggaatgggaggccactttaggtccagatagggagagtctggaggggctggaagtagccccaaggccacctgccaggatcactggggttggggcagtacctctccctgcctctggcaacagttttgatgcgaggccttcccagggctaccggcgccggaggggcagaggccaacaccgaaggggtggtgtggcaagggctggctctcgaggctcaagaaaacggaaacgccacacattctgctatagctgtggggaagacggccacatcagggtacagtgcatcaacccctccaacctgctcttggtaaagcagaagaaacaggctgcagttgagtcgggaaacgggaactgggcttgggacaagagccatcccaagtccaaggccaagtaggctcgggagaacagggcaac

SEQ ID NO: 163679 - DNA, 3627 bp, Homo sapiens
  Payload ID: 12235
  Gene Symbol: PNMA3
  Gene Name: paraneoplastic Ma antigen 3
  Uniprot ID: Q9UL41
  ENST ID: ENST00000619635
  CDS Start-End: 337-1704
ccgccgccgcgcccccgccccgtgtccgcactgcagagagccgcggcgagcaggcgccggcgcactggcccacgtgctgcgcgagcgagggagagccacagtctgagcgaacgtccgcgctgggagccaggggtgcccgacccccgtccgccgccgccgccgccgccgcgcatagcccccggagagccctctggggaccccgaccagaagggaccttgccctgggagaaggctgtggagacctgggccttctgcgatcaccctaggagttgatccagatatgtgcctcacgccctgatcactccccccaaattagtatccgcagagattcgaggacatgccgttgaccttgttacaggactggtgtcggggggaacacctgaacacccggaggtgcatgctcatcctggggatccccgaggactgtggcgaggatgagtttgaggagacactccaggaggcttgcaggcacctgggcagatacagggtgattggcaggatgtttaggagggaggagaacgcccaggcgattctactggagctggcacaagatatcgactatgctttgctcccaagggaaataccaggaaagggggggccctgggaagtgattgtaaaaccccgtaactcagatggggaatttctcaacagactgaaccgcttcttagaggaggagaggcggaccgtgtcagatatgaaccgagtcctcgggtcggacaccaattgttcggctccaagagtgactatatcaccagagttctggacctgggcccagactctgggggcagcagtgcagcctctgctagaacaaatgttgtaccgagaactaagagtgttttctgggaacaccatatccatcccaggtgcactggcctttgatgcctggcttgagcacaccactgagatgctacagatgtggcaggtgcccgagggggaaaagaggcggaggctgatggaatgcttacggggccctgctctccaggtggtcagtgggctccgggccagcaatgcttccataactgtggaggagtgcctggctgccttgcagcaggtgttcggacctgtggagagccataaaattgcccaggtgaagttgtgtaaagcctatcaggaggcaggagagaaagtatctagctttgtgttacgtttggaacccctgctccaaagagctgtagaaaacaatgtggtatcacgtagaaacgtgaatcagactcgcctgaaacgagtcttaagtggggccacccttcctgacaaactccgagataagcttaagctgatgaaacagcgaaggaagcctcctggtttcctggccctggtgaagctcctgcgtgaggaggaggaatgggaggccactttaggtccagatagggagagtctggaggggctggaagtagccccaaggccacctgccaggatcactggggttggggcagtacctctccctgcctctggcaacagttttgatgcgaggccttcccagggctaccggcgccggaggggcagaggccaacaccgaaggggtggtgtggcaagggctggctctcgaggctcaagaaaacggaaacgccacacattctgctatagctgtggggaagacggccacatcagggtacagtgcatcaacccctccaacctgctcttggccaaggagacaaaagagatattggaaggaggggaaagagaagcccagacaaacagcagatgagttgagtggggcagagggacagggcagccagaccaaggccaagccttctcacccttggccagctggaagggacttcagcaaccaagaccacctggcaacaggctcagtgggggtcaggtccaggtccccgaagaggtgctggagaggaaagcagggagccactgcatccagcacatggggtgcctgggcctcagatggggaccccaaagaagcagaagctgaagaaggtacggctgggggttctgtcctgctcatccaaccacccctaaatacccaccctgtggactttgagctgaacatgcccactggcccccaggccacatgggacctggaggagcctacctggggcctgcccctgccagcaggtgccagggctggtgaggaagagctggggggcagaggtaaagccctgcaggggaggccacagggtccatcccgtcttcaggatcatctacactgcactaggggagccccaggaaggcagcaccctggaggccctgtgccagtgaggacaggagaccctaaggccccgggagcccagtgccagccagaggttgtgcaggcaaggagaccaaagattgatgagaagacccccagcaggggtactgggtacccggcaggccagtgccctcacagttgacttggaccagggtggctgtgaagggaagtctttgttgcaaaggaggaggaaaagggaggacttggtagggttttgtttcttctgcttgtttctgtacagggccaccagactcctggagagatcaagcaaggagaacctggggctgccatggccaaagcaactcaacagatgccaatgccaattccaaggccagccacaaccctgccaccttggggaatccagcctggaggcatcccctaagcagccagccatggcctgggtggaggcacctgaagacgtctgtcccaaactcccccagccctgagctgggagatgacagggggaaagaggccctctcaagggtgccagatgcctgggtctcccaagaggggtcccccaactcactgttcccgggacaggctgccccctgttccaggaagctcatcctcacctgtgtaggcccctgtagtgacccacgcgtccagcagacgcccacccaccgctagccgttgttcctgtgcaaagtagtgtgctatgcacccacccaggtggccgcctctgggcccaaggcacatgctgtgagcttcctgtgagcccaggctctgctcactgctgtcccgcgtcatgagcaccacctctgctttccctgtgtagatctaggccagtggctgcttgttcttgtggagctgtgtgtgttcttctctgagcagctcctccccggagtcccccagcacagtcccaggagatgacaggaaggaagcaccagggcaaggcggacgctcaccctgtgaccacgatggtgaccgtgactgtgggaggaagaactggacccaggacggagcggggctgccctgcctgaggctcccgaggagctttgtgctttggtgttccacccctgttgttactcatgactcagtttccttaacctggtagggtgttccctgctgtgttttccagtgtcctgtgactgtcctgtgcgggccatagggcagggccctgccccagcagatgggcttgggaggggactccctaaagccagtggacactgccagagtctaccttcctggcaagaggcagaccccggggccctcaggaaggagggagttggcagcgggggctgcagcaggagtaggagcagatgaggcgtcttgccaggaacctcaggaggagggggcccgggacctgtgtgggacctgtgtcctgtggtggccgtttgcagtttctctctgtgttgtgattcccttctcttcaacgttttcagtacgtgtttctcttcaataaacttcattcagtgttccagccgg

SEQ ID NO: 163680 - DNA, 3197 bp, Homo sapiens
  Payload ID: 12236
  Gene Symbol: PNMA5
  Gene Name: paraneoplastic Ma antigen family member 5
  Uniprot ID: Q96PV4
  ENST ID: ENST00000361887
  CDS Start-End: 423-1769
cattgcattgcgcagagctcagccatctttctcatccgtcaggcattcctgagaaagagggccactctacctctcttgctgccagccttcactccagcaaggagggtgctgggtgacctgagcccacatagccccgagtgagcagtgaggctgtctcctgccctcttctgcctggagggctcgtcagtgtccccaggtgtcaggccctgcctcctgacgttggccttttcactacaggcacccgaagcacacacagcagagtcctctggactttgaggaagaacccacagcaggaggaagctgtgtgaaacctgggaccacttctgccttcctacgtggcagtggctcagagttatttgagtgctgtcaaactgagctgattgctgccctagtattagatcagtccatagaaagtgggagcaatggcactgacactgctagaggattggtgcaaggggatggacatggaccccagaaaggccctgctgattgtaggcatccccatggagtgtagtgaggtggaaattcaggacactgtgaaggcaggcttacagcccctgtgcgcatacagggtcctagggagaatgttcaggagggaagacaatgccaaggcagtcttcattgaactggctgacactgtcaattacactactctgcccagtcacataccaggaaagggtggctcctgggaagtggtggtaaaaccccgtaacccagatgatgagtttctcagtagactgaactacttcctgaaagatgagggccgaagtatgacagatgtggccagagccctgggatgttgcagcctccctgccgagagcctggatgcagaggtcatgccccaagttagatccccacctttagagcctccgaaagaaagtatgtggtacaggaaactgaaagtgttttcgggaactgcttcccctagcccaggcgaagagacctttgaagactggctagagcaggtcactgagataatgcccatatggcaagtgtctgaggtggagaagaggcggcgtttgctggagagcttacgtgggcctgctctgtcaatcatgcgggtgctccaggccaacaatgactccataactgtggagcagtgccttgacgccctaaagcagatctttggggataaagaggactttagagcctctcagtttaggtttctgcagacctctccgaagattggagagaaagtctccactttcctgctgcgcttagagcccctgctgcagaaagccgtgcacaagagccccttgtcagtgcgcagcacagacatgattcgtctgaaacatctcttagctcgggtcgccatgacccccgccctcaggggcaagctggagctcttggatcagcgagggtgtcctcccaattttctggagttaatgaagctcattcgagatgaagaagagtgggagaacactgaggcagtgatgaagaataaggagaagccatcagggagaggccggggggcctccggtagacaggcaagagcagaagccagtgtctctgcacctcaggccaccgtgcaggcaaggtcttttagcgacagcagcccccagaccatacagggaggcttacccccattagtgaaacgcaggcggctgttaggcagtgaaagcactaggggagaagaccatggccaggccacgtatcccaaggctgaaaaccagactccaggcagggaggggccacaggctgcaggagaggagttgggaaacgaggcaggggctggggccatgagccatcccaagccctgggaaacataggctcagaagaccgaagcactccttcccctggcaggcagcagggacatttgaacaaggggaaggggcagcttacactaacagggaacttgactggggcagagggacagggaagccaggtcgagatcaagcccccttactttccaccagctggaagggacttcaccaaccaagaccaaatagcatctggttcagtgggggccgggcccatagcccctaacaggtacaggagacacaagcggggaaccactacacttagcacatggggtgcctgggcttcagatggggaccccagcgaagcaggggctgaagaaggtgtggctgggggctctggcctggtcctctggacacccccaaatatctaccctgtggactttgagctgagcatgcccactggcacccaggccacgtgggacctggaggagcctgcctggggcctgcctctgccagaaggagccagggctgctgaggaagagctgtggggcagaagtgaagccccgcaggggaggccacagggtccagcctgtctttaggatcatctacactgcatgaggggagccccaggaaggcagcattcataagcccctgcaccagtgaggaagagaaagaggaggagaattaagaagaggatgatcgggaggaggaagaggagaataaggaggagcaggaggaagagggggaggagaaggaggaagagggggaggaggaagaggggaaggaggaggaagaagtgtaagaagagaagagaggatgtgttgggggtgggtagttgtttttggtttgcgtcatcatcaggcccgggctctgctcactgctgttccgtgtcaagaactccacctctgctttgccggtgtagatctcggccagtggctgcttgttctcttggggatgtgtgtgtttttatctgagcagctcctttccagagtaccccagcgcagttccaggagacggtgggaaggaggcatggcagacgctcaccttgtgactgtgacctcgactgcaggaggaccaaccagacacgggaaggagcagggctgcctgaggctccccaggaagctttgtgctttggcgttccacccctgctgttactcgtgactcagtttcctcaacttggtggggtgttccctgctatgttttccagcatcctgtgactgtcctgtgcagtctatagggcagggccctgccccagcgggtgggctcaggagggggttccctgaagcgagtacacattgccagagcccaccatcctggcaagaggtggatcctggggccctatggaaggagggatgtggtggggggggccacactgagggaggggccggggacttgtgacctgtagtggctgtttgcagtttctctctgtgttagattcccttttcttcagcagtttcagttcatgtttctcttcagtaaattttgttcagtgttcca

SEQ ID NO: 163681 - DNA, 3213 bp, Homo sapiens
  Payload ID: 12236
  Gene Symbol: PNMA5
  Gene Name: paraneoplastic Ma antigen family member 5
  Uniprot ID: Q96PV4
  ENST ID: ENST00000439251
  CDS Start-End: 440-1786
tctcattgcattgcgcagagctcagccatctttctcatccgtcaggcattcctgagaaagagggccactctacctctcttgctgccagccttcactccagcaaggagggtgctgggtgacctgagcccacatagccccgagtgagcagtgaggctgtctcctgccctcttctgcctggagggctcgtcagtgtccccaggtgtcaggccctgcctcctgacgttggccttttcactacaggcacccgaagcacacacagcagagtcctctggactttgaggaagaacccacagcaggaggaagtcagcagggagtggctgtgtgaaacctgggaccacttctgccttcctacgtggcagtggctcagagttatttgagtgctgtcaaactgagctgattgctgccctagtattagatcagtccatagaaagtgggagcaatggcactgacactgctagaggattggtgcaaggggatggacatggaccccagaaaggccctgctgattgtaggcatccccatggagtgtagtgaggtggaaattcaggacactgtgaaggcaggcttacagcccctgtgcgcatacagggtcctagggagaatgttcaggagggaagacaatgccaaggcagtcttcattgaactggctgacactgtcaattacactactctgcccagtcacataccaggaaagggtggctcctgggaagtggtggtaaaaccccgtaacccagatgatgagtttctcagtagactgaactacttcctgaaagatgagggccgaagtatgacagatgtggccagagccctgggatgttgcagcctccctgccgagagcctggatgcagaggtcatgccccaagttagatccccacctttagagcctccgaaagaaagtatgtggtacaggaaactgaaagtgttttcgggaactgcttcccctagcccaggcgaagagacctttgaagactggctagagcaggtcactgagataatgcccatatggcaagtgtctgaggtggagaagaggcggcgtttgctggagagcttacgtgggcctgctctgtcaatcatgcgggtgctccaggccaacaatgactccataactgtggagcagtgccttgacgccctaaagcagatctttggggataaagaggactttagagcctctcagtttaggtttctgcagacctctccgaagattggagagaaagtctccactttcctgctgcgcttagagcccctgctgcagaaagccgtgcacaagagccccttgtcagtgcgcagcacagacatgattcgtctgaaacatctcttagctcgggtcgccatgacccccgccctcaggggcaagctggagctcttggatcagcgagggtgtcctcccaattttctggagttaatgaagctcattcgagatgaagaagagtgggagaacactgaggcagtgatgaagaataaggagaagccatcagggagaggccggggggcctccggtagacaggcaagagcagaagccagtgtctctgcacctcaggccaccgtgcaggcaaggtcttttagcgacagcagcccccagaccatacagggaggcttacccccattagtgaaacgcaggcggctgttaggcagtgaaagcactaggggagaagaccatggccaggccacgtatcccaaggctgaaaaccagactccaggcagggaggggccacaggctgcaggagaggagttgggaaacgaggcaggggctggggccatgagccatcccaagccctgggaaacataggctcagaagaccgaagcactccttcccctggcaggcagcagggacatttgaacaaggggaaggggcagcttacactaacagggaacttgactggggcagagggacagggaagccaggtcgagatcaagcccccttactttccaccagctggaagggacttcaccaaccaagaccaaatagcatctggttcagtgggggccgggcccatagcccctaacaggtacaggagacacaagcggggaaccactacacttagcacatggggtgcctgggcttcagatggggaccccagcgaagcaggggctgaagaaggtgtggctgggggctctggcctggtcctctggacacccccaaatatctaccctgtggactttgagctgagcatgcccactggcacccaggccacgtgggacctggaggagcctgcctggggcctgcctctgccagaaggagccagggctgctgaggaagagctgtggggcagaagtgaagccccgcaggggaggccacagggtccagcctgtctttaggatcatctacactgcatgaggggagccccaggaaggcagcattcataagcccctgcaccagtgaggaagagaaagaggaggagaattaagaagaggatgatcgggaggaggaagaggagaataaggaggagcaggaggaagagggggaggagaaggaggaagagggggaggaggaagaggggaaggaggaggaagaagtgtaagaagagaagagaggatgtgttgggggtgggtagttgtttttggtttgcgtcatcatcaggcccgggctctgctcactgctgttccgtgtcaagaactccacctctgctttgccggtgtagatctcggccagtggctgcttgttctcttggggatgtgtgtgtttttatctgagcagctcctttccagagtaccccagcgcagttccaggagacggtgggaaggaggcatggcagacgctcaccttgtgactgtgacctcgactgcaggaggaccaaccagacacgggaaggagcagggctgcctgaggctccccaggaagctttgtgctttggcgttccacccctgctgttactcgtgactcagtttcctcaacttggtggggtgttccctgctatgttttccagcatcctgtgactgtcctgtgcagtctatagggcagggccctgccccagcgggtgggctcaggagggggttccctgaagcgagtacacattgccagagcccaccatcctggcaagaggtggatcctggggccctatggaaggagggatgtggtggggggggccacactgagggaggggccggggacttgtgacctgtagtggctgtttgcagtttctctctgtgttagattcccttttcttcagcagtttcagttcatgtttctcttcagtaaattttgttcagtgttcc

SEQ ID NO: 163682 - DNA, 749 bp, Homo sapiens
  Payload ID: 12236
  Gene Symbol: PNMA5
  Gene Name: paraneoplastic Ma antigen family member 5
  ENST ID: ENST00000437210
  CDS Start-End: 330-749
atccagtgaagcaggacccatcacgcctgagtcaggaactgcctaactggatagagttgaaaagcagagcgagtctgaagtggctgtgttattgcagcatccgcgctgccagcagggccaacccagcaaggcacccgaagcacacacagcagagtcctctggactttgaggaagaacccacagcaggaggaagtcagcagggagtggctgtgtgaaacctgggaccacttctgccttcctacgtggcagtggctcagagttatttgagtgctgtcaaactgagctgattgctgccctagtattagatcagtccatagaaagtgggagcaatggcactgacactgctagaggattggtgcaaggggatggacatggaccccagaaaggccctgctgattgtaggcatccccatggagtgtagtgaggtggaaattcaggacactgtgaaggcaggcttacagcccctgtgcgcatacagggtcctagggagaatgttcaggagggaagacaatgccaaggcagtcttcattgaactggctgacactgtcaattacactactctgcccagtcacataccaggaaagggtggctcctgggaagtggtggtaaaaccccgtaacccagatgatgagtttctcagtagactgaactacttcctgaaagatgagggccgaagtatgacagatgtggccagagccctgggatgttgcagcctccctgccgagagcctggatgcagaggtcatgccc

SEQ ID NO: 163683 - DNA, 3113 bp, Homo sapiens
  Payload ID: 12236
  Gene Symbol: PNMA5
  Gene Name: paraneoplastic Ma antigen family member 5
  Uniprot ID: Q96PV4
  ENST ID: ENST00000452693
  CDS Start-End: 340-1686
tctcattgcattgcgcagagctcagccatctttctcatccgtcaggcattcctgagaaagagggccactctacctctcttgctgccagccttcactccagcaaggagggtgctgggtgacctgagcccacatagccccgagcacccgaagcacacacagcagagtcctctggactttgaggaagaacccacagcaggaggaagtcagcagggagtggctgtgtgaaacctgggaccacttctgccttcctacgtggcagtggctcagagttatttgagtgctgtcaaactgagctgattgctgccctagtattagatcagtccatagaaagtgggagcaatggcactgacactgctagaggattggtgcaaggggatggacatggaccccagaaaggccctgctgattgtaggcatccccatggagtgtagtgaggtggaaattcaggacactgtgaaggcaggcttacagcccctgtgcgcatacagggtcctagggagaatgttcaggagggaagacaatgccaaggcagtcttcattgaactggctgacactgtcaattacactactctgcccagtcacataccaggaaagggtggctcctgggaagtggtggtaaaaccccgtaacccagatgatgagtttctcagtagactgaactacttcctgaaagatgagggccgaagtatgacagatgtggccagagccctgggatgttgcagcctccctgccgagagcctggatgcagaggtcatgccccaagttagatccccacctttagagcctccgaaagaaagtatgtggtacaggaaactgaaagtgttttcgggaactgcttcccctagcccaggcgaagagacctttgaagactggctagagcaggtcactgagataatgcccatatggcaagtgtctgaggtggagaagaggcggcgtttgctggagagcttacgtgggcctgctctgtcaatcatgcgggtgctccaggccaacaatgactccataactgtggagcagtgccttgacgccctaaagcagatctttggggataaagaggactttagagcctctcagtttaggtttctgcagacctctccgaagattggagagaaagtctccactttcctgctgcgcttagagcccctgctgcagaaagccgtgcacaagagccccttgtcagtgcgcagcacagacatgattcgtctgaaacatctcttagctcgggtcgccatgacccccgccctcaggggcaagctggagctcttggatcagcgagggtgtcctcccaattttctggagttaatgaagctcattcgagatgaagaagagtgggagaacactgaggcagtgatgaagaataaggagaagccatcagggagaggccggggggcctccggtagacaggcaagagcagaagccagtgtctctgcacctcaggccaccgtgcaggcaaggtcttttagcgacagcagcccccagaccatacagggaggcttacccccattagtgaaacgcaggcggctgttaggcagtgaaagcactaggggagaagaccatggccaggccacgtatcccaaggctgaaaaccagactccaggcagggaggggccacaggctgcaggagaggagttgggaaacgaggcaggggctggggccatgagccatcccaagccctgggaaacataggctcagaagaccgaagcactccttcccctggcaggcagcagggacatttgaacaaggggaaggggcagcttacactaacagggaacttgactggggcagagggacagggaagccaggtcgagatcaagcccccttactttccaccagctggaagggacttcaccaaccaagaccaaatagcatctggttcagtgggggccgggcccatagcccctaacaggtacaggagacacaagcggggaaccactacacttagcacatggggtgcctgggcttcagatggggaccccagcgaagcaggggctgaagaaggtgtggctgggggctctggcctggtcctctggacacccccaaatatctaccctgtggactttgagctgagcatgcccactggcacccaggccacgtgggacctggaggagcctgcctggggcctgcctctgccagaaggagccagggctgctgaggaagagctgtggggcagaagtgaagccccgcaggggaggccacagggtccagcctgtctttaggatcatctacactgcatgaggggagccccaggaaggcagcattcataagcccctgcaccagtgaggaagagaaagaggaggagaattaagaagaggatgatcgggaggaggaagaggagaataaggaggagcaggaggaagagggggaggagaaggaggaagagggggaggaggaagaggggaaggaggaggaagaagtgtaagaagagaagagaggatgtgttgggggtgggtagttgtttttggtttgcgtcatcatcaggcccgggctctgctcactgctgttccgtgtcaagaactccacctctgctttgccggtgtagatctcggccagtggctgcttgttctcttggggatgtgtgtgtttttatctgagcagctcctttccagagtaccccagcgcagttccaggagacggtgggaaggaggcatggcagacgctcaccttgtgactgtgacctcgactgcaggaggaccaaccagacacgggaaggagcagggctgcctgaggctccccaggaagctttgtgctttggcgttccacccctgctgttactcgtgactcagtttcctcaacttggtggggtgttccctgctatgttttccagcatcctgtgactgtcctgtgcagtctatagggcagggccctgccccagcgggtgggctcaggagggggttccctgaagcgagtacacattgccagagcccaccatcctggcaagaggtggatcctggggccctatggaaggagggatgtggtggggggggccacactgagggaggggccggggacttgtgacctgtagtggctgtttgcagtttctctctgtgttagattcccttttcttcagcagtttcagttcatgtttctcttcagtaaattttgttcagtgttcc

SEQ ID NO: 163684 - DNA, 3198 bp, Homo sapiens
  Payload ID: 12236
  Gene Symbol: PNMA5
  Gene Name: paraneoplastic Ma antigen family member 5
  Uniprot ID: Q96PV4
  ENST ID: ENST00000535214
  CDS Start-End: 425-1771
agcctcgtggcgcagtcagcacggaggcggcagccgccatagacgtgtggtggtcgcgctgcgcgggaactccggcttggaggcacctccggcagatccagtgaagcaggacccatcacgcctgagtcaggaactgcctaactggatagagttgaaaagcagagcgagtctgaagtggctgtgttattgcagcatccgcgctgccagcagggccaacccagcaaggcacccgaagcacacacagcagagtcctctggactttgaggaagaacccacagcaggaggaagtcagcagggagtggctgtgtgaaacctgggaccacttctgccttcctacgtggcagtggctcagagttatttgagtgctgtcaaactgagctgattgctgccctagtattagatcagtccatagaaagtgggagcaatggcactgacactgctagaggattggtgcaaggggatggacatggaccccagaaaggccctgctgattgtaggcatccccatggagtgtagtgaggtggaaattcaggacactgtgaaggcaggcttacagcccctgtgcgcatacagggtcctagggagaatgttcaggagggaagacaatgccaaggcagtcttcattgaactggctgacactgtcaattacactactctgcccagtcacataccaggaaagggtggctcctgggaagtggtggtaaaaccccgtaacccagatgatgagtttctcagtagactgaactacttcctgaaagatgagggccgaagtatgacagatgtggccagagccctgggatgttgcagcctccctgccgagagcctggatgcagaggtcatgccccaagttagatccccacctttagagcctccgaaagaaagtatgtggtacaggaaactgaaagtgttttcgggaactgcttcccctagcccaggcgaagagacctttgaagactggctagagcaggtcactgagataatgcccatatggcaagtgtctgaggtggagaagaggcggcgtttgctggagagcttacgtgggcctgctctgtcaatcatgcgggtgctccaggccaacaatgactccataactgtggagcagtgccttgacgccctaaagcagatctttggggataaagaggactttagagcctctcagtttaggtttctgcagacctctccgaagattggagagaaagtctccactttcctgctgcgcttagagcccctgctgcagaaagccgtgcacaagagccccttgtcagtgcgcagcacagacatgattcgtctgaaacatctcttagctcgggtcgccatgacccccgccctcaggggcaagctggagctcttggatcagcgagggtgtcctcccaattttctggagttaatgaagctcattcgagatgaagaagagtgggagaacactgaggcagtgatgaagaataaggagaagccatcagggagaggccggggggcctccggtagacaggcaagagcagaagccagtgtctctgcacctcaggccaccgtgcaggcaaggtcttttagcgacagcagcccccagaccatacagggaggcttacccccattagtgaaacgcaggcggctgttaggcagtgaaagcactaggggagaagaccatggccaggccacgtatcccaaggctgaaaaccagactccaggcagggaggggccacaggctgcaggagaggagttgggaaacgaggcaggggctggggccatgagccatcccaagccctgggaaacataggctcagaagaccgaagcactccttcccctggcaggcagcagggacatttgaacaaggggaaggggcagcttacactaacagggaacttgactggggcagagggacagggaagccaggtcgagatcaagcccccttactttccaccagctggaagggacttcaccaaccaagaccaaatagcatctggttcagtgggggccgggcccatagcccctaacaggtacaggagacacaagcggggaaccactacacttagcacatggggtgcctgggcttcagatggggaccccagcgaagcaggggctgaagaaggtgtggctgggggctctggcctggtcctctggacacccccaaatatctaccctgtggactttgagctgagcatgcccactggcacccaggccacgtgggacctggaggagcctgcctggggcctgcctctgccagaaggagccagggctgctgaggaagagctgtggggcagaagtgaagccccgcaggggaggccacagggtccagcctgtctttaggatcatctacactgcatgaggggagccccaggaaggcagcattcataagcccctgcaccagtgaggaagagaaagaggaggagaattaagaagaggatgatcgggaggaggaagaggagaataaggaggagcaggaggaagagggggaggagaaggaggaagagggggaggaggaagaggggaaggaggaggaagaagtgtaagaagagaagagaggatgtgttgggggtgggtagttgtttttggtttgcgtcatcatcaggcccgggctctgctcactgctgttccgtgtcaagaactccacctctgctttgccggtgtagatctcggccagtggctgcttgttctcttggggatgtgtgtgtttttatctgagcagctcctttccagagtaccccagcgcagttccaggagacggtgggaaggaggcatggcagacgctcaccttgtgactgtgacctcgactgcaggaggaccaaccagacacgggaaggagcagggctgcctgaggctccccaggaagctttgtgctttggcgttccacccctgctgttactcgtgactcagtttcctcaacttggtggggtgttccctgctatgttttccagcatcctgtgactgtcctgtgcagtctatagggcagggccctgccccagcgggtgggctcaggagggggttccctgaagcgagtacacattgccagagcccaccatcctggcaagaggtggatcctggggccctatggaaggagggatgtggtggggggggccacactgagggaggggccggggacttgtgacctgtagtggctgtttgcagtttctctctgtgttagattcccttttcttcagcagtttcagttcatgtttctcttcagtaaattttgttcagtgttcc

SEQ ID NO: 163685 - DNA, 2209 bp, Homo sapiens
  Payload ID: 12237
  Gene Symbol: PNMA6A
  Gene Name: paraneoplastic Ma antigen family member 6A
  Uniprot ID: P0CW24
  ENST ID: ENST00000421798
  CDS Start-End: 254-1453
acagtcagagggaacgcccgcgcggggagccaggggcgcccgaccccgccgccgccgcagcggcgcgcagcccccgacgcgccctgtggggacccggaccaggagggaccctgccccgggaaaaggctgtggagacctgggctccgaccccagttcatccccccacacccccgccgccccgtgccaccctggtccgcgctgggaaccctatcctgcccctcgtgtcagcccggcactggccagaatcgcgggcatggcggtgaccatgctgcaggactggtgccggtggatgggggtcaacgctcgcaggggcctgctcatcctgggcatcccggaggactgtgatgatgccgaattccaagagtccctcgaggctgccctgaggcctatgggacactttacagtgctaggcaaagcgtttcgagaggaggataatgccaccgcggccctggtcgagctcgaccgggaagtcaactatgctttggtccccagggaaatccccggcactgggggcccgtggaacgtggtctttgtgccccgttgctcaggcgaggagtttctcggtctcggtcgcgtgttccacttcccggagcaagaggggcagatggtggagagcgtggccggcgccctgggtgtggggctgcgcagggtgtgctggctgcgatccatcggtcaggcggtccagccctgggtggaggccgtgaggtgccagagcctgggcgtgttttccgggagggaccagccagccccaggggaggagtcctttgaggtctggctagaccacaccaccgaaatgctgcatgtgtggcagggggtctcggaaagggagaggaggaggaggctgctggaaggcttgcgtgggaccgccctgcagctcgtgcacgcgctcctggcggagaaccccgccaggacggcgcaggactgtctggcggccctggcccaggtgtttggagacaacgagtcccaggcgaccatccgggtgaagtgtctgaccgctcagcagcagtcaggcgagcgtctctcagctttcgtgttgcggctggaagtgctgctgcagaaggccatggagaaggaggccctggccagagcatccgccgaccgcgtgcgcctgaggcagatgctcaccagggcccaccttactgagcctctggatgaagcactgaggaagctgagaatggccgggaggtctccaagtttcttggagatgctggggctcgttcgggagtctgaggcatgggaggccagtctagccaggagcgtgagagcccagacacaggaaggggccggtgcccgggctggtgcccaggctgttgccagagccagcactaaagtagaggcggtcccaggaggtcctggtcgggagccagagggcctcctccaggcaggaggccaggaggctgaggagctcctccaggaggggctcaagcccgtcctggaggaatgtgataactaggttggggctggggaggcagcccagcgcgagtcctccccgggcaaataggctccgagggccccggggcctcctctcctcctctcaggcagcagggccctggagacaggcggaggcggggccagggccggtccctcaccccacatcgggatcggggccccccacttccccccaaggggccctgcccaccaccaccttcccggtgacccagatgaccacatttaataccaaatggggtggggggaggcgcccctccagtgccaggggcacgtgctgtgagcttcctgggagcccaggttgtgctcactgctctcccgtatcgtgagcaccacctctgctttccctgcgtagatctaggccaggggctgcttgtttttgtggagccgtgtgtgttcttctctgagcagctcctccccagaggaccccagcgcagtcccgggagatggcggaaagaaggcaccagggcacagtggacactcatcccgtgacagcgatggtgaccatgactgtgggagaaagaacaggacccgggatggagtggggctgtctgagtttccccagtgaactttgtgctttggcgttccacccctgttgttacttgttactgagtttcctagacctggggtgggtgttcccccaggaggaggggggtcccgacctgtgtcctgtggtggccatttgcagcttctgtgttgtgattcccttctcttcaacggtttcagtacatatctctcttcaataaatttcattcagtgttcc

SEQ ID NO: 163686 - DNA, 3689 bp, Homo sapiens
  Payload ID: 12238
  Gene Symbol: PNMAL1
  Gene Name: paraneoplastic Ma antigen family-like 1
  Uniprot ID: Q86V59
  ENST ID: ENST00000313683
  CDS Start-End: 307-1626
agtgcgcaggcgcgcgctgcgacgccaacctcggcttctcgccgctaacggcatcgagtctggacgccccgtgacccgcctgggccggagcgggggcggacggcgccttcttggccctttctgcctctagcagcggcgccggggtagccggagccagcgactgggaaacggctgcattccactgcgtctccttggcctggctgggcggtcggaggctgatctgccaagattactgtttggagaccgctgcagcccacgtccacctgatagactatttactacacatagtaggttcagagccgctaaatgtccaagaccatggcgatgaaccttctggaggattggtgcaggggaatggaagtggacatccacaggtccttgttggtcacaggcatcccagaggactgtgggcaggcagaaattgaggagaccttgaatggggtcctctccccactgggcccgtaccgcgtgctcaacaagatttttgtgagggaagagaatgttaaagctgccctcattgaggttggtgaaggtgtgaatctgagcaccatcccccgtgaattcccaggaaggggtggtgtctggagagtggtctgtagagaccctacccaggatgccgagtttttaaaaaatctgaatgaattcctggatgccgaggggcgcacctgggaggatgtggtccgcctgctccagctcaaccaccccaccctgtcccagaaccagcatcagcccccagagaactgggcagaagctctgggggtgcttctgggagcagtggtgcagatcatcttctgcatggatgccgagatccgcagccgggaggaagccagggcccaggaggccgctgaattcgaggagatggcagcctgggctttagcagcagggaggaaggtgaagaaagaaccggggcttgcagcagaggtgggttctgccttaaaggcagagacccccaacaactggaatgccacggaagaccagcatgagcctaccaaacctttggttcgcagggctggagctaagtctcgctccaggagaaagaagcagaagaagaactccaggcaggaagcagtgccctggaaaaaacccaaaggcatcaattccaacagcacagctaacttggaggatcctgaggtgggtgatgctgaaagcatggcgatctcagagccgatcaagggcagcagaaagccctgtgtgaataaggaggagttggctttgaagaagcccatggcgaaatgtgcctggaagggtcccagagagccacctcaggatgcccgggcagaagccgagagcccaggaggcgcctctgagtcagaccaagatggtggccatgaaagcccaccaaagaagaaggccgtggcctgggtgtctgccaagaaccccgctcccatgaggaagaagaagaaggtgagcttgggccctgtctcctacgtcttggttgactcagaagatggcaggaagaagccggtgatgccaaagaaagggccaggctcaagaagggaggcatcagatcagaaggcccctcggggccagcagcctgccgaggcaacagcctcaacctctaggggtccgaaggccaagccagaaggctctcctcggcgtgccaccaatgaatccagaaaggtttgatctgggggaccacccatactgaggagttgaaagaacaaggaagaagtaccaagtcaaccaagttctctcttgtcactgaataagactttggactctcttagggcccctgttgatagagatctggccctgaggtaaacgataggtgaggtcttgggtgggagggagttggggaagggaggtggatctctatgcccttttctctaccaggcctgccgtttcaccgccttctctactcaccttctcttcggaggcaggagagttggtaagaggattgggaaaattctagaacattcattcccctttatgcatgagcagggtcactgttacactcatccatgttcagcttttctcccccacgccttgctccctcctcggaatggtcagcgacctctgcaggccctggcatttggaagagctgggtggccctgccatattcttcctcccgccttcctctcgtgtaaccagcggggtaagttaagccaggaccttcgctgcaaacctggttttattgctccttcagtctccagcttccatcctccagttatctagccaggaggtcccaagagttagttttagggaaaaagaatgtctgcctagacctcaaagtctttgagttttagagtctgttagtaaaaatggcactttgattcccatttgggatgagccctctcaggaatcctgtggggaaggggggtgattatagggaaggacgcaggcattcctaggtccccagctctaattccatccatctacccaactgtcaccatctttgcaccaaactgtcaccatctttgcagcagaaggtcactactcacattatagtaagaggggaaaaaaatcttttaaaacttggctgttggccgggcacggtggctcacgcctgtaatcccagcactttgggaggctgaggcaggtcgatcacgaggtcaggcgtttaagaccagcttgaccaacatggtgaaaccccatctctacaaaaattagctgggcgtggtggcgcgcgcctgtaatcccagctactcaggaggctgaggcagatgaattgcttgaatccaggaggcagaggttgcaatgagccgagattgtgccacggcactccagcctgggcagcagagtgagactctctctcaaaaaaacaaaacttggctgttaatgtctgccctctgaattcagacacactatattagaccagaccaccatgtgtcattgtgtgtgtgtgtgtgtgtgtttgcgtgcgcatgtgtagaggagagagcagggtccctgagataatggtttccaaactgtatcgtagccgtccacaaagatgtaatccaaatctatttttctcacgtgtttaaaaaactgaaaagtgactactcagatatgttggaagtcacatcgaagactatcagaatattaccttgtgttcataggttaacttgtttttgtacacgtcttagttatttcaggcatctctttgcttaaaattgagtttcttgtaaatgtgactgatgagcgaggttagaagtggaagaaattcctgtgcatgttctataatctgacaccctgaaagcaagtttcctttcgtcattcacatgctcttgttctgccgtgactgttcaggtgtatggtagtaagtaaatgtattaacatggtgaacagtagtaatattctatcatagagtattagcccttgcaagttttcagggcgtcttttccgacttcagtttttgtgataaagaatgtgaacagttgttagatgttctcagtgattcaactttaaaacaaatttctcgtgatgattcatttcaaaatcctgagtgagtctgactgaaaaatacgagagaaaagagagtggtttccgtttgcagctacacagctgtgtgcatcgacgttctcctggggtgtgtgccaagcgaaacccaggggtgaattggattcttgaagagaccaaagcctgtaactgtccagcttctaatttcaaaacgggtccattagggcttcgttgtgttaacaagttgacaccatgactagtaaatgtaaacgtgtatgtataaaataaagtttagcaaattaagtgtc

SEQ ID NO: 163687 - DNA, 3335 bp, Homo sapiens
  Payload ID: 12238
  Gene Symbol: PNMAL1
  Gene Name: paraneoplastic Ma antigen family-like 1
  Uniprot ID: Q86V59
  ENST ID: ENST00000438932
  CDS Start-End: 151-1287
gcgactgggaaacggctgcattccactgcgtctccttggcctggctgggcggtcggaggctgatctgccaagattactgtttggagaccgctgcagcccacgtccacctgatagactatttactacacatagtaggttcagagccgctaaatgtccaagaccatggcgatgaaccttctggaggattggtgcaggggaatggaagtggacatccacaggtccttgttggtcacaggcatcccagaggactgtgggcaggcagaaattgaggagaccttgaatggggtcctctccccactgggcccgtaccgcgtgctcaacaagatttttgtgagggaagagaatgttaaagctgccctcattgaggttggtgaaggtgtgaatctgagcaccatcccccgtgaattcccaggaaggggtggtgtctggagagtggtctgtagagaccctacccaggatgccgagtttttaaaaaatctgaatgaattcctggatgccgaggggcgcacctgggaggatgtggtccgcctgctccagctcaaccaccccaccctgtcccagaaccagcatcagcccccagagaactgggcagaagctctgggggtgcttctgggagcagtggtgcagatcatcttctgcatggatgccgagatccgcagccgggaggaagccagggcccaggaggccgctgaattcgaggagatggcagcctgggctttagcagcagggaggaaggtgaagaaagaaccggggcttgcagcagaggtgggttctgccttaaaggcagagacccccaacaactggaatgccacggaagaccagcatgagcctaccaaacctttggttcgcagggctggagctaagtctcgctccaggagaaagaagcagaagaagaactccaggcaggaagcagtgccctggaaaaaacccaaaggcatcaattccaacagcacagctaacttggaggatcctgaggtgggtgatgctgaaagcatggcgatctcagagccgatcaagggcagcagaaagccctgtgtgaataaggaggagttggctttgaagaagcccatggcgaaatgtgcctggaagggtcccagagagccacctcaggatgcccgggcagaagccgagagcccaggaggcgcctctgagtcagaccaagatggtggccatgaaagcccaccaaagaagaaggccgtggcctgggtgtctgccaagaaccccgctcccatgaggaagaagaagaagaatccagaaaggtttgatctgggggaccacccatactgaggagttgaaagaacaaggaagaagtaccaagtcaaccaagttctctcttgtcactgaataagactttggactctcttagggcccctgttgatagagatctggccctgaggtaaacgataggtgaggtcttgggtgggagggagttggggaagggaggtggatctctatgcccttttctctaccaggcctgccgtttcaccgccttctctactcaccttctcttcggaggcaggagagttggtaagaggattgggaaaattctagaacattcattcccctttatgcatgagcagggtcactgttacactcatccatgttcagcttttctcccccacgccttgctccctcctcggaatggtcagcgacctctgcaggccctggcatttggaagagctgggtggccctgccatattcttcctcccgccttcctctcgtgtaaccagcggggtaagttaagccaggaccttcgctgcaaacctggttttattgctccttcagtctccagcttccatcctccagttatctagccaggaggtcccaagagttagttttagggaaaaagaatgtctgcctagacctcaaagtctttgagttttagagtctgttagtaaaaatggcactttgattcccatttgggatgagccctctcaggaatcctgtggggaaggggggtgattatagggaaggacgcaggcattcctaggtccccagctctaattccatccatctacccaactgtcaccatctttgcaccaaactgtcaccatctttgcagcagaaggtcactactcacattatagtaagaggggaaaaaaatcttttaaaacttggctgttggccgggcacggtggctcacgcctgtaatcccagcactttgggaggctgaggcaggtcgatcacgaggtcaggcgtttaagaccagcttgaccaacatggtgaaaccccatctctacaaaaattagctgggcgtggtggcgcgcgcctgtaatcccagctactcaggaggctgaggcagatgaattgcttgaatccaggaggcagaggttgcaatgagccgagattgtgccacggcactccagcctgggcagcagagtgagactctctctcaaaaaaacaaaacttggctgttaatgtctgccctctgaattcagacacactatattagaccagaccaccatgtgtcattgtgtgtgtgtgtgtgtgtgtttgcgtgcgcatgtgtagaggagagagcagggtccctgagataatggtttccaaactgtatcgtagccgtccacaaagatgtaatccaaatctatttttctcacgtgtttaaaaaactgaaaagtgactactcagatatgttggaagtcacatcgaagactatcagaatattaccttgtgttcataggttaacttgtttttgtacacgtcttagttatttcaggcatctctttgcttaaaattgagtttcttgtaaatgtgactgatgagcgaggttagaagtggaagaaattcctgtgcatgttctataatctgacaccctgaaagcaagtttcctttcgtcattcacatgctcttgttctgccgtgactgttcaggtgtatggtagtaagtaaatgtattaacatggtgaacagtagtaatattctatcatagagtattagcccttgcaagttttcagggcgtcttttccgacttcagtttttgtgataaagaatgtgaacagttgttagatgttctcagtgattcaactttaaaacaaatttctcgtgatgattcatttcaaaatcctgagtgagtctgactgaaaaatacgagagaaaagagagtggtttccgtttgcagctacacagctgtgtgcatcgacgttctcctggggtgtgtgccaagcgaaacccaggggtgaattggattcttgaagagaccaaagcctgtaactgtccagcttctaatttcaaaacgggtccattagggcttcgttgtgttaacaagttgacaccatgactagtaaatgtaaacgtgtatgtataaaataaagtttagcaaattaagtgtcctgttaa

SEQ ID NO: 163688 - DNA, 572 bp, Homo sapiens
  Payload ID: 12238
  Gene Symbol: PNMAL1
  Gene Name: paraneoplastic Ma antigen family-like 1
  ENST ID: ENST00000602246
  CDS Start-End: 307-561
agtgcgcaggcgcgcgctgcgacgccaacctcggcttctcgccgctaacggcatcgagtctggacgccccgtgacccgcctgggccggagcgggggcggacggcgccttcttggccctttctgcctctagcagcggcgccggggtagccggagccagcgactgggaaacggctgcattccactgcgtctccttggcctggctgggcggtcggaggctgatctgccaagattactgtttggagaccgctgcagcccacgtccacctgatagactatttactacacatagtaggttcagagccgctaaatgtccaagaccatggcgatgaaccttctggaggattggtgcaggggaatggaagtggacatccacaggtccttgttggtcacaggcatcccagaggactgtgggcaggcagaaattgaggagaccttgaatggggtcctctccccactgggcccgtaccgcgtgctcaacaagatttttgtgagggaagagaatgttaaagctgccctcattgagaatccagaaaggtttgatctgggggaccacccatactgaggagttgaaag

SEQ ID NO: 163689 - DNA, 5308 bp, Homo sapiens
  Payload ID: 12239
  Gene Symbol: PNMAL2
  Gene Name: paraneoplastic Ma antigen family-like 2
  Uniprot ID: Q9ULN7
  ENST ID: ENST00000599531
  CDS Start-End: 1034-2941
gtgcaaaaccacaggatttattgtgcatgcatagttcagaatacaggaacgtgtatgggagtgagggccggtcccatcgagtggggcctgtaccctgcaagtgaggcccatataccctgaatggtgtcttgctcacaggtggtgcctgggcccccctatttgatactgagacccatatactgtgaatgaggccagtatcccgagtaagtcctggtcctacgctgcaaggccagtgccctttgatttaggcctatataatcctgaattccacctggcccctggaagggggaattgtaacccccagtgatgccggtaccctctggaaggaggcctctatcccctgaatgaggtcgggtatccttgagtgatttctggccctctgtggtttcggccttgttttttgctggttaatgaaagtggtgcttccaggccccaagtccttgtcatcgggacctttaagaaaagcgtctcaggccacagcgacgcagaccccagctcaaggctgcaccgttgccatggagacggttgggcgggggacaggggagggtgtgcggctccctctgcgcaggcgcacgcgcgagcagccgcgtcgcagcggaactgctgagattcaggcccagggtgcgcgctcagacgcggcgcgagcgccaggcaagctgcggctgctacctcccacgcctctccaggtgcactcggcgccgcccccctgcacctggctgcggtgccgagtcactcaggcctgtgtcagggagagagggagggagctgtcctggaaagcagacacgtaagccccccgcggatcctcagacagctctggagaggggtcccgggggaaggtcactgcgtccagccggccagcaggcagctagagcccccgagccccgagccccactccagccttgccacattcaccggaaccgggactctaagccctgcaagtggctttctagggttgcattgacaccgtgcgctgcagcccacccctatctcgggctccctgctgccccaagatcagcgccaagggggctgcaccatggccatgagccttttgcaggactggtgccggagcctggacgtggacgcgcacagggccctgctggtcaccggcatcccggagggcctggagcaggcagacgtcgaagccgtcctgcagccgaccctcctgcccctgggcacgttcaggttgcgacacatgaaggctttgatgaacgagaaggcccaggccgccctggtggagtttgtggaggacgtcaatcacgctgccattcccagggagatcccaggcaaggatggggtctggagggttctgtggaaggaccgtgcgcaggacacgagggtcctgaggcagatgagacgcctgctgctggatgacgggcccacgcaggccgcggaggctgggacccccggggaggcacccacccctcccgcttcggagacgcaggcccaggattctggggaggtaacagggcaggctggctcgcttcttggggcagccaggaacccaaggaggggccgtcggggtcgcagaaacagaaccagacgcaacaggttgacccagaagggcaagaagagaagccgaggaggacggccgtctgctcccgcgaggagtgaggccgaggactcttccgacgagagcctgggcatcgtgatcgaggagatcgaccagggcgacctgagcggagaagaggaccagagcgcgctgtacgccacgctgcaggccgctgccagggagctggttaggcagtgggcgccctgcaactccgagggggaagaagacggtccccgcgagttcttggctctggtcaccgtcaccgacaaatcgaagaaagaagaggcagagaaggagccagctggggccgaatccatccgcttgaacaccaaagaagacaaaaatggtgtccccgacttagtggccctgctggctgtgagagacaccccggacgaggagccggtggacagcgacacttcggagagcgactcgcaggaaagtggggaccaagaaacagaggagttggataatcctgagttcgtggccattgtggcctataccgacccgtcggacccctgggcccgggaggagatgttgaaaatcgcttctgttatcgagtcgctgggctggagcgacgagaaagacaagcgagaccccctccgacaggtcttgtccgtcatgtccaaggacactaacgggacccgcgtgaaggtggaagaggcgggccgcgaggtggacgccgtggtcctgcgcaaggccggggatgacggggacctccgggagtgcatttccaccttggcgcagccggatctccctccccaggcgaagaaggctgggcgtggcctcttcgggggctggagcgagcaccgtgaggacgaagggggtcttctggagctggtggcgctcctggctgcccaggacatggcggaggtgatgaaggaggaaaaagaaaacgcctgggaaggcgggaagtacaaataccccaaaggcaaactgggggaggtattggcgctcctggccgcccgggagaacatggggtccaacgaggggtcggaggaggcttcggacgaacagtccgaggaggagtcggaggacaccgagagcgaggcgtcggagccggaggacagggcatccaggaagccccgggccaagagggcgcgcacggcccccaggggcctgactccggccggcgcgcctcccaccgcttccggggcccgcaaaacccgcgcgggcggccgaggccgaggccggggcgtcactcccgagaagaaagccgggagccggggctcggcccaggacgacgccgcaggaagcaggaagaagaaggggagcgcgggcgccggggcccatgccagggcaggcgaggccaagggccaggcgcccactggatccaaggccgcgcgcgggaagaaggcccgtcggggccggaggctgccccctaaatgccgctagtggccccccaagaagccgcccaggctgcgagcaggccccgcagggcacccgcccgcctgtggcccccgccctcccctcccctcttcctgtcctccgcagacgcaatctcctcgcttcacagcgcgcccgggccgcgttttgccagcgtcacgttcccctctcgggccctcgcaggccgggggcgccagcgatcccgacggaggaagcccggatgggaggaggaaagagaagtgggcgcccgaggcagcagcgcagggccgagatggggacgcgccaagtggaccaggattgggggcccgggttgcccccggagggggtgtgtgtgtggacgccgggcacctgcagaggcgagcagggctcttcgtggcgctctcggggcctgcgcctggcaggtgctgtaggccgctgtcgcccctaccccagtctgactgggccctgggtctgtggtggaggctcagtcaccagccgcgcagcgcgtgtcagggcgcaactctcagccaggggaggccccagctcccagccaggggaagagatgattccagaaaggaaagtctgagagatagaaggcggttgggaaggggaggaggaggaaaggggagaggaacggtgggagaagggaaagaggaggaggagggggaggggggagcagagggaagacacatgccagccctgcctactggggcgcccctgataacaaaggaaccagccccaggccaaggccacctgcccctgaccacaagttgaatttgtcactcagactgcagtgtttcccaacattctaattatttgcagaggtgttcaatttggggtaattcacttaaaatccagttttggttcttctgggctgagtgggccctggcccctcccataggctgtggctcccctgggtgccccctctccagtggagctgacccaccgctcagcgctggccttgcagcccttactaaaagacttgaaagtccctgggttcaccccctgagtgaattaaaggccagaggggccccgaagggcactgtgagggacagaggctcacctgggcagtgcagaagccggccgcgtgtccctccttacaggggatgaaatgacctggggaggaaaccccagccctgccctggaggttccagagtaggcgggccggtgctgtgaggcttcacaacctgctgtcccaagcacgcttgagttgtatgtgagtctgtgccgtgccgtgccgtatgcttcagctcctgcaaccccggctgagctcgatttttacctaaatatcagtctccacgggaccccaccttcattcatgccttcttgtccctggggcaatgtgtgtgcttcctcgtcccaatttccattccctggcagtgaggagcccatcgtgccagggggccctgccccacttgtccctgggaaggaataggagggtttgggtgtgacctcacagtccagaccagactgtcccagtcctatgtcagggacacccagatgtagaagctgactgagacctgctgcagggcgtgggtgctcccctctgcttggaggctgtccctggacagtgacccacccactgaggaccaggctgggtgtaccttgagctgggcacagcagcctgtggtgttgcctgtgggtggggagggccccaggtgtgcttctcccgtagcagtcctaggcttctctccctgtgccctgtgtcacctggatcctccagtaaagtgaaattcagcactgtactctctctgtgctctgggcagtggggcaggcggggtgtgggagcgtgggccacagatgtccacggtcttgactgtggtttgcccagaatacctgggaactgtcctgtcactggtttacatacactgtcctttgctgcttcgggatccctgcctggctctccctaccccccagcatcatctcaccccttgcagatctgagccagcttccactcccacccctgatgcctccccacttccagcctcagctccgaagcccctggacacccatggagaccccgcccagccaatccccaccctagcttccacccagatacactctgccaggccacagctgcaggcactctccccccagcctccacccctcacctgtgccctggacctcagactcagctttccatcctacctgagttttctgcctccctccatcctgtgtccccccaccatacatggctgccagagacgtcctcttagaagtcacacctggggtctgattgcgtccctcgcctccccagatcccccaaggtctccttcctgtgccgtcatatctgcagttcttaggactgtctagacatgctttgttcaactaggtaatcacacggggtaaattggatttaaatgtaattaagattaaataaaaatacacatgcatgtc

SEQ ID NO: 163690 - DNA, 2568 bp, Homo sapiens
  Payload ID: 12240
  Gene Symbol: PON1
  Gene Name: paraoxonase 1
  Uniprot ID: P27169
  ENST ID: ENST00000222381
  CDS Start-End: 233-1300
gttggaaggagcaaaatgggacttttggctgaaagtgctgagctcctgcggtgggggctgaccgcaagccacgccttctgtgcacctggtcggcccagctagctgccgacccggcggggaggggcggggcgggccaatcggcgctgccccagcagggctgcggctgcaggcaggcagagcctcctagcccgtcggtgtctgcgcccatcgatccctttgtctatccccgaccatggcgaagctgattgcgctcaccctcttggggatgggactggcactcttcaggaaccaccagtcttcttaccaaacacgacttaatgctctccgagaggtacaacccgtagaacttcctaactgtaatttagttaaaggaatcgaaactggctctgaagacttggagatactgcctaatggactggctttcattagctctggattaaagtatcctggaataaagagcttcaaccccaacagtcctggaaaaatacttctgatggacctgaatgaagaagatccaacagtgttggaattggggatcactggaagtaaatttgatgtatcttcatttaaccctcatgggattagcacattcacagatgaagataatgccatgtacctcctggtggtgaaccatccagatgccaagtccacagtggagttgtttaaatttcaagaagaagaaaaatcgcttttgcatctaaaaaccatcagacataaacttctgcctaatttgaatgatattgttgctgtgggacctgagcacttttatggcacaaatgatcactattttcttgacccctacttacaatcctgggagatgtatttgggtttagcgtggtcgtatgttgtctactatagtccaagtgaagttcgagtggtggcagaaggatttgattttgctaatggaatcaacatttcacccgatggcaagtatgtctatatagctgagttgctggctcataagattcatgtgtatgaaaagcatgctaattggactttaactccattgaagtcccttgactttaataccctcgtggataacatatctgtggatcctgagacaggagacctttgggttggatgccatcccaatggcatgaaaatcttcttctatgactcagagaatcctcctgcatcagaggtgcttcgaatccagaacattctaacagaagaacctaaagtgacacaggtttatgcagaaaatggcacagtgttgcaaggcagtacagttgcctctgtgtacaaagggaaactgctgattggcacagtgtttcacaaagctctttactgtgagctctaacagaccgatttgcacccatgccatagaaactgaggccattatttcaaccgcttgccatattccgaggacccagtgttcttagctgaacaatgaatgctgaccctaaatgtggacatcatgaagcatcaaagcactgtttaactgggagtgatatgatgtgtagggcttttttttgagaatacactatcaaatcagtcttggaatacttgaaaacctcatttaccataaaaatccttctcactaaaatggataaatcagttatgtcaattgtcagatattaaataacagtgtgtgaccccaaaagtacttaccctaaaacatgtgttgcctggaagcacatgtgtgtatcgctgccttgccatgtcttgttcagaagacacaggggagcagggttagctcacgtgtctttagaactccagtactcacccagggactccagttcacaggccagaaaacatatgcattatgaagttcccctctactccatgcacatagtaagtctgactatggcagtcagacttacttactcccattttcccttcgatatatgactttttctcagtaaatattaacctgaattattccaactccccttgtactcttgctttttcaattctcctgttgcaatgacacataggaaaatcttaaaattcttgggagtgttgtcacacctgaaaattatgagtctctatgatcttggcacaaattgtacatttgagtgtctttgacttggttaaaggaagtttgttcacttcgatgactggatacagaatgaatcccataattgacatgggcgaagctaaaagtgtccccaaagactacactgttgttgaggtggtggtagtgctggtgggtttttgtttaatatttaaacttcttgttgtggaggctgaaaagaaaaaaaataatagaaaggtaaacaaacaaataaatagaaaagatcaacaacccctttggctatctactgagacatgactaggaagaaaacatgactttatcattttgttatagaaactgatatataaaggttacacattttcatttatttgtttttctgatttgaaggtataaccttcatgatgaattacttcttcagggtgttaaggcagtgactttagaaacaaatttttttcttgtttttgttttgtttttgagaccgaatctcactctgttgcccaggctggagtgcagtggtgcgatcttggctcactgcaacttctacctccgaggttcaagagattcttgtgcctcagcctcccggatagctg

SEQ ID NO: 163691 - DNA, 1058 bp, Homo sapiens
  Payload ID: 12240
  Gene Symbol: PON1
  Gene Name: paraoxonase 1
  ENST ID: ENST00000433729
  CDS Start-End: 2-235
catggcgaagctgattgcgctcaccctcttggggatgggactggcactcttcaggaaccaccagtcttcttaccaaacacgacttaatgctctccgagaggtacaacccgtagaacttcctaactgtaatttagttaaaggaatcgaaactggctctgaagacttggagatactgcctaatggactggctttcattagctcttcctggaaaaatacttctgatggacctgaatgaagaagatccaacagtgttggaattggggatcactggaagtaaatttgatgtatcttcatttaaccctcatgggattagcacattcacagatgaagataatgccatgtacctcctggtggtgaaccatccagatgccaagtccacagtggagttgtttaaatttcaagaagaagaaaaatcgcttttgcatctaaaaaccatcagacataaacttctgcctaatttgaatgatattgttgctgtgggacctgagcacttttatggcacaaatgatcactattttcttgacccctacttacaatcctgggagatgtatttgggtttagcgtggtcgtatgttgtctactatagtccaagtgaagttcgagtggtggcagaaggatttgattttgctaatggaatcaacatttcacccgatggcaagtatgtctatatagctgagttgctggctcataagattcatgtgtatgaaaagcatgctaattggactttaactccattgaagtcccttgactttaataccctcgtggataacatatctgtggatcctgagacaggagacctttgggttggatgccatcccaatggcatgaaaatcttcttctatgactcagagaatcctcctgcatcagaggtgcttcgaatccagaacattctaacagaagaacctaaagtgacacaggtttatgcagaaaatggcacagtgttgcaaggcagtacagttgcctctgtgtacaaagggaaactgctgattggcacagtgtttcacaaagctctttactgtgagctctaacagaccgatttgcacccatgccatagaaac

SEQ ID NO: 163692 - DNA, 1745 bp, Homo sapiens
  Payload ID: 12241
  Gene Symbol: PON2
  Gene Name: paraoxonase 2
  Uniprot ID: Q15165
  ENST ID: ENST00000222572
  CDS Start-End: 248-1312
aagtttcacatcatgagcctaatgtaaggcgtgtccgggccgtcccgaaggtatctggggaaataggtttgtgaggacaaagaccagggccaggcccagggcggagcctccgcggccccgacgcagggactcggcctaggcggaggacggggcggagcgcggccggcaccatcgagccgggaagatggcaccgcccacggagctgctggccaggccggagcgaggcagcgcgcccggctcccgcgccatggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaaattgtacttttggcatgaaagtgcgataacttaacaattaattttctatgaattgctaattctgagggaatttaaccagcaacattgacccagaaatgtatggcatgtgtagttaattttattccagtaaggaacggcccttttagttcttagagcacttttaacaaaaaaggaaaatgaacaggttctttaaaatgccaagcaagggacagaaaagaaagctgctttcgaataaagtgaatacattttgcacaaagtaagcctcacctttgccttccaactgccagaacatggattccactgaaatagagtgaattatatttccttaaaatgtgagtgacctcacttctggcactgtgactactatggctgtttagaactactgataacgtattttgatgttttgtacttacatctttgtttaccattaaaa

SEQ ID NO: 163693 - DNA, 1726 bp, Homo sapiens
  Payload ID: 12241
  Gene Symbol: PON2
  Gene Name: paraoxonase 2
  ENST ID: ENST00000433091
  CDS Start-End: 248-1276
aagtttcacatcatgagcctaatgtaaggcgtgtccgggccgtcccgaaggtatctggggaaataggtttgtgaggacaaagaccagggccaggcccagggcggagcctccgcggccccgacgcagggactcggcctaggcggaggacggggcggagcgcggccggcaccatcgagccgggaagatggcaccgcccacggagctgctggccaggccggagcgaggcagcgcgcccggctcccgcgccatggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaaattgtacttttggcatgaaagtgcgataacttaacaattaattttctatgaattgctaattctgagggaatttaaccagcaacattgacccagaaatgtatggcatgtgtagttaattttattccagtaaggaacggcccttttagttcttagagcacttttaacaaaaaaggaaaatgaacaggttctttaaaatgccaagcaagggacagaaaagaaagctgctttcgaataaagtgaatacattttgcacaaagtaagcctcacctttgccttccaactgccagaacatggattccactgaaatagagtgaattatatttccttaaaatgtgagtgacctcacttctggcactgtgactactatggctgtttagaactactgataacgtattttgatgttttgtacttacatctttgtttaccattaaaaagttggagttatattaa

SEQ ID NO: 163694 - DNA, 1099 bp, Homo sapiens
  Payload ID: 12241
  Gene Symbol: PON2
  Gene Name: paraoxonase 2
  Uniprot ID: Q15165
  ENST ID: ENST00000446142
  CDS Start-End: 26-178
aggcagcgcgcccggctcccgcgccatggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgtgtggtgagtgtcttcttccttccccaaattcagcagaggagatacaagggtatttgatgagggctgcagaacaggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgt

SEQ ID NO: 163695 - DNA, 1515 bp, Homo sapiens
  Payload ID: 12241
  Gene Symbol: PON2
  Gene Name: paraoxonase 2
  ENST ID: ENST00000455123
  CDS Start-End: 41-700
ggccaggccggagcgaggcagcgcgcccggctcccgcgccatggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaaattgtacttttggcatgaaagtgcgataacttaacaattaattttctatgaattgctaattctgagggaatttaaccagcaacattgacccagaaatgtatggcatgtgtagttaattttattccagtaaggaacggcccttttagttcttagagcacttttaacaaaaaaggaaaatgaacaggttctttaaaatgccaagcaagggacagaaaagaaagctgctttcgaataaagtgaatacattttgcacaaagtaagcctcacctttgccttccaactgccagaacatggattccactgaaatagagtgaattatatttccttaaaatgtgagtgacctcacttctggcactgtgactactatggctgtttagaactactgataacgtattttgatgttttgtacttacatctttgtttaccattaaaaagttggagttatattaaagactaactaaaa

SEQ ID NO: 163696 - DNA, 555 bp, Homo sapiens
  Payload ID: 12241
  Gene Symbol: PON2
  Gene Name: paraoxonase 2
  ENST ID: ENST00000478801
  CDS Start-End: 459-555
atggggcggctggtggctgtgggcttgctggggatcgcgctggcgctcctgggcgagaggcttctggcactcagggaagcctgaagccagaatgccagacagcgcagacactattccatctcgcattttagttttaatgaaaatctctgaaatcgacttaaagcctccagagaagtagaatctgtagaccttccacactgccacctgattaaaggaattgaagctggctctgaagatattgacatacttcccaatggtctggctttttttagtgtgataaggggacagatgaggaggttctgaccacctacctccctggcttgggcagacataggagttcttggcatcttcataggtccagtttttctggaggaagaagtaaccaactctgacacctgactggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactt

SEQ ID NO: 163697 - DNA, 570 bp, Homo sapiens
  Payload ID: 12241
  Gene Symbol: PON2
  Gene Name: paraoxonase 2
  ENST ID: ENST00000632034
  CDS Start-End: 58-312
ccgcccacggagctgctggccaggccggagcgaggcagcgcgcccggctcccgcgccatggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgaagctggctctgaagatattgacatacttcccaatggtctggctttttttagtgtggtgagtgtcttcttccttccccaaattcagcagaggagatacaagggtatttgatgagggctgcagaacaggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagc

SEQ ID NO: 163698 - DNA, 1876 bp, Homo sapiens
  Payload ID: 12241
  Gene Symbol: PON2
  Gene Name: paraoxonase 2
  ENST ID: ENST00000633192
  CDS Start-End: 316-1443
tgctttctatgtaagtttctcactggaatagcgagtgagaaatgtgtttgaagactagggaaacgagaaaggtatgcgggctgctagagggtttcgggtgggttgtttgaaaaaggaagtgaaggaattcaaagtttcacatcatgagcctaatgtaaggcgtgtccgggccgtcccgaaggtatctggggaaataggtttgtgaggacaaagaccagggccaggcccagggcggagcctccgcggccccgacgcagggactcggcctaggcggaggacggggcggagcgcggccggcaccatcgagccgggaagatggcaccgcccacggagctgctggccaggccggagcgaggcagcgcgcccggctcccgcgccatggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaaattgtacttttggcatgaaagtgcgataacttaacaattaattttctatgaattgctaattctgagggaatttaaccagcaacattgacccagaaatgtatggcatgtgtagttaattttattccagtaaggaacggcccttttagttcttagagcacttttaacaaaaaaggaaaatgaacaggttctttaaaatgccaagcaagggacagaaaagaaagctgctttcgaataaagtgaatacattttgcacaaagtaagcctcacctttgccttccaactgccagaacatggattccactgaaatagagtgaattatatttccttaaaatgtgagtgacctcacttctggcactgtgactactatggctgtttagaactactgataacgtattttgatgttttgtacttacatctttgtttaccattaaaa

SEQ ID NO: 163699 - DNA, 566 bp, Homo sapiens
  Payload ID: 12241
  Gene Symbol: PON2
  Gene Name: paraoxonase 2
  ENST ID: ENST00000491069
  CDS Start-End: 1-255
atggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgaagctggctctgaagatattgacatacttcccaatggtctggctttttttagtgtggtgagtgtcttcttccttccccaaattcagcagaggagatacaagggtatttgatgagggctgcagaacaggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaaggt

SEQ ID NO: 163700 - DNA, 645 bp, Homo sapiens
  Payload ID: 12241
  Gene Symbol: PON2
  Gene Name: paraoxonase 2
  ENST ID: ENST00000469926
  CDS Start-End: 305-645
agctgctggccaggccggagcgaggcagcgcgcccggctcccgcgccatggggcggctggtggctgtgggcttgctggggatcgcgctggcgctcctgggcgagaggcttctggcactcagaagctggctctgaagatattgacatacttcccaatggtctggctttttttagtgtggtgagtgtcttcttccttccccaaattcagcagaggagatacaagggtatttgatgagggctgcagaacaggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttaca

SEQ ID NO: 163701 - DNA, 550 bp, Homo sapiens
  Payload ID: 12241
  Gene Symbol: PON2
  Gene Name: paraoxonase 2
  ENST ID: ENST00000493290
  CDS Start-End: 392-550
accgcccacggagctgctggccaggccggagcgaggcagcgcgcccggctcccgcgccatggggcggctggtggctgtgggcttgctggggatcgcgctggcgctcctgggcgagaggcttctggcactcagggaagcctgaagccagaatgccagacagcgcagacactattccatctcgcattttagttttaatgaaaatctctgaaatcgacttaaagcctccagagaagtagaatctgtagaccttccacactgccacctgattaaaggaattgaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaataca

SEQ ID NO: 163702 - DNA, 694 bp, Homo sapiens
  Payload ID: 12241
  Gene Symbol: PON2
  Gene Name: paraoxonase 2
  ENST ID: ENST00000490778
  CDS Start-End: 488-694
gaggacaaagaccagggccaggcccagggcggagcctccgcggccccgacgcagggactcggcctaggcggaggacggggcggagcgcggccggcaccatcgagccgggaagatggcaccgcccacggagctgctggccaggccggagcgaggcagcgcgcccggctcccgcgccatggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgaagctggctctgaagatattgacatacttcccaatggtctggctttttttagtgtggtgagtgtcttcttccttccccaaattcagcagaggagatacaagggtatttgatgagggctgcagaacagactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctg

SEQ ID NO: 163703 - DNA, 1653 bp, Homo sapiens
  Payload ID: 12241
  Gene Symbol: PON2
  Gene Name: paraoxonase 2
  ENST ID: ENST00000633531
  CDS Start-End: 122-1186
ggactcggcctaggcggaggacggggcggagcgcggccggcaccatcgagccgggaagatggcaccgcccacggagctgctggccaggccggagcgaggcagcgcgcccggctcccgcgccatggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaaattgtacttttggcatgaaagtgcgataacttaacaattaattttctatgaattgctaattctgagggaatttaaccagcaacattgacccagaaatgtatggcatgtgtagttaattttattccagtaaggaacggcccttttagttcttagagcacttttaacaaaaaaggaaaatgaacaggttctttaaaatgccaagcaagggacagaaaagaaagctgctttcgaataaagtgaatacattttgcacaaagtaagcctcacctttgccttccaactgccagaacatggattccactgaaatagagtgaattatatttccttaaaatgtgagtgacctcacttctggcactgtgactactatggctgtttagaactactgataacgtattttgatgttttgtacttacatctttgtttaccattaaaaagttggagttatattaaagactaactaaaatccc

SEQ ID NO: 163704 - DNA, 699 bp, Homo sapiens
  Payload ID: 12241
  Gene Symbol: PON2
  Gene Name: paraoxonase 2
  ENST ID: ENST00000483292
  CDS Start-End: 1-367
agaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaagattttgacaatttctcatttggaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaaattgtacttttggcatgaaagtgcgataacttaacaattaattttctatgaa

SEQ ID NO: 163705 - DNA, 1105 bp, Homo sapiens
  Payload ID: 12242
  Gene Symbol: PON3
  Gene Name: paraoxonase 3
  Uniprot ID: Q15166
  ENST ID: ENST00000265627
  CDS Start-End: 12-1076
accccgagaccatggggaagctcgtggcgctggtcctgctgggggtcggcctgtccttagtcggggagatgttcctggcgtttagagaaagggtgaatgcctctcgagaagtggagccagtagaacctgaaaactgccaccttattgaggaacttgaaagtggctctgaagatattgatatacttcctagtgggctggcttttatctccagtggattaaaatatccaggcatgccaaactttgcgccagatgaaccaggaaaaatcttcttgatggatctgaatgaacaaaacccaagggcacaagcgctagaaatcagtggtggatttgacaaagaattatttaatccacatgggatcagtattttcatcgacaaagacaatactgtgtatctttatgttgtgaatcatccccacatgaagtccactgtggagatatttaaatttgaggaacaacaacgttctctggtatacctgaaaactataaaacatgaacttctcaaaagtgtgaatgacattgtggttcttggaccagaacagttctatgccaccagagaccactattttaccaactccctcctgtcattttttgagatgatcttggatcttcgctggacttatgttcttttctacagcccaagggaggttaaagtggtggccaaaggattttgtagtgccaatgggatcacagtctcagcagaccagaagtatgtctatgtagctgatgtagcagctaagaacattcacataatggaaaaacatgataactgggatttaactcaactgaaggtgatacagttgggcaccttagtggataacctgactgtcgatcctgccacaggagacattttggcaggatgccatcctaatcctatgaagctactgaactataaccctgaggaccctccaggatcagaagtacttcgcatccagaatgttttgtctgagaagcccagggtgagcaccgtgtatgccaacaatggctctgtgcttcagggcacctctgtggcttctgtgtaccatgggaaaattctcataggcaccgtatttcacaaaactctgtactgtgagctctagactctagatagtaaaaaaaaaaaaaaaaa

SEQ ID NO: 163706 - DNA, 1127 bp, Homo sapiens
  Payload ID: 12242
  Gene Symbol: PON3
  Gene Name: paraoxonase 3
  ENST ID: ENST00000442770
  CDS Start-End: 14-154
gcaccccgagaccatggggaagctcgtggcgctggtcctgctgggggtcggcctgtccttagtcggggagatgttcctggcgtttagggttgggttttatcttctacagagaaagggtgaatgcctctcgagaagtggagccagtagaacctgaaaactgccaccttattgaggaacttgaaagtggctctgaagatattgatatacttcctagtgggctggcttttatctccagtggattaaaatatccaggcatgccaaactttgcgccagatgaaccaggaaaaatcttcttgatggatctgaatgaacaaaacccaagggcacaagcgctagaaatcagtggtggatttgacaaagaattatttaatccacatgggatcagtattttcatcgacaaagacaatactgtgtatctttatgttgtgaatcatccccacatgaagtccactgtggagatatttaaatttgaggaacaacaacgttctctggtatacctgaaaactataaaacatgaacttctcaaaagtgtgaatgacattgtggttcttggaccagaacagttctatgccaccagagaccactattttaccaactccctcctgtcattttttgagatgatcttggatcttcgctggacttatgttcttttctacagcccaagggaggttaaagtggtggccaaaggattttgtagtgccaatgggatcacagtctcagcagaccagaagtatgtctatgtagctgatgtagcagctaagaacattcacataatggaaaaacatgataactgggatttaactcaactgaaggtgatacagttgggcaccttagtggataacctgactgtcgatcctgccacaggagacattttggcaggatgccatcctaatcctatgaagctactgaactataaccctgaggaccctccaggatcagaagtacttcgcatccagaatgttttgtctgagaagcccagggtgagcaccgtgtatgccaacaatggctctgtgcttcagggcacctctgtggcttctgtgtaccatgggaaaattctcataggcaccgtatttcacaaaactctgtactgtgagctctagactctagatagtaaaaaaaaaaaaaaa

SEQ ID NO: 163707 - DNA, 1049 bp, Homo sapiens
  Payload ID: 12242
  Gene Symbol: PON3
  Gene Name: paraoxonase 3
  ENST ID: ENST00000456855
  CDS Start-End: 14-199
gcaccccgagaccatggggaagctcgtggcgctggtcctgctgggggtcggcctgtccttagtcggggagatgttcctggcgtttagagaaagggtgaatgcctctcgagaagtggagccagtagaacctgaaaactgccaccttattgaggaacttgggattaaaatatccaggcatgccaaactttgcgccagatgaaccaggaaaaatcttcttgatggatctgaatgaacaaaacccaagggcacaagcgctagaaatcagtggtggatttgacaaagaattatttaatccacatgggatcagtattttcatcgacaaagacaatactgtgtatctttatgttgtgaatcatccccacatgaagtccactgtggagatatttaaatttgaggaacaacaacgttctctggtatacctgaaaactataaaacatgaacttctcaaaagtgtgaatgacattgtggttcttggaccagaacagttctatgccaccagagaccactattttaccaactccctcctgtcattttttgagatgatcttggatcttcgctggacttatgttcttttctacagcccaagggaggttaaagtggtggccaaaggattttgtagtgccaatgggatcacagtctcagcagaccagaagtatgtctatgtagctgatgtagcagctaagaacattcacataatggaaaaacatgataactgggatttaactcaactgaaggtgatacagttgggcaccttagtggataacctgactgtcgatcctgccacaggagacattttggcaggatgccatcctaatcctatgaagctactgaactataaccctgaggaccctccaggatcagaagtacttcgcatccagaatgttttgtctgagaagcccagggtgagcaccgtgtatgccaacaatggctctgtgcttcagggcacctctgtggcttctgtgtaccatgggaaaattctcataggcaccgtatttcacaaaactctgtactgtgagctctagactctagatagtaaaaaaaaaaaaaaa

SEQ ID NO: 163708 - DNA, 1000 bp, Homo sapiens
  Payload ID: 12242
  Gene Symbol: PON3
  Gene Name: paraoxonase 3
  ENST ID: ENST00000418617
  CDS Start-End: 14-154
gcaccccgagaccatggggaagctcgtggcgctggtcctgctgggggtcggcctgtccttagtcggggagatgttcctggcgtttagggttgggttttatcttctacagagaaagggtgaatgcctctcgagaagtggagccagtagaacctgaaaactgccaccttattgaggaacttgaaagtggctctgaagatattgatatacttcctagtgggctggcttttatctccagtggattaaaatatccaggcatgccaaactttgcgccagatgaaccaggaaaaatcttcttgatggatctgaatgaacaaaacccaagggcacaagcgctagaaatcagtggtggatttgacaaagaattatttaatccacatgggatcagtattttcatcgacaaagtgtgaatgacattgtggttcttggaccagaacagttctatgccaccagagaccactattttaccaactccctcctgtcattttttgagatgatcttggatcttcgctggacttatgttcttttctacagcccaagggaggttaaagtggtggccaaaggattttgtagtgccaatgggatcacagtctcagcagaccagaagtatgtctatgtagctgatgtagcagctaagaacattcacataatggaaaaacatgataactgggatttaactcaactgaaggtgatacagttgggcaccttagtggataacctgactgtcgatcctgccacaggagacattttggcaggatgccatcctaatcctatgaagctactgaactataaccctgaggaccctccaggatcagaagtacttcgcatccagaatgttttgtctgagaagcccagggtgagcaccgtgtatgccaacaatggctctgtgcttcagggcacctctgtggcttctgtgtaccatgggaaaattctcataggcaccgtatttcacaaaactctgtactgtgagctctagactctagatagtaaaaaaaaaaaaaaa

SEQ ID NO: 163709 - DNA, 1053 bp, Homo sapiens
  Payload ID: 12242
  Gene Symbol: PON3
  Gene Name: paraoxonase 3
  ENST ID: ENST00000451904
  CDS Start-End: 14-826
gcaccccgagaccatggggaagctcgtggcgctggtcctgctgggggtcggcctgtccttagtcggggagatgttcctggcgtttagagaaagggtgaatgcctctcgagaagtggagccagtagaacctgaaaactgccaccttattgaggaacttgaaagtggctctgaagatattgatatacttcctagtgggctggcttttatctccagtggattaaaatatccaggcatgccaaactttgcgccagatgaaccaggaaaaatcttcttgatggatctgaatgaacaaaacccaagggcacaagcgctagaaatcagtggtggatttgacaaagaattatttaatccacatgggatcagtattttcatcgacaaagacaatactgtgtatctttatgttgtgaatcatccccacatgaagtccactgtggagatatttaaatttgaggaacaacaacgttctctggtatacctgaaaactataaaacatgaacttctcaaaagtgtgaatgacattgtggttcttggaccagaacagttctatgccaccagagaccactattttaccaactccctcctgtcattttttgagatgatcttggatcttcgctggacttatgttcttttctacagcccaagggaggttaaagtggtggccaaaggattttgtagtgccaatgggatcacagtctcagcagaccagaagtatgtctatgtagctgatgtagcagctaagaacattcacataatggaaaaacatgataactgggatttaactcaactgaaggagacattttggcaggatgccatcctaatcctatgaagctactgaactataaccctgaggaccctccaggatcagaagtacttcgcatccagaatgttttgtctgagaagcccagggtgagcaccgtgtatgccaacaatggctctgtgcttcagggcacctctgtggcttctgtgtaccatgggaaaattctcataggcaccgtatttcacaaaactctgtactgtgagctctagactctagatagtaaaaaaaaaaaaaaa

SEQ ID NO: 163710 - DNA, 894 bp, Homo sapiens
  Payload ID: 12242
  Gene Symbol: PON3
  Gene Name: paraoxonase 3
  ENST ID: ENST00000427422
  CDS Start-End: 12-749
accccgagaccatggggaagctcgtggcgctggtcctgctgggggtcggcctgtccttagtcggggagatgttcctggcgtttagagaaagggtgaatgcctctcgagaagtggagccagtagaacctgaaaactgccaccttattgaggaacttgaaagtggctctgaagatattgatatacttcctagtgggctggcttttatctccagtggattaaaatatccaggcatgccaaactttgcgccagatgaaccaggaaaaatcttcttgatggatctgaatgaacaaaacccaagggcacaagcgctagaaatcagtggtggatttgacaaagaattatttaatccacatgggatcagtattttcatcgacaaagacaatactgtgtatctttatgttgtgaatcatccccacatgaagtccactgtggagatatttaaatttgaggaacaacaacgttctctggtatacctgaaaactataaaacatgaacttctcaaaagtgtgaatgacattgtggttcttggaccagaacagttctatgccaccagagaccactattttaccaactccctcctgtcattttttgagatgatcttggatcttcgctggacttatgttcttttctacagcccaagggaggttaaagtggtggccaaaggattttgtagtgccaatgggatcacagtctcagcagaccagaagtacttcgcatccagaatgttttgtctgagaagcccagggtgagcaccgtgtatgccaacaatggctctgtgcttcagggcacctctgtggcttctgtgtaccatgggaaaattctcataggcaccgtatttcacaaaactctgtactgtgagctctagactctagatagtaaaaaaaaaaaaaaaaa

SEQ ID NO: 163711 - DNA, 2407 bp, Homo sapiens
  Payload ID: 12243
  Gene Symbol: PSPC1
  Gene Name: paraspeckle component 1
  Uniprot ID: Q8WXF1
  ENST ID: ENST00000338910
  CDS Start-End: 161-1732
cgtgagttgggggaggacgggttgccgactcgcctacctagcggtctcttgattgtcgatattttgttggcataggtttatgtagagacgtatacatatatatagacacactgtctataaatctaggcctgtatccggtgtccgaggcgaactcagtaagatgatgttaagaggaaacctgaagcaagtgcgcattgagaaaaacccggcccgccttcgcgccctggagtccgcggtgggcgagagcgagccggcggccgcggcagccatggcgctcgctcttgccggggagccggcaccgcccgcgcccgcgcctccagaggaccacccggacgaggagatggggttcactatcgacatcaagagtttcctcaagccgggcgagaagacgtacacgcagcgctgccgcctcttcgtgggaaatctgcccaccgacatcacggaggaggacttcaagaggctcttcgaacgctatggcgagcccagcgaagtcttcatcaaccgggaccgtggcttcggcttcatccgcttggaatccagaaccctggctgaaattgcaaaagcagagctggacggcaccattctcaagagcagacctctacggattcgcttcgctacacatggagcagccttgactgtcaagaacctttctccagttgtttccaatgagctgctagagcaagcattttctcagtttggtccagtagagaaagctgttgtggttgtggatgatcgcggtagagctacaggaaaaggttttgtagagtttgcagcaaaacctcctgcacgaaaggctctggaaagatgtggtgatggggcattcttgctaacaacgacccctcgtccagtcattgtggaacccatggagcagtttgatgatgaagatggcttgccagagaagctgatgcagaaaactcaacaatatcataaggaaagagaacaaccaccacgttttgctcaacctgggacatttgaatttgagtatgcatctcgatggaaggctcttgatgaaatggaaaagcagcagcgtgagcaggttgatagaaacatcagagaagccaaagagaaactggaggcagaaatggaagcagctaggcatgaacaccaattaatgctaatgaggcaagatctaatgaggcgtcaagaagaactcagacgcttggaagaactcagaaaccaagagttgcaaaaacggaagcaaatacaactaagacatgaagaggagcatcggcggcgtgaggaagaaatgatccgacacagagaacaggaggaactgaggcgacagcaagagggctttaagccaaactacatggaaaatagagaacaggaaatgagaatgggtgatatgggtccccgtggagcaataaacatgggagatgcgtttagcccagcccctgctggtaaccaaggtcctcctccaatgatgggtatgaatatgaacaacagagcaactatacctggcccaccaatgggtcctggtcctgccatgggaccagaaggagccgcaaatatgggaactccaatgatgccagataatggagcagtgcacaatgacagatttcctcaaggaccaccatctcagatgggttcacctatggggagtagaacaggttctgaaacccctcaagcaccaatgagtggtgtaggtcctgtgagtggtggtcctggtggctttggtagaggaagtcaagggggcaactttgaaggccctaataagcgtcgtagatattaaacattcgttcattcctggctatctagaaaaaaaaaagtcagtggtatgcctttatacttttacctgttatctggaagaaatggttttattgttaatgtatgtagacttaaaagtttttttttttttgtaaaacttgaggtttttgtatttttctttattcatgagctttgtagattagaatggtaatgatgctcatcattttgaatgttgaaatgtgtttgtgactttagctaaatataagtattccatagtactgtgaaatctatgtagttaatctcaataaagaaatcattttggataatttaaaactgttattagtggtattctcttacggtcttactaaactttgctgtaacagtaatgctttggttgctttaactaatcctatcattaaaaatgaaaatgattttgctttttaatttgcgcaagtagcactaaagatagaagcttaattaatgaaagctaatgtcaataaggggtagatagagtagtatatgtgggggtgggagggtatgggagtttaatttgtataaaccactgatgttctgtgaaatcggaatttccagctacatttcatatagcttctgaatattcaggtattctgagacagattattaaggatatctttgtcctgtgctgatttttccaaataaatctttttcatcttgaaaaaaa

SEQ ID NO: 163712 - DNA, 866 bp, Homo sapiens
  Payload ID: 12243
  Gene Symbol: PSPC1
  Gene Name: paraspeckle component 1
  ENST ID: ENST00000427943
  CDS Start-End: 121-866
ggcggaggggtgggacttgcaccggcgtctcttcttctaactgcagtttgtggcagcgccattttgaatgtgcagctgcagcgggcgcctgtatccggtgtccgaggcgaactcagtaagatgatgttaagaggaaacctgaagcaagtgcgcattgagaaaaacccggcccgccttcgcgccctggagtccgcggtgggcgagagcgagccggcggccgcggcagccatggcgctcgctcttgccggggagccggcaccgcccgcgcccgcgcctccagaggaccacccggacgaggagatggggttcactatcgacatcaagagtttcctcaagccgggcgagaagacgtacacgcagcgctgccgcctcttcgtgggaaatctgcccaccgacatcacggaggaggacttcaagaggctcttcgaacgctatggcgagcccagcgaagtcttcatcaaccgggaccgtggcttcggcttcatccgcttggaatccagaaccctggctgaaattgcaaaagcagagctggacggcaccattctcaagagcagacctctacggattcgcttcgctacacatggagcagccttgactgtcaagaacctttctccagttgtttccaatgagctgctagagcaagcattttctcagtttggtccagtagagaaagctgttgtggttgtggatgatcgcggtagagctacaggaaaaggttttgtagagtttgcagcaaaacctcctgcacgaaaggctctggaaagatgtggtgatggggcattcttgctaacaacgacccctcgtccagtcattgtggaacccatggagcagtttgatgatgaagatggcttgccagagaagctgat

SEQ ID NO: 163713 - DNA, 1709 bp, Homo sapiens
  Payload ID: 12243
  Gene Symbol: PSPC1
  Gene Name: paraspeckle component 1
  Uniprot ID: Q8WXF1
  ENST ID: ENST00000492741
  CDS Start-End: 186-1367
attttgaatgtgcagctgcagcgggcgtgagttgggggaggacgggttgccgactcgcctacctagcggtctcttgattgtcgatattttgttggcataggtttatgtagagacgtatacatatatatagacacactgtctataaatctaggcctgtatccggtgtccgaggcgaactcagtaagatgatgttaagaggaaacctgaagcaagtgcgcattgagaaaaacccggcccgccttcgcgccctggagtccgcggtgggcgagagcgagccggcggccgcggcagccatggcgctcgctcttgccggggagccggcaccgcccgcgcccgcgcctccagaggaccacccggacgaggagatggggttcactatcgacatcaagagtttcctcaagccgggcgagaagacgtacacgcagcgctgccgcctcttcgtgggaaatctgcccaccgacatcacggaggaggacttcaagaggctcttcgaacgctatggcgagcccagcgaagtcttcatcaaccgggaccgtggcttcggcttcatccgcttggaatccagaaccctggctgaaattgcaaaagcagagctggacggcaccattctcaagagcagacctctacggattcgcttcgctacacatggagcagccttgactgtcaagaacctttctccagttgtttccaatgagctgctagagcaagcattttctcagtttggtccagtagagaaagctgttgtggttgtggatgatcgcggtagagctacaggaaaaggttttgtagagtttgcagcaaaacctcctgcacgaaaggctctggaaagatgtggtgatggggcattcttgctaacaacgacccctcgtccagtcattgtggaacccatggagcagtttgatgatgaagatggcttgccagagaagctgatgcagaaaactcaacaatatcataaggaaagagaacaaccaccacgttttgctcaacctgggacatttgaatttgagtatgcatctcgatggaaggctcttgatgaaatggaaaagcagcagcgtgagcaggttgatagaaacatcagagaagccaaagagaaactggaggcagaaatggaagcagctaggcatgaacaccaattaatgctaatgaggcaagatctaatgaggcgtcaagaagaactcagacgcttggaagaactcagaaaccaagagttgcaaaaacggaagcaaatacaactaagacatgaagaggagcatcggcggcgtgaggaagaaatgatccgacacagagaacaggaggaactgaggcgacagcaagagggctttaagccaaactacatggaaaatggtgataaaagaaaatgtggctgaagttacccgaagttcagcttgcagtgtaattcagaagagttaagaccagaagtactggaatcatacttcctttcaggtcaaaacattttgtgggaaatatcctgttcgtgacctaggagaaacaagacagaaaacaaatctttcttcatttatgaatttcttactccatacaagcagtttatggatgtctgggcaatcatagcacttgccatttaaaaacatgctacaggggcacattttctgtggttaaaaatgatctccagaataagtgtaaactgcagttttcctttgcattgagggttttggctttttatttgtaaattaaatcaagatgttacccac

SEQ ID NO: 163714 - DNA, 1647 bp, Homo sapiens
  Payload ID: 12243
  Gene Symbol: PSPC1
  Gene Name: paraspeckle component 1
  Uniprot ID: Q8WXF1
  ENST ID: ENST00000471658
  CDS Start-End: 161-1342
cgtgagttgggggaggacgggttgccgactcgcctacctagcggtctcttgattgtcgatattttgttggcataggtttatgtagagacgtatacatatatatagacacactgtctataaatctaggcctgtatccggtgtccgaggcgaactcagtaagatgatgttaagaggaaacctgaagcaagtgcgcattgagaaaaacccggcccgccttcgcgccctggagtccgcggtgggcgagagcgagccggcggccgcggcagccatggcgctcgctcttgccggggagccggcaccgcccgcgcccgcgcctccagaggaccacccggacgaggagatggggttcactatcgacatcaagagtttcctcaagccgggcgagaagacgtacacgcagcgctgccgcctcttcgtgggaaatctgcccaccgacatcacggaggaggacttcaagaggctcttcgaacgctatggcgagcccagcgaagtcttcatcaaccgggaccgtggcttcggcttcatccgcttggaatccagaaccctggctgaaattgcaaaagcagagctggacggcaccattctcaagagcagacctctacggattcgcttcgctacacatggagcagccttgactgtcaagaacctttctccagttgtttccaatgagctgctagagcaagcattttctcagtttggtccagtagagaaagctgttgtggttgtggatgatcgcggtagagctacaggaaaaggttttgtagagtttgcagcaaaacctcctgcacgaaaggctctggaaagatgtggtgatggggcattcttgctaacaacgacccctcgtccagtcattgtggaacccatggagcagtttgatgatgaagatggcttgccagagaagctgatgcagaaaactcaacaatatcataaggaaagagaacaaccaccacgttttgctcaacctgggacatttgaatttgagtatgcatctcgatggaaggctcttgatgaaatggaaaagcagcagcgtgagcaggttgatagaaacatcagagaagccaaagagaaactggaggcagaaatggaagcagctaggcatgaacaccaattaatgctaatgaggcaagatctaatgaggcgtcaagaagaactcagacgcttggaagaactcagaaaccaagagttgcaaaaacggaagcaaatacaactaagacatgaagaggagcatcggcggcgtgaggaagaaatgatccgacacagagaacaggaggaactgaggcgacagcaagagggctttaagccaaactacatggaaaatggtgataaaagaaaatgtggctgaagttacccgaagttcagcttgcagtgtaattcagaagagttaagaccagaagtactggaatcatacttcctttcagtcttgccacttgcctagtgaggcttttccgaacctggaaggagacgtctagaaatcccaactttgctgtgtaaggaccattagctgcaagtcagtggaagtctatagaaagcagtgtgaattccatagtggtcttgacttcttagcaaggatttgggataagtctaaaacttcagacttaaagctttgaagcatgttaactgcatgaaatattaaacatttcgaacttc

SEQ ID NO: 163715 - DNA, 2013 bp, Homo sapiens
  Payload ID: 12243
  Gene Symbol: PSPC1
  Gene Name: paraspeckle component 1
  Uniprot ID: Q8WXF1
  ENST ID: ENST00000619300
  CDS Start-End: 138-1709
gttccggcgccggctttggcggaggggtgggacttgcaccggcgtctcttcttctaactgcagtttgtggcagcgccattttgaatgtgcagctgcagcgggcgcctgtatccggtgtccgaggcgaactcagtaagatgatgttaagaggaaacctgaagcaagtgcgcattgagaaaaacccggcccgccttcgcgccctggagtccgcggtgggcgagagcgagccggcggccgcggcagccatggcgctcgctcttgccggggagccggcaccgcccgcgcccgcgcctccagaggaccacccggacgaggagatggggttcactatcgacatcaagagtttcctcaagccgggcgagaagacgtacacgcagcgctgccgcctcttcgtgggaaatctgcccaccgacatcacggaggaggacttcaagaggctcttcgaacgctatggcgagcccagcgaagtcttcatcaaccgggaccgtggcttcggcttcatccgcttggaatccagaaccctggctgaaattgcaaaagcagagctggacggcaccattctcaagagcagacctctacggattcgcttcgctacacatggagcagccttgactgtcaagaacctttctccagttgtttccaatgagctgctagagcaagcattttctcagtttggtccagtagagaaagctgttgtggttgtggatgatcgcggtagagctacaggaaaaggttttgtagagtttgcagcaaaacctcctgcacgaaaggctctggaaagatgtggtgatggggcattcttgctaacaacgacccctcgtccagtcattgtggaacccatggagcagtttgatgatgaagatggcttgccagagaagctgatgcagaaaactcaacaatatcataaggaaagagaacaaccaccacgttttgctcaacctgggacatttgaatttgagtatgcatctcgatggaaggctcttgatgaaatggaaaagcagcagcgtgagcaggttgatagaaacatcagagaagccaaagagaaactggaggcagaaatggaagcagctaggcatgaacaccaattaatgctaatgaggcaagatctaatgaggcgtcaagaagaactcagacgcttggaagaactcagaaaccaagagttgcaaaaacggaagcaaatacaactaagacatgaagaggagcatcggcggcgtgaggaagaaatgatccgacacagagaacaggaggaactgaggcgacagcaagagggctttaagccaaactacatggaaaatagagaacaggaaatgagaatgggtgatatgggtccccgtggagcaataaacatgggagatgcgtttagcccagcccctgctggtaaccaaggtcctcctccaatgatgggtatgaatatgaacaacagagcaactatacctggcccaccaatgggtcctggtcctgccatgggaccagaaggagccgcaaatatgggaactccaatgatgccagataatggagcagtgcacaatgacagatttcctcaaggaccaccatctcagatgggttcacctatggggagtagaacaggttctgaaacccctcaagcaccaatgagtggtgtaggtcctgtgagtggtggtcctggtggctttggtagaggaagtcaagggggcaactttgaaggccctaataagcgtcgtagatattaaacattcgttcattcctggctatctagaaaaaaaaaagtcagtggtatgcctttatacttttacctgttatctggaagaaatggttttattgttaatgtatgtagacttaaaagtttttttttttttgtaaaacttgaggtttttgtatttttctttattcatgagctttgtagattagaatggtaatgatgctcatcattttgaatgttgaaatgtgtttgtgactttagctaaatataagtattccatagtactgtgaaatctatgtagttaatctcaataaagaaatcattttggataattt

SEQ ID NO: 163716 - DNA, 422 bp, Homo sapiens
  Payload ID: 12243
  Gene Symbol: PSPC1
  Gene Name: paraspeckle component 1
  ENST ID: ENST00000635562
  CDS Start-End: 1-102
gaagaaatgatccgacacagagaacaggaggaactgaggcgacagcaagagggctttaagccaaactacatggaaaattatgtctgccatttcctaaggtgataaaagaaaatgtggctgaagttacccgaagttcagcttgcagtgtaattcagaagagttaagaccagaagtactggaatcatacttcctttcaggtcaaaacattttgtgggaaatatcctgttcgtgacctaggagaaacaagacagaaaacaaatctttcttcatttatgaatttcttactccatacaagcagtttatggatgtctgggcaatcatagcacttgccatttaaaaacatgctacaggggcacattttctgtggttaaaaatgatctccagaataagtgtaaactgcagttttcctttgcattgagggt

SEQ ID NO: 163717 - DNA, 1139 bp, Homo sapiens
  Payload ID: 12244
  Gene Symbol: PTMS
  Gene Name: parathymosin
  Uniprot ID: P20962
  ENST ID: ENST00000309083
  CDS Start-End: 330-638
ggcagctctgctggtgcgggggcggcgagcccgggatcgagctaccgcggccgagcgcgccggccaccgcctgcaccgcccttccgcccgccctccggacggccgcagccctgcgggtctccgctccagacccacccccgccccaccccgcgcgcctctgccgcctcttccagagacccagcttgccgagcggccgccgctgccgctgtcgccgccgccgccgccaccgcgccaggttccggccgcggccaccctccgccgtccagggcccctccgtctcggccccgggaccccggctccccgccagccccggccccggccccggcaccatgtcggagaaaagcgtggaggcagcggccgagttgagcgccaaggacctgaaggagaagaaggagaaggtggaggagaaggcaagccggaaagagcgaaagaaagaagtggtggaggaggaggagaacggggctgaggaggaagaagaagaaactgccgaggatggagaggaggaagatgaaggggaagaagaagatgaggaagaagaagaagaggatgatgaagggcccgcgctgaagagagctgccgaagaggaggatgaagcggatcccaaacggcagaagacagaaaatggggcatcggcgtgagcccctgccaacaggctggggttgggaggcctctctgggcctggaggtgggggtgggggcagccaagtccagccactcttcacctggctccctgctctgggccctgcaccagagctgccaccctcttctttctccccagccttctcatttccgcctctccagacactgcgccctccaccctcactctgccattgttccacctcctgacctgctccatctgagctctccagctggcccccaattgctcctctctctctttgctctctttctccctcccctaccagcctcattcttcctccggtagcctctcccacctaacctctgcatcccccagcctcatgtcctgccccatccctatcctgcctgatccctggatctccctcagatcccctcttctcagacagcgccaggccggggtggggccggggttggggccgagccccacagctgcccccctcccctccctttttgtataatttaataaagaaatggtcgcgcttc

SEQ ID NO: 163718 - DNA, 773 bp, Homo sapiens
  Payload ID: 12244
  Gene Symbol: PTMS
  Gene Name: parathymosin
  ENST ID: ENST00000389462
  CDS Start-End: 332-646
gcggcagctctgctggtgcgggggcggcgagcccgggatcgagctaccgcggccgagcgcgccggccaccgcctgcaccgcccttccgcccgccctccggacggccgcagccctgcgggtctccgctccagacccacccccgccccaccccgcgcgcctctgccgcctcttccagagacccagcttgccgagcggccgccgctgccgctgtcgccgccgccgccgccaccgcgccaggttccggccgcggccaccctccgccgtccagggcccctccgtctcggccccgggaccccggctccccgccagccccggccccggccccggcaccatgtcggagaaaagcgtggaggcagcggccgagttgagcgccaaggacctgaaggagaagaaggagaaggtggaggagaaggcaagccggaaagagcgaaagaaagaagtggtggaggctccagtcccattggtggtgatggtgggcaaggcatgcagccagcctgaggctactccctctcctggtccccacaggaggaggagaacggggctgaggaggaagaagaagaaactgccgaggatggagaggaggaagatgaaggggaagaagaagatgaggaagaagaagaagaggatgatgaagggcccgcgctgaagagagctgccgaagaggaggatgaagcggatcccaaacggcagaagacagaaaatggggcatcggcgtgagcccctgccaacaggctggggttgggaggcctctctgggcctggaggtgggggtgg

SEQ ID NO: 163719 - DNA, 501 bp, Homo sapiens
  Payload ID: 12244
  Gene Symbol: PTMS
  Gene Name: parathymosin
  ENST ID: ENST00000540874
  CDS Start-End: 331-501
cggcagctctgctggtgcgggggcggcgagcccgggatcgagctaccgcggccgagcgcgccggccaccgcctgcaccgcccttccgcccgccctccggacggccgcagccctgcgggtctccgctccagacccacccccgccccaccccgcgcgcctctgccgcctcttccagagacccagcttgccgagcggccgccgctgccgctgtcgccgccgccgccgccaccgcgccaggttccggccgcggccaccctccgccgtccagggcccctccgtctcggccccgggaccccggctccccgccagccccggccccggccccggcaccatgtcggagaaaagcgtggaggcagcggccgagttgagcgccaaggacctgaaggagaagaaggagaaggtggaggagaaggcaagccggaaagagcgaaagaaagaagtggtggaggctccagtcccattggtggtgatggtgggcaaggcatgcagccagcctgaggct

SEQ ID NO: 163720 - DNA, 1150 bp, Homo sapiens
  Payload ID: 12244
  Gene Symbol: PTMS
  Gene Name: parathymosin
  Uniprot ID: P20962
  ENST ID: ENST00000619580
  CDS Start-End: 332-640
gcggcagctctgctggtgcgggggcggcgagcccgggatcgagctaccgcggccgagcgcgccggccaccgcctgcaccgcccttccgcccgccctccggacggccgcagccctgcgggtctccgctccagacccacccccgccccaccccgcgcgcctctgccgcctcttccagagacccagcttgccgagcggccgccgctgccgctgtcgccgccgccgccgccaccgcgccaggttccggccgcggccaccctccgccgtccagggcccctccgtctcggccccgggaccccggctccccgccagccccggccccggccccggcaccatgtcggagaaaagcgtggaggcagcggccgagttgagcgccaaggacctgaaggagaagaaggagaaggtggaggagaaggcaagccggaaagagcgaaagaaagaagtggtggaggaggaggagaacggggctgaggaggaagaagaagaaactgccgaggatggagaggaggaagatgaaggggaagaagaagatgaggaagaagaagaagaggatgatgaagggcccgcgctgaagagagctgccgaagaggaggatgaagcggatcccaaacggcagaagacagaaaatggggcatcggcgtgagcccctgccaacaggctggggttgggaggcctctctgggcctggaggtgggggtgggggcagccaagtccagccactcttcacctggctccctgctctgggccctgcaccagagctgccaccctcttctttctccccagccttctcatttccgcctctccagacactgcgccctccaccctcactctgccattgttccacctcctgacctgctccatctgagctctccagctggcccccaattgctcctctctctctttgctctctttctccctcccctaccagcctcattcttcctccggtagcctctcccacctaacctctgcatcccccagcctcatgtcctgccccatccctatcctgcctgatccctggatctccctcagatcccctcttctcagacagcgccaggccggggtggggccggggttggggccgagccccacagctgcccccctcccctccctttttgtataatttaataaagaaatggtcgcgcttctgtttttaa

SEQ ID NO: 163721 - DNA, 813 bp, Homo sapiens
  Payload ID: 12245
  Gene Symbol: PTH
  Gene Name: parathyroid hormone
  Uniprot ID: P01270
  ENST ID: ENST00000282091
  CDS Start-End: 116-463
aaaagtcaccatttaaggggtctgcagtccaattcatcagttgtctttagtttactcagcatcagctactaacatacctgaacgaagatcttgttctaagacattgtatgtgaagatgatacctgcaaaagacatggctaaagttatgattgtcatgttggcaatttgttttcttacaaaatcggatgggaaatctgttaagaagagatctgtgagtgaaatacagcttatgcataacctgggaaaacatctgaactcgatggagagagtagaatggctgcgtaagaagctgcaggatgtgcacaattttgttgcccttggagctcctctagctcccagagatgctggttcccagaggccccgaaaaaaggaagacaatgtcttggttgagagccatgaaaaaagtcttggagaggcagacaaagctgatgtgaatgtattaactaaagctaaatcccagtgaaaatgaaaacagatattgtcagagttctgctctagacagtgtagggcaacaatacatgctgctaattcaaagctctattaagatttccaagtgccaatatttctgatataacaaactacatgtaatccatcactagccatgataactgcaattttaattgattattctgattccacttttattcatttgagttattttaattatcttttctattgtttattctttttaaagtatgttattgcataatttataaaagaataaaattgcacttttaaacctctcttctaccttaaaatgtaaaacaaaaatgtaatgatcataagtctaaataaatgaagtatttctcactc

SEQ ID NO: 163722 - DNA, 799 bp, Homo sapiens
  Payload ID: 12245
  Gene Symbol: PTH
  Gene Name: parathyroid hormone
  Uniprot ID: P01270
  ENST ID: ENST00000529816
  CDS Start-End: 146-493
ccttttagtatccaattatctgaaacttaagaagagtgtgcaccgcccaatgggtgtgtgtatgtgctgctttgaacctatagttgagatccagagaattgggagtgacatcatctgtaacaataaaagagcctctcttgtgaagatgatacctgcaaaagacatggctaaagttatgattgtcatgttggcaatttgttttcttacaaaatcggatgggaaatctgttaagaagagatctgtgagtgaaatacagcttatgcataacctgggaaaacatctgaactcgatggagagagtagaatggctgcgtaagaagctgcaggatgtgcacaattttgttgcccttggagctcctctagctcccagagatgctggttcccagaggccccgaaaaaaggaagacaatgtcttggttgagagccatgaaaaaagtcttggagaggcagacaaagctgatgtgaatgtattaactaaagctaaatcccagtgaaaatgaaaacagatattgtcagagttctgctctagacagtgtagggcaacaatacatgctgctaattcaaagctctattaagatttccaagtgccaatatttctgatataacaaactacatgtaatccatcactagccatgataactgcaattttaattgattattctgattccacttttattcatttgagttattttaattatcttttctattgtttattctttttaaagtatgttattgcataatttataaaagaataaaattgcacttttaaacctctcttctaccttaaaatgtaaaacaaa

SEQ ID NO: 163723 - DNA, 2123 bp, Homo sapiens
  Payload ID: 12246
  Gene Symbol: PTH1R
  Gene Name: parathyroid hormone 1 receptor
  Uniprot ID: Q03431
  ENST ID: ENST00000313049
  CDS Start-End: 204-1985
cgctgctcgctcgctcgctcgctcgctcgccctcagcgcatgggccccgcgccgggccccggggcctcgggccgccgggacgccggggtcccataggccggggcgtgggcggggcggccagcctgacgcagctctgcaccccctaccaccaccagggccggcggcggcggctgccccgagggacgcggccctaggcggtggcgatggggaccgcccggatcgcacccggcctggcgctcctgctctgctgccccgtgctcagctccgcgtacgcgctggtggatgcagatgacgtcatgactaaagaggaacagatcttcctgctgcaccgtgctcaggcccagtgcgaaaaacggctcaaggaggtcctgcagaggccagccagcataatggaatcagacaagggatggacatctgcgtccacatcagggaagcccaggaaagataaggcatctgggaagctctaccctgagtctgaggaggacaaggaggcacccactggcagcaggtaccgagggcgcccctgtctgccggaatgggaccacatcctgtgctggccgctgggggcaccaggtgaggtggtggctgtgccctgtccggactacatttatgacttcaatcacaaaggccatgcctaccgacgctgtgaccgcaatggcagctgggagctggtgcctgggcacaacaggacgtgggccaactacagcgagtgtgtcaaatttctcaccaatgagactcgtgaacgggaggtgtttgaccgcctgggcatgatttacaccgtgggctactccgtgtccctggcgtccctcaccgtagctgtgctcatcctggcctactttaggcggctgcactgcacgcgcaactacatccacatgcacctgttcctgtccttcatgctgcgcgccgtgagcatcttcgtcaaggacgctgtgctctactctggcgccacgcttgatgaggctgagcgcctcaccgaggaggagctgcgcgccatcgcccaggcgcccccgccgcctgccaccgccgctgccggctacgcgggctgcagggtggctgtgaccttcttcctttacttcctggccaccaactactactggattctggtggaggggctgtacctgcacagcctcatcttcatggccttcttctcagagaagaagtacctgtggggcttcacagtcttcggctggggtctgcccgctgtcttcgtggctgtgtgggtcagtgtcagagctaccctggccaacaccgggtgctgggacttgagctccgggaacaaaaagtggatcatccaggtgcccatcctggcctccattgtgctcaacttcatcctcttcatcaatatcgtccgggtgctcgccaccaagctgcgggagaccaacgccggccggtgtgacacacggcagcagtaccggaagctgctcaaatccacgctggtgctcatgcccctctttggcgtccactacattgtcttcatggccacaccatacaccgaggtctcagggacgctctggcaagtccagatgcactatgagatgctcttcaactccttccagggattttttgtcgcaatcatatactgtttctgcaatggcgaggtacaagctgagatcaagaaatcttggagccgctggacactggcactggacttcaagcgaaaggcacgcagcgggagcagcagctatagctacggccccatggtgtcccacacaagtgtgaccaatgtcggcccccgtgtgggactcggcctgcccctcagcccccgcctactgcccactgccaccaccaacggccaccctcagctgcctggccatgccaagccagggaccccagccctggagaccctcgagaccacaccacctgccatggctgctcccaaggacgatgggttcctcaacggctcctgctcaggcctggacgaggaggcctctgggcctgagcggccacctgccctgctacaggaagagtgggagacagtcatgtgaccaggcgctgggggctggacctgctgacatagtggatggacagatggaccaaaagatgggtggttgaatgatttcccactcagggctggggccaagaggaaaaacagggaaaaaaagaaaaaaaaaagaaaaaggaaa

SEQ ID NO: 163724 - DNA, 2063 bp, Homo sapiens
  Payload ID: 12246
  Gene Symbol: PTH1R
  Gene Name: parathyroid hormone 1 receptor
  ENST ID: ENST00000428220
  CDS Start-End: 204-1205
cgctgctcgctcgctcgctcgctcgctcgccctcagcgcatgggccccgcgccgggccccggggcctcgggccgccgggacgccggggtcccataggccggggcgtgggcggggcggccagcctgacgcagctctgcaccccctaccaccaccagggccggcggcggcggctgccccgagggacgcggccctaggcggtggcgatggggaccgcccggatcgcacccggcctggcgctcctgctctgctgccccgtgctcagctccgcgtacgcgctggtggatgcagatgacgtcatgactaaagaggaacagatcttcctgctgcaccgtgctcaggcccagtgcgaaaaacggctcaaggaggtcctgcagaggccagccagcataatggaatcagacaagggatggacatctgcgtccacatcagggaagcccaggaaagataaggcatctgggaagctctaccctgagtctgaggaggacaaggaggcacccactggcagcaggtaccgagggcgcccctgtctgccggaatgggaccacatcctgtgctggccgctgggggcaccaggtgaggtggtggctgtgccctgtccggactacatttatgacttcaatcacaaaggccatgcctaccgacgctgtgaccgcaatggcagctgggagctggtgcctgggcacaacaggacgtgggccaactacagcgagtgtgtcaaatttctcaccaatgagactcgtgaacgggaggtgtttgaccgcctgggcatgatttacaccgtgggctactccgtgtccctggcgtccctcaccgtagctgtgctcatcctggcctactttaggcggctgcactgcacgcgcaactacatccacatgcacctgttcctgtccttcatgctgcgcgccgtgagcatcttcgtcaaggacgctgtgctctactctggcgccacgcttgatgaggctgagcgcctcaccgaggaggagctgcgcgccatcgcccaggcgcccccgccgcctgccaccgccgctgccggctacgcgggctgcagggtggctgtgaccttcttcctttacttcctggccaccaactactactggattctggtggaggggctgtacctgcacagcctcatcttcatggccttcttctcagagaagaagtacctgtggggcttcacagtcttcggctggggtgctgggacttgagctccgggaacaaaaagtggatcatccaggtgcccatcctggcctccattgtgctcaacttcatcctcttcatcaatatcgtccgggtgctcgccaccaagctgcgggagaccaacgccggccggtgtgacacacggcagcagtaccggaagctgctcaaatccacgctggtgctcatgcccctctttggcgtccactacattgtcttcatggccacaccatacaccgaggtctcagggacgctctggcaagtccagatgcactatgagatgctcttcaactccttccagggattttttgtcgcaatcatatactgtttctgcaatggcgaggtacaagctgagatcaagaaatcttggagccgctggacactggcactggacttcaagcgaaaggcacgcagcgggagcagcagctatagctacggccccatggtgtcccacacaagtgtgaccaatgtcggcccccgtgtgggactcggcctgcccctcagcccccgcctactgcccactgccaccaccaacggccaccctcagctgcctggccatgccaagccagggaccccagccctggagaccctcgagaccacaccacctgccatggctgctcccaaggacgatgggttcctcaacggctcctgctcaggcctggacgaggaggcctctgggcctgagcggccacctgccctgctacaggaagagtgggagacagtcatgtgaccaggcgctgggggctggacctgctgacatagtggatggacagatggaccaaaagatgggtggttgaatgatttcccactcagggctggggccaagaggaaaaacagggaaaaaaagaaaaaaaaaagaaaaaggaaaa

SEQ ID NO: 163725 - DNA, 692 bp, Homo sapiens
  Payload ID: 12246
  Gene Symbol: PTH1R
  Gene Name: parathyroid hormone 1 receptor
  ENST ID: ENST00000422115
  CDS Start-End: 1-549
tacaccgaggtctcagggacgctctggcaagtccagatgcactatgagatgctcttcaactccttccagggattttttgtcgcaatcatatactgtttctgcaatggcgagaacacccctgaggacattctgaaagcagagaagtctttccagatgatgcaggtacaagctgagatcaagaaatcttggagccgctggacactggcactggacttcaagcgaaaggcacgcagcgggagcagcagctatagctacggccccatggtgtcccacacaagtgtgaccaatgtcggcccccgtgtgggactcggcctgcccctcagcccccgcctactgcccactgccaccaccaacggccaccctcagctgcctggccatgccaagccagggaccccagccctggagaccctcgagaccacaccacctgccatggctgctcccaaggacgatgggttcctcaacggctcctgctcaggcctggacgaggaggcctctgggcctgagcggccacctgccctgctacaggaagagtgggagacagtcatgtgaccaggcgctgggggctggacctgctgacatagtggatggacagatggaccaaaagatgggtggttgaatgatttcccactcagggctggggccaagaggaaaaacagggaaaaaaagaaaaaaaaaagaaaaaggaaaaggaa

SEQ ID NO: 163726 - DNA, 1914 bp, Homo sapiens
  Payload ID: 12246
  Gene Symbol: PTH1R
  Gene Name: parathyroid hormone 1 receptor
  ENST ID: ENST00000427125
  CDS Start-End: 334-1914
gagggggtgggggcgggagaggcccgggagggcgcgggggagggaagaggcgcccggccggggagaaggggagcggcagacgccgaggcgagggatgcgcgcggcgggcggtggctccgagcggcggccgggcggggggcgctggaggccaggccggccagcggggggtatcccgagagctccatgaagtccccccggggccgcggacggggcgctggcttggggaggctgtcgggggggccccgacatccatggcaaggcgggggccgcggcggcgcgctcggaggccggcggcggcggctgccccgagggacgcggccctaggcggtggcgatggggaccgcccggatcgcacccggcctggcgctcctgctctgctgccccgtgctcagctccgcgtacgcgctggtggatgcagatgacgtcatgactaaagaggaacagatcttcctgctgcaccgtgctcaggcccagtgcgaaaaacggctcaaggaggtcctgcagaggccagccagcataatggaatcagacaagggatggacatctgcgtccacatcagggaagcccaggaaagataaggcatctgggaagctctaccctgagtctgaggaggacaaggaggcacccactggcagcaggtaccgagggcgcccctgtctgccggaatgggaccacatcctgtgctggccgctgggggcaccaggtgaggtggtggctgtgccctgtccggactacatttatgacttcaatcacaaaggccatgcctaccgacgctgtgaccgcaatggcagctgggagctggtgcctgggcacaacaggacgtgggccaactacagcgagtgtgtcaaatttctcaccaatgagactcgtgaacgggaggtgtttgaccgcctgggcatgatttacaccgtgggctactccgtgtccctggcgtccctcaccgtagctgtgctcatcctggcctactttaggcggctgcactgcacgcgcaactacatccacatgcacctgttcctgtccttcatgctgcgcgccgtgagcatcttcgtcaaggacgctgtgctctactctggcgccacgcttgatgaggctgagcgcctcaccgaggaggagctgcgcgccatcgcccaggcgcccccgccgcctgccaccgccgctgccggctacgcgggctgcagggtggctgtgaccttcttcctttacttcctggccaccaactactactggattctggtggaggggctgtacctgcacagcctcatcttcatggccttcttctcagagaagaagtacctgtggggcttcacagtcttcggctggggtctgcccgctgtcttcgtggctgtgtgggtcagtgtcagagctaccctggccaacaccgggtgctgggacttgagctccgggaacaaaaagtggatcatccaggtgcccatcctggcctccattgtgctcaacttcatcctcttcatcaatatcgtccgggtgctcgccaccaagctgcgggagaccaacgccggccggtgtgacacacggcagcagtaccggaagctgctcaaatccacgctggtgctcatgcccctctttggcgtccactacattgtcttcatggccacaccatacaccgaggtctcagggacgctctggcaagtccagatgcactatgagatgctcttcaactccttccagggattttttgtcgcaatcatatactgtttctgcaatggcgaggtacaagctgagatcaagaaatcttggagccgctggacactggcactggacttcaagcgaaaggcacgcagcgggagcagcagctatagctacggccccatggtgtcccacacaagtgtgaccaatgtcggcccccgtgtgggactcggcctgcccctcagcccccgcctactgcccactgccacc

SEQ ID NO: 163727 - DNA, 2123 bp, Homo sapiens
  Payload ID: 12246
  Gene Symbol: PTH1R
  Gene Name: parathyroid hormone 1 receptor
  Uniprot ID: Q03431
  ENST ID: ENST00000449590
  CDS Start-End: 204-1985
ccacagaagctgctcagggactatccatggcctccccgtggccaacttgagtctgctctgcagctttaggcccgacttggaaggcccatgggctgcagatgaggaaactgaggtccagacagccgaagagtggtagtgtccaggacacacaactgggccggcggcggcggctgccccgagggacgcggccctaggcggtggcgatggggaccgcccggatcgcacccggcctggcgctcctgctctgctgccccgtgctcagctccgcgtacgcgctggtggatgcagatgacgtcatgactaaagaggaacagatcttcctgctgcaccgtgctcaggcccagtgcgaaaaacggctcaaggaggtcctgcagaggccagccagcataatggaatcagacaagggatggacatctgcgtccacatcagggaagcccaggaaagataaggcatctgggaagctctaccctgagtctgaggaggacaaggaggcacccactggcagcaggtaccgagggcgcccctgtctgccggaatgggaccacatcctgtgctggccgctgggggcaccaggtgaggtggtggctgtgccctgtccggactacatttatgacttcaatcacaaaggccatgcctaccgacgctgtgaccgcaatggcagctgggagctggtgcctgggcacaacaggacgtgggccaactacagcgagtgtgtcaaatttctcaccaatgagactcgtgaacgggaggtgtttgaccgcctgggcatgatttacaccgtgggctactccgtgtccctggcgtccctcaccgtagctgtgctcatcctggcctactttaggcggctgcactgcacgcgcaactacatccacatgcacctgttcctgtccttcatgctgcgcgccgtgagcatcttcgtcaaggacgctgtgctctactctggcgccacgcttgatgaggctgagcgcctcaccgaggaggagctgcgcgccatcgcccaggcgcccccgccgcctgccaccgccgctgccggctacgcgggctgcagggtggctgtgaccttcttcctttacttcctggccaccaactactactggattctggtggaggggctgtacctgcacagcctcatcttcatggccttcttctcagagaagaagtacctgtggggcttcacagtcttcggctggggtctgcccgctgtcttcgtggctgtgtgggtcagtgtcagagctaccctggccaacaccgggtgctgggacttgagctccgggaacaaaaagtggatcatccaggtgcccatcctggcctccattgtgctcaacttcatcctcttcatcaatatcgtccgggtgctcgccaccaagctgcgggagaccaacgccggccggtgtgacacacggcagcagtaccggaagctgctcaaatccacgctggtgctcatgcccctctttggcgtccactacattgtcttcatggccacaccatacaccgaggtctcagggacgctctggcaagtccagatgcactatgagatgctcttcaactccttccagggattttttgtcgcaatcatatactgtttctgcaatggcgaggtacaagctgagatcaagaaatcttggagccgctggacactggcactggacttcaagcgaaaggcacgcagcgggagcagcagctatagctacggccccatggtgtcccacacaagtgtgaccaatgtcggcccccgtgtgggactcggcctgcccctcagcccccgcctactgcccactgccaccaccaacggccaccctcagctgcctggccatgccaagccagggaccccagccctggagaccctcgagaccacaccacctgccatggctgctcccaaggacgatgggttcctcaacggctcctgctcaggcctggacgaggaggcctctgggcctgagcggccacctgccctgctacaggaagagtgggagacagtcatgtgaccaggcgctgggggctggacctgctgacatagtggatggacagatggaccaaaagatgggtggttgaatgatttcccactcagggctggggccaagaggaaaaacagggaaaaaaagaaaaaaaaaagaaaaaggaaa

SEQ ID NO: 163728 - DNA, 2070 bp, Homo sapiens
  Payload ID: 12246
  Gene Symbol: PTH1R
  Gene Name: parathyroid hormone 1 receptor
  Uniprot ID: Q03431
  ENST ID: ENST00000418619
  CDS Start-End: 150-1931
ggcagaagagtatgatcctggcagaggaagcagcaaggacaaagatgaggaaactgaggtccagacagccgaagagtggtagtgtccaggacacacaactgggccggcggcggcggctgccccgagggacgcggccctaggcggtggcgatggggaccgcccggatcgcacccggcctggcgctcctgctctgctgccccgtgctcagctccgcgtacgcgctggtggatgcagatgacgtcatgactaaagaggaacagatcttcctgctgcaccgtgctcaggcccagtgcgaaaaacggctcaaggaggtcctgcagaggccagccagcataatggaatcagacaagggatggacatctgcgtccacatcagggaagcccaggaaagataaggcatctgggaagctctaccctgagtctgaggaggacaaggaggcacccactggcagcaggtaccgagggcgcccctgtctgccggaatgggaccacatcctgtgctggccgctgggggcaccaggtgaggtggtggctgtgccctgtccggactacatttatgacttcaatcacaaaggccatgcctaccgacgctgtgaccgcaatggcagctgggagctggtgcctgggcacaacaggacgtgggccaactacagcgagtgtgtcaaatttctcaccaatgagactcgtgaacgggaggtgtttgaccgcctgggcatgatttacaccgtgggctactccgtgtccctggcgtccctcaccgtagctgtgctcatcctggcctactttaggcggctgcactgcacgcgcaactacatccacatgcacctgttcctgtccttcatgctgcgcgccgtgagcatcttcgtcaaggacgctgtgctctactctggcgccacgcttgatgaggctgagcgcctcaccgaggaggagctgcgcgccatcgcccaggcgcccccgccgcctgccaccgccgctgccggctacgcgggctgcagggtggctgtgaccttcttcctttacttcctggccaccaactactactggattctggtggaggggctgtacctgcacagcctcatcttcatggccttcttctcagagaagaagtacctgtggggcttcacagtcttcggctggggtctgcccgctgtcttcgtggctgtgtgggtcagtgtcagagctaccctggccaacaccgggtgctgggacttgagctccgggaacaaaaagtggatcatccaggtgcccatcctggcctccattgtgctcaacttcatcctcttcatcaatatcgtccgggtgctcgccaccaagctgcgggagaccaacgccggccggtgtgacacacggcagcagtaccggaagctgctcaaatccacgctggtgctcatgcccctctttggcgtccactacattgtcttcatggccacaccatacaccgaggtctcagggacgctctggcaagtccagatgcactatgagatgctcttcaactccttccagggattttttgtcgcaatcatatactgtttctgcaatggcgaggtacaagctgagatcaagaaatcttggagccgctggacactggcactggacttcaagcgaaaggcacgcagcgggagcagcagctatagctacggccccatggtgtcccacacaagtgtgaccaatgtcggcccccgtgtgggactcggcctgcccctcagcccccgcctactgcccactgccaccaccaacggccaccctcagctgcctggccatgccaagccagggaccccagccctggagaccctcgagaccacaccacctgccatggctgctcccaaggacgatgggttcctcaacggctcctgctcaggcctggacgaggaggcctctgggcctgagcggccacctgccctgctacaggaagagtgggagacagtcatgtgaccaggcgctgggggctggacctgctgacatagtggatggacagatggaccaaaagatgggtggttgaatgatttcccactcagggctggggccaagaggaaaaacagggaaaaaaagaaaaaaaaaagaaaaaggaaaa

SEQ ID NO: 163729 - DNA, 1947 bp, Homo sapiens
  Payload ID: 12246
  Gene Symbol: PTH1R
  Gene Name: parathyroid hormone 1 receptor
  Uniprot ID: Q03431
  ENST ID: ENST00000430002
  CDS Start-End: 67-1848
ggagcggcagacgccgagggccggcggcggcggctgccccgagggacgcggccctaggcggtggcgatggggaccgcccggatcgcacccggcctggcgctcctgctctgctgccccgtgctcagctccgcgtacgcgctggtggatgcagatgacgtcatgactaaagaggaacagatcttcctgctgcaccgtgctcaggcccagtgcgaaaaacggctcaaggaggtcctgcagaggccagccagcataatggaatcagacaagggatggacatctgcgtccacatcagggaagcccaggaaagataaggcatctgggaagctctaccctgagtctgaggaggacaaggaggcacccactggcagcaggtaccgagggcgcccctgtctgccggaatgggaccacatcctgtgctggccgctgggggcaccaggtgaggtggtggctgtgccctgtccggactacatttatgacttcaatcacaaaggccatgcctaccgacgctgtgaccgcaatggcagctgggagctggtgcctgggcacaacaggacgtgggccaactacagcgagtgtgtcaaatttctcaccaatgagactcgtgaacgggaggtgtttgaccgcctgggcatgatttacaccgtgggctactccgtgtccctggcgtccctcaccgtagctgtgctcatcctggcctactttaggcggctgcactgcacgcgcaactacatccacatgcacctgttcctgtccttcatgctgcgcgccgtgagcatcttcgtcaaggacgctgtgctctactctggcgccacgcttgatgaggctgagcgcctcaccgaggaggagctgcgcgccatcgcccaggcgcccccgccgcctgccaccgccgctgccggctacgcgggctgcagggtggctgtgaccttcttcctttacttcctggccaccaactactactggattctggtggaggggctgtacctgcacagcctcatcttcatggccttcttctcagagaagaagtacctgtggggcttcacagtcttcggctggggtctgcccgctgtcttcgtggctgtgtgggtcagtgtcagagctaccctggccaacaccgggtgctgggacttgagctccgggaacaaaaagtggatcatccaggtgcccatcctggcctccattgtgctcaacttcatcctcttcatcaatatcgtccgggtgctcgccaccaagctgcgggagaccaacgccggccggtgtgacacacggcagcagtaccggaagctgctcaaatccacgctggtgctcatgcccctctttggcgtccactacattgtcttcatggccacaccatacaccgaggtctcagggacgctctggcaagtccagatgcactatgagatgctcttcaactccttccagggattttttgtcgcaatcatatactgtttctgcaatggcgaggtacaagctgagatcaagaaatcttggagccgctggacactggcactggacttcaagcgaaaggcacgcagcgggagcagcagctatagctacggccccatggtgtcccacacaagtgtgaccaatgtcggcccccgtgtgggactcggcctgcccctcagcccccgcctactgcccactgccaccaccaacggccaccctcagctgcctggccatgccaagccagggaccccagccctggagaccctcgagaccacaccacctgccatggctgctcccaaggacgatgggttcctcaacggctcctgctcaggcctggacgaggaggcctctgggcctgagcggccacctgccctgctacaggaagagtgggagacagtcatgtgaccaggcgctgggggctggacctgctgacatagtggatggacagatggaccaaaagatgggtggttgaatgatttcccactcagggctggggccaagagg

SEQ ID NO: 163730 - DNA, 459 bp, Homo sapiens
  Payload ID: 12247
  Gene Symbol: PTH2
  Gene Name: parathyroid hormone 2
  Uniprot ID: Q96A98
  ENST ID: ENST00000270631
  CDS Start-End: 103-405
gtaggggactgtgcgggaagctgggggtggatgcatggtggggcccggggttctgggccgggatgcagccctactgagcccctttctggttctccacaggtgatggagacccgccaggtgtccaggagccctcgggttcggctgctgctgctgctgctgctgctgctggtggtgccctggggcgtccgcactgcctcgggagtcgccctgcccccggtcggggtcctcagcctccgccccccaggacgggcctgggcggatcccgccacccccaggccgcggaggagcctggcgctggcggacgacgcggccttccgggagcgcgcgcggttgctggccgccctcgagcgccgccactggctgaactcgtacatgcacaagctgctggtgttggatgcgccctgagcgcgctgcccgtccccatcttaataaagaccatgccctgcgctccggactgcg

SEQ ID NO: 163731 - DNA, 2713 bp, Homo sapiens
  Payload ID: 12248
  Gene Symbol: PTH2R
  Gene Name: parathyroid hormone 2 receptor
  Uniprot ID: P49190
  ENST ID: ENST00000272847
  CDS Start-End: 214-1866
cgcgccgcggcgcagcagcacgcgggttctgagaagcgcgtggctccggcgacaagaccccaagcaccctcggccggtggcccgggcccgaccaccccagctgcgcgtcgttactggccacaagtttgctctgggccagccaagttggcaacttggaagcttctcccgggctctggaggagggtccctgcttcttcctacagccgttccgggcatggccgggctgggggcgtcgctccacgtctggggttggctaatgctcggcagctgcctcctggccagagcccagctggattctgatggcaccattactatagaggagcagattgtccttgtgctgaaagcgaaagtacaatgtgaactcaacatcacagctcaactccaggagggagaaggtaattgtttccctgaatgggatggactcatttgttggcccagaggaacagtggggaaaatatcggctgttccatgccctccttatatttatgacttcaaccataaaggagttgctttccgacactgtaaccccaatggaacatgggattttatgcacagcttaaataaaacatgggccaattattcagactgccttcgctttctgcagccagatatcagcataggaaagcaagaattctttgaacgcctctatgtaatgtataccgttggctactccatctcttttggttccttggctgtggctattctcatcattggttacttcagacgattgcattgcactaggaactatatccacatgcacttatttgtgtctttcatgctgagagctacaagcatctttgtcaaagacagagtagtccatgctcacataggagtaaaggagctggagtccctaataatgcaggatgacccacaaaattccattgaggcaacttctgtggacaaatcacaatatatcgggtgcaagattgctgttgtgatgtttatttacttcctggctacaaattattattggatcctggtggaaggtctctacctgcataatctcatctttgtggctttcttttcggacaccaaatacctgtggggcttcatcttgataggctgggggtttccagcagcatttgttgcagcatgggctgtggcacgagcaactctggctgatgcgaggtgctgggaacttagtgctggagacatcaagtggatttatcaagcaccgatcttagcagctattgggctgaattttattctgtttctgaatacggttagagttctagctaccaaaatctgggagaccaatgcagttgggcatgacacaaggaagcaatacaggaaactggccaaatcgacactggtcctggtcctagtctttggagtgcattacatcgtgttcgtatgcctgcctcactccttcactgggctcgggtgggagatccgcatgcactgtgagctcttcttcaactcctttcagggtttctttgtgtctatcatctactgctactgcaatggagaggttcaggcagaggtgaagaagatgtggagtcggtggaacctctccgtggactggaaaaggacaccgccatgtggcagccgcagatgcggctcagtgctcaccaccgtgacgcacagcaccagcagccagtcacaggtggcggccagcacacgcatggtgcttatctctggcaaagctgccaagatcgccagcagacagcctgacagccacatcactttacctggctatgtctggagtaactcagagcaggactgcctgccacactctttccacgaggagaccaaggaagatagtgggaggcagggagatgatattctaatggagaagccttccaggcctatggaatctaacccagacactgaaggatgccaaggagaaactgaggatgttctctgaatggacatttgtggctgactttcatgggctggtccaatggctggttgtgtgagagggcttggctgatactcctatgcttgagttcaaaggctgaaaattcagttaaggtgttacttaataatagtttttaggctccatgaattggctcctgtaaatactaacgacatgaaaatgcaagtgtcaatggagtagtttattaccttctattggcatcaagttttcctctaaattaatgtatggtatttgctctgtgattgttcatttttttctgctacttttgggtagaaaaaagattcaattgcttggctgtagctttctctcatatatatcaccctaaatataatgaagatcttttagtgtgtatcattttccttttagaaactagtattctcttatttcttactttaatgtacttctatcactgcatttattttgcctgtgcataggagcaattaggatctaaaaaaatatatgggaagataaaagatctaagaacaagtacttgctggaaaattagttggctggacattgataaaataatgcatttataacaattacatgtgtttctgggaacaaggaaaatttctcaaaaaagaatatttcacacatcccttcttttgaatggcctctttgtgaccagccagacctcaggtcttcactctttcttctttgtaaactatgtcatgtggaaagatttcctcagttagtgagcttgtgtctgcaaattgattttgtttgtaatgtattttgatagcaaatcatgctgcatctatatctttttcttgtttgagctgttactacattgtacatggcatgtgggatcaattaaaaatttgttttaaaaata

SEQ ID NO: 163732 - DNA, 811 bp, Homo sapiens
  Payload ID: 12248
  Gene Symbol: PTH2R
  Gene Name: parathyroid hormone 2 receptor
  ENST ID: ENST00000419079
  CDS Start-End: 1-164
actccttcactgggctcgggtgggagatccgcatgcactgtgagctcttcttcaactcctttcagggtttctttgtgtctatcatctactgctactgcaatggagagattgggaggctgctgtgtatggataagatacctgctacagccagcttgacaccatgagaaggacaagagaattgcagagacacatatccaggattctgatccagttgaggcactgaaataatctagaaccaccttcaaatttcttataaagagagctatgctattaggatttaattaaatggatgccaacagcaagtaaaccatctccaaagatgccatgaagctctcctaattgcaggaaaatatcagaggcacttgatttgagtctttcaagtacggaaataacaaattcagtctcaacagacctatagtgaatgagaatgattgtcacataatgtgtagagaaaatggaagaatcaaaggcaagggaaacctgtacagtggagacacaaagggtcactggcagatttcaaatgatccaagacatcctcaagacattgagatctgctggttggagatcttagtgcccaaggaagaatgcttgcaaaaggagatggaacagtgtttctgttgcattggccactgagaatatctggttattttgaatttgtcacagtctgcagctaaaaggcgaacaggaaaagaagagatcacgaatcaagctgaaaaagtaaagcattctgtgagttgtggaatggaaattgcctcaaccatctcaccacttgatgacacttgtaatttcagtgacccaattcaaggcaaga

SEQ ID NO: 163733 - DNA, 2472 bp, Homo sapiens
  Payload ID: 12248
  Gene Symbol: PTH2R
  Gene Name: parathyroid hormone 2 receptor
  ENST ID: ENST00000617735
  CDS Start-End: 783-2102
gtgctccgagggaccacaggtccactacgtgaggggaggcttccctcccacaggaactcacacctgtgggcaggaagccgggaggcccgccccctgcctgggttcctgcaggggaaggcgagggtggctggatagagcgtaccctgagaggtggttgggcaggaggctgggctggtggccagctgcgcagggagaccgggaggtggcagatctgcggggcgcccagtcacttcctccacgttctcgtgctgggcgggaggagcggatggggcttgggaggcagcctgctctccagtccctatccacccacaggttttttgggtcggagaggaattatctgataaaattcctgggttaatatttttaaaaacggagagtttttaaaaatgatttttttccctcgaaaatgacctttttatgcttcgaagcagtttgtcaccagcatagtgctttttcttttctcttctttttctacgataaatgaaagcatttcttcaagaaaaaggcacaggttccttgaacagctggattctgatggcaccattactatagaggagcagattgtccttgtgctgaaagcgaaagtacaatgtgaactcaacatcacagctcaactccaggagggagaaggtaattgtttccctgaatgggatggactcatttgttggcccagaggaacagtggggaaaatatcggctgttccatgccctccttatatttatgacttcaaccataaaggagttgctttccgacactgtaaccccaatggaacatgggattttatgcacagcttaaataaaacatgggccaattattcagactgccttcgctttctgcagccagatatcagcataggaaagcaagaattctttgaacgcctctatgtaatgtataccgttggctactccatctcttttggttccttggctgtggctattctcatcattggttacttcagacgattgcattgcactaggaactatatccacatgcacttatttgtgtctttcatgctgagagctacaagcatctttgtcaaagacagagtagtccatgctcacataggagtaaaggagctggagtccctaataatgcaggatgacccacaaaattccattgaggcaacttctgtggacaaatcacaatatatcgggtgcaagattgctgttgtgatgtttatttacttcctggctacaaattattattggatcctggtggaaggtctctacctgcataatctcatctttgtggctttcttttcggacaccaaatacctgtggggcttcatcttgataggctgggggtttccagcagcatttgttgcagcatgggctgtggcacgagcaactctggctgatgcgaggtgctgggaacttagtgctggagacatcaagtggatttatcaagcaccgatcttagcagctattgggctgaattttattctgtttctgaatacggttagagttctagctaccaaaatctgggagaccaatgcagttgggcatgacacaaggaagcaatacaggaaactggccaaatcgacactggtcctggtcctagtctttggagtgcattacatcgtgttcgtatgcctgcctcactccttcactgggctcgggtgggagatccgcatgcactgtgagctcttcttcaactcctttcagggtttctttgtgtctatcatctactgctactgcaatggagaggttcaggcagaggtgaagaagatgtggagtcggtggaacctctccgtggactggaaaaggacaccgccatgtggcagccgcagatgcggctcagtgctcaccaccgtgacgcacagcaccagcagccagtcacaggtggcggccagcacacgcatggtgcttatctctggcaaagctgccaagatcgccagcagacagcctgacagccacatcactttacctggctatgtctggagtaactcagagcaggactgcctgccacactctttccacgaggagaccaaggaagatagtgggaggcagggagatgatattctaatggagaagccttccaggcctatggaatctaacccagacactgaaggatgccaaggagaaactgaggatgttctctgaatggacatttgtggctgactttcatgggctggtccaatggctggttgtgtgagagggcttggctgatactcctatgcttgagttcaaaggctgaaaattcagttaaggtgttacttaataatagtttttaggctccatgaattggctcctgtaaatactaacgacatgaaaatgcaagtgtcaatggagtagtttattaccttctattggcatcaagttttcctctaaattaatgtatggtatttgctctgtgattgttcatttttttctgctacttttgggtagaaaaaagattcaattgcttggctgtagctttctctcatatatatcaccctaaatataatgaagatcttttagtgtgtatcatttt

SEQ ID NO: 163734 - DNA, 1872 bp, Homo sapiens
  Payload ID: 12249
  Gene Symbol: PTHLH
  Gene Name: parathyroid hormone-like hormone
  Uniprot ID: P12272
  ENST ID: ENST00000201015
  CDS Start-End: 323-850
cctgcatctttttggaaggattctttttataaatcagaaagtgttcgaggttcaaaggtttgcctcggagcgtgtgaacattcctccgctcggttttcaactcgcctccaacctgcgccgcccggccagcatgtctccccgcccgtgaagcggggctgccgcctccctgccgctccggctgccactaacgacccgccctcgccgccacctggccctcctgatcgacgacacacgcacttgaaacttgttctcagggtgtgtggaatcaactttccggaagcaaccagcccaccagaggaggtcccgagcgcgagcggagacgatgcagcggagactggttcagcagtggagcgtcgcggtgttcctgctgagctacgcggtgccctcctgcgggcgctcggtggagggtctcagccgccgcctcaaaagagctgtgtctgaacatcagctcctccatgacaaggggaagtccatccaagatttacggcgacgattcttccttcaccatctgatcgcagaaatccacacagctgaaatcagagctacctcggaggtgtcccctaactccaagccctctcccaacacaaagaaccaccccgtccgatttgggtctgatgatgagggcagatacctaactcaggaaactaacaaggtggagacgtacaaagagcagccgctcaagacacctgggaagaaaaagaaaggcaagcccgggaaacgcaaggagcaggaaaagaaaaaacggcgaactcgctctgcctggttagactctggagtgactgggagtgggctagaaggggaccacctgtctgacacctccacaacgtcgctggagctcgattcacggtaacaggcttctctggcccgtagcctcagcggggtgctctcagctgggttttggagcctcccttctgccttggcttggacaaacctagaattttctccctttatgtatctctatcgattgtgtagcaattgacagagaataactcagaatattgtctgccttaaagcagtacccccctaccacacacacccctgtcctccagcaccatagagaggcgctagagcccattcctctttctccaccgtcacccaacatcaatcctttaccactctaccaaataatttcatattcaagcttcagaagctagtgaccatcttcataatttgctggagaagtgtgtttcttccccttactctcacacctgggcaaactttcttcagtgtttttcatttcttacgttctttcacttcaagggagaatatagaagcatttgatattatctacaaacactgcagaacagcatcatgtcataaacgattctgagccattcacactttttatttaattaaatgtatttaattaaatctcaaatttattttaatgtaaagaacttaaattatgttttaaacacatgccttaaatttgtttaattaaatttaactctggtttctaccagctcatacaaaataaatggtttctgaaaatgtttaagtattaacttacaaggatataggtttttctcatgtatctttttgttcattggcaagatgaaataatttttctagggtaatgccgtaggaaaaataaaacttcacatttatgtggcttgtttatccttagctcacagattgaggtaataatgacactcctagactttgggatcaaataacttagggccaagtcttgggtctgaatttatttaagttcacaacctagggcaagttactctgcctttctaagactcacttacatcttctgtgaaatataattgtaccaacctcatagagtttggtgtcaactaaatgagattatatgtggactaaatatctgtcatatagtaaacactcaataaattgcaacatatt

SEQ ID NO: 163735 - DNA, 1674 bp, Homo sapiens
  Payload ID: 12249
  Gene Symbol: PTHLH
  Gene Name: parathyroid hormone-like hormone
  Uniprot ID: P12272
  ENST ID: ENST00000395868
  CDS Start-End: 390-917
aagcaaccagcccaccagaggaggtagacagacagctatgtatatatatgtgggtttcgctacaagtggctctggaacgaaagggcctggttcgcaaagaagctgacttcagagggggaaactttcttcttttaggaggcggttagccctgttccacgaacccaggagaactgctggccagattaattagacattgctatgggagacgtgtaaacacactacttatcattgatgcatatataaaaccattttattttcgctattatttcagaggaagcgcctctgatttgtttcttttttccctttttgctctttctggctgtgtggtttggagaaagcacagttggagtagccggttgctaaataagtcccgagcgcgagcggagacgatgcagcggagactggttcagcagtggagcgtcgcggtgttcctgctgagctacgcggtgccctcctgcgggcgctcggtggagggtctcagccgccgcctcaaaagagctgtgtctgaacatcagctcctccatgacaaggggaagtccatccaagatttacggcgacgattcttccttcaccatctgatcgcagaaatccacacagctgaaatcagagctacctcggaggtgtcccctaactccaagccctctcccaacacaaagaaccaccccgtccgatttgggtctgatgatgagggcagatacctaactcaggaaactaacaaggtggagacgtacaaagagcagccgctcaagacacctgggaagaaaaagaaaggcaagcccgggaaacgcaaggagcaggaaaagaaaaaacggcgaactcgctctgcctggttagactctggagtgactgggagtgggctagaaggggaccacctgtctgacacctccacaacgtcgctggagctcgattcacggtaacaggcttctctggcccgtagcctcagcggggtgctctcagctgggttttggagcctcccttctgccttggcttggacaaacctagaattttctccctttatgtatctctatcgattgtgtagcaattgacagagaataactcagaatattgtctgccttaaagcagtacccccctaccacacacacccctgtcctccagcaccatagagaggcgctagagcccattcctctttctccaccgtcacccaacatcaatcctttaccactctaccaaataatttcatattcaagcttcagaagctagtgaccatcttcataatttgctggagaagtgtgtttcttccccttactctcacacctgggcaaactttcttcagtgtttttcatttcttacgttctttcacttcaagggagaatatagaagcatttgatattatctacaaacactgcagaacagcatcatgtcataaacgattctgagccattcacactttttatttaattaaatgtatttaattaaatctcaaatttattttaatgtaaagaacttaaattatgttttaaacacatgccttaaatttgtttaattaaatttaactctggtttctaccagctcatacaaaataaatggtttctgaaaatgtttaagtattaacttacaaggatataggtttttctcatgtatctttttgttcattggcaagatgaaataatttttctagggtaatgccgtaggaaaaataaaacttcacattta

SEQ ID NO: 163736 - DNA, 1318 bp, Homo sapiens
  Payload ID: 12249
  Gene Symbol: PTHLH
  Gene Name: parathyroid hormone-like hormone
  Uniprot ID: P12272
  ENST ID: ENST00000395872
  CDS Start-End: 310-843
ggaaggattctttttataaatcagaaagtgttcgaggttcaaaggtttgcctcggagcgtgtgaacattcctccgctcggttttcaactcgcctccaacctgcgccgcccggccagcatgtctccccgcccgtgaagcggggctgccgcctccctgccgctccggctgccactaacgacccgccctcgccgccacctggccctcctgatcgacgacacacgcacttgaaacttgttctcagggtgtgtggaatcaactttccggaagcaaccagcccaccagaggaggtcccgagcgcgagcggagacgatgcagcggagactggttcagcagtggagcgtcgcggtgttcctgctgagctacgcggtgccctcctgcgggcgctcggtggagggtctcagccgccgcctcaaaagagctgtgtctgaacatcagctcctccatgacaaggggaagtccatccaagatttacggcgacgattcttccttcaccatctgatcgcagaaatccacacagctgaaatcagagctacctcggaggtgtcccctaactccaagccctctcccaacacaaagaaccaccccgtccgatttgggtctgatgatgagggcagatacctaactcaggaaactaacaaggtggagacgtacaaagagcagccgctcaagacacctgggaagaaaaagaaaggcaagcccgggaaacgcaaggagcaggaaaagaaaaaacggcgaactcgctctgcctggttagactctggagtgactgggagtgggctagaaggggaccacctgtctgacacctccacaacgtcgctggagctcgattcacggaggcattgaaattttcagcagagaccttccaaggacatattgcaggattctgtaatagtgaacatatggaaagtattagaaatatttattgtctgtaaatactgtaaatgcattggaataaaactgtctcccccattgctctatgaaactgcacattggtcattgtgaatattttttttttgccaaggctaatccaattattattatcacatttaccataatttattttgtccattgatgtatttattttgtaaatgtatcttggtgctgctgaatttctatattttttgtaacataatgcactttagatatacatatcaagtatgttgataaatgacacaatgaagtgtctctattttgtggttgattttaatgaatgcctaaatataattatccaaattgattttcctttgtgcatgtaaaaataacagtattttaaatttgtaaagaatgtctaataaaatataatctaattacatcatga

SEQ ID NO: 163737 - DNA, 1891 bp, Homo sapiens
  Payload ID: 12249
  Gene Symbol: PTHLH
  Gene Name: parathyroid hormone-like hormone
  Uniprot ID: P12272
  ENST ID: ENST00000535992
  CDS Start-End: 348-875
cgccagcccgcctgcgccctcgctcgccccgcgcgcgttcctagggcgccacctctttgcgactagctcacttctccggcaggtttgcctcggagcgtgtgaacattcctccgctcggttttcaactcgcctccaacctgcgccgcccggccagcatgtctccccgcccgtgaagcggggctgccgcctccctgccgctccggctgccactaacgacccgccctcgccgccacctggccctcctgatcgacgacacacgcacttgaaacttgttctcagggtgtgtggaatcaactttccggaagcaaccagcccaccagaggaggtcccgagcgcgagcggagacgatgcagcggagactggttcagcagtggagcgtcgcggtgttcctgctgagctacgcggtgccctcctgcgggcgctcggtggagggtctcagccgccgcctcaaaagagctgtgtctgaacatcagctcctccatgacaaggggaagtccatccaagatttacggcgacgattcttccttcaccatctgatcgcagaaatccacacagctgaaatcagagctacctcggaggtgtcccctaactccaagccctctcccaacacaaagaaccaccccgtccgatttgggtctgatgatgagggcagatacctaactcaggaaactaacaaggtggagacgtacaaagagcagccgctcaagacacctgggaagaaaaagaaaggcaagcccgggaaacgcaaggagcaggaaaagaaaaaacggcgaactcgctctgcctggttagactctggagtgactgggagtgggctagaaggggaccacctgtctgacacctccacaacgtcgctggagctcgattcacggtaacaggcttctctggcccgtagcctcagcggggtgctctcagctgggttttggagcctcccttctgccttggcttggacaaacctagaattttctccctttatgtatctctatcgattgtgtagcaattgacagagaataactcagaatattgtctgccttaaagcagtacccccctaccacacacacccctgtcctccagcaccatagagaggcgctagagcccattcctctttctccaccgtcacccaacatcaatcctttaccactctaccaaataatttcatattcaagcttcagaagctagtgaccatcttcataatttgctggagaagtgtgtttcttccccttactctcacacctgggcaaactttcttcagtgtttttcatttcttacgttctttcacttcaagggagaatatagaagcatttgatattatctacaaacactgcagaacagcatcatgtcataaacgattctgagccattcacactttttatttaattaaatgtatttaattaaatctcaaatttattttaatgtaaagaacttaaattatgttttaaacacatgccttaaatttgtttaattaaatttaactctggtttctaccagctcatacaaaataaatggtttctgaaaatgtttaagtattaacttacaaggatataggtttttctcatgtatctttttgttcattggcaagatgaaataatttttctagggtaatgccgtaggaaaaataaaacttcacatttatgtggcttgtttatccttagctcacagattgaggtaataatgacactcctagactttgggatcaaataacttagggccaagtcttgggtctgaatttatttaagttcacaacctagggcaagttactctgcctttctaagactcacttacatcttctgtgaaatataattgtaccaacctcatagagtttggtgtcaactaaatgagattatatgtggactaaatatctgtcatatagtaaacactcaataaattgcaa

SEQ ID NO: 163738 - DNA, 890 bp, Homo sapiens
  Payload ID: 12249
  Gene Symbol: PTHLH
  Gene Name: parathyroid hormone-like hormone
  Uniprot ID: P12272
  ENST ID: ENST00000539239
  CDS Start-End: 68-601
ggagagtccagactgacactcgggtcccattcccttctgttgcaggtcccgagcgcgagcggagacgatgcagcggagactggttcagcagtggagcgtcgcggtgttcctgctgagctacgcggtgccctcctgcgggcgctcggtggagggtctcagccgccgcctcaaaagagctgtgtctgaacatcagctcctccatgacaaggggaagtccatccaagatttacggcgacgattcttccttcaccatctgatcgcagaaatccacacagctgaaatcagagctacctcggaggtgtcccctaactccaagccctctcccaacacaaagaaccaccccgtccgatttgggtctgatgatgagggcagatacctaactcaggaaactaacaaggtggagacgtacaaagagcagccgctcaagacacctgggaagaaaaagaaaggcaagcccgggaaacgcaaggagcaggaaaagaaaaaacggcgaactcgctctgcctggttagactctggagtgactgggagtgggctagaaggggaccacctgtctgacacctccacaacgtcgctggagctcgattcacggaggcattgaaattttcagcagagaccttccaaggacatattgcaggattctgtaatagtgaacatatggaaagtattagaaatatttattgtctgtaaatactgtaaatgcattggaataaaactgtctcccccattgctctatgaaactgcacattggtcattgtgaatattttttttttgccaaggctaatccaattattattatcacatttaccataatttattttgtccattgatgtatttattttgtaaatgtatcttggtgctgctgaatttctatattttttgtaacataa

SEQ ID NO: 163739 - DNA, 1544 bp, Homo sapiens
  Payload ID: 12249
  Gene Symbol: PTHLH
  Gene Name: parathyroid hormone-like hormone
  Uniprot ID: P12272
  ENST ID: ENST00000545234
  CDS Start-End: 542-1075
ctgctttctaataattgcctttagtgggaacagaagtctcctttcaagaagcttttaattcattttaagatttaattttatgttttctgaagaacaacaaaaaatatttctggaaaagactgctgagaagatttccctctttcagccagaagagcagagagaagattgtaaatcaaggaaaagatttcccccttcagatctaacgattacattagggctcctgcatctttttggaaggattctttttataaatcagaaagtgttcgaggttcaaaggtttgcctcggagcgtgtgaacattcctccgctcggttttcaactcgcctccaacctgcgccgcccggccagcatgtctccccgcccgtgaagcggggctgccgcctccctgccgctccggctgccactaacgacccgccctcgccgccacctggccctcctgatcgacgacacacgcacttgaaacttgttctcagggtgtgtggaatcaactttccggaagcaaccagcccaccagaggaggtcccgagcgcgagcggagacgatgcagcggagactggttcagcagtggagcgtcgcggtgttcctgctgagctacgcggtgccctcctgcgggcgctcggtggagggtctcagccgccgcctcaaaagagctgtgtctgaacatcagctcctccatgacaaggggaagtccatccaagatttacggcgacgattcttccttcaccatctgatcgcagaaatccacacagctgaaatcagagctacctcggaggtgtcccctaactccaagccctctcccaacacaaagaaccaccccgtccgatttgggtctgatgatgagggcagatacctaactcaggaaactaacaaggtggagacgtacaaagagcagccgctcaagacacctgggaagaaaaagaaaggcaagcccgggaaacgcaaggagcaggaaaagaaaaaacggcgaactcgctctgcctggttagactctggagtgactgggagtgggctagaaggggaccacctgtctgacacctccacaacgtcgctggagctcgattcacggaggcattgaaattttcagcagagaccttccaaggacatattgcaggattctgtaatagtgaacatatggaaagtattagaaatatttattgtctgtaaatactgtaaatgcattggaataaaactgtctcccccattgctctatgaaactgcacattggtcattgtgaatattttttttttgccaaggctaatccaattattattatcacatttaccataatttattttgtccattgatgtatttattttgtaaatgtatcttggtgctgctgaatttctatattttttgtaacataatgcactttagatatacatatcaagtatgttgataaatgacacaatgaagtgtctctattttgtggttgattttaatgaatgcctaaatataattatccaaattgattttcctttgtgcatgtaaaaataacagtattttaaatttgtaaagaatgtctaataaaatataatctaattaca

SEQ ID NO: 163740 - DNA, 854 bp, Homo sapiens
  Payload ID: 12249
  Gene Symbol: PTHLH
  Gene Name: parathyroid hormone-like hormone
  Uniprot ID: P12272
  ENST ID: ENST00000538310
  CDS Start-End: 1-630
atgcagcggagactggttcagcagtggagcgtcgcggtgttcctgctgagctacgcggtgccctcctgcgggcgctcggtggagggtctcagccgccgcctcaaaagagctgtgtctgaacatcagctcctccatgacaaggggaagtccatccaagatttacggcgacgattcttccttcaccatctgatcgcagaaatccacacagctgaaatcagagctacctcggaggtgtcccctaactccaagccctctcccaacacaaagaaccaccccgtccgatttgggtctgatgatgagggcagatacctaactcaggaaactaacaaggtggagacgtacaaagagcagccgctcaagacacctgggaagaaaaagaaaggcaagcccgggaaacgcaaggagcaggaaaagaaaaaacggcgaactcgctctgcctggttagactctggagtgactgggagtgggctagaaggggaccacctgtctgacacctccacaacgtcgctggagctcgattcacgtacagcacttctgtggggtttgaaaaaaaaaaaggaaaacaacagaagaacacatcatatgcaactaatgatctcattatttaagagtcccctgttacttctttagtcatttcctttgactctgctacagataggattataggatgatgcttcaaaggggaccttgaacctattcaccattatttgtctctttaagctggcaaacccatcattaaatagcacataaaatagcaatcatatgggataagtagtacagcttcagtaatcaatgggcagtggcactagaaaaatcttgagcacagtgaatgacctatcctgcaaacatctaat

SEQ ID NO: 163741 - DNA, 746 bp, Homo sapiens
  Payload ID: 12249
  Gene Symbol: PTHLH
  Gene Name: parathyroid hormone-like hormone
  ENST ID: ENST00000542963
  CDS Start-End: 231-746
tctccggcaggtttgcctcggagcgtgtgaacattcctccgctcggttttcaactcgcctccaacctgcgccgcccggccagcatgtctccccgcccgtgaagcggggctgccgcctccctgccgctccggctgccactaacgacccgccctcgccgccacctggccctcctgatcgacgacacacgcacttgaaacttgttctcagggtcccgagcgcgagcggagacgatgcagcggagactggttcagcagtggagcgtcgcggtgttcctgctgagctacgcggtgccctcctgcgggcgctcggtggagggtctcagccgccgcctcaaaagagctgtgtctgaacatcagctcctccatgacaaggggaagtccatccaagatttacggcgacgattcttccttcaccatctgatcgcagaaatccacacagctgaaatcagagctacctcggaggtgtcccctaactccaagccctctcccaacacaaagaaccaccccgtccgatttgggtctgatgatgagggcagatacctaactcaggaaactaacaaggtggagacgtacaaagagcagccgctcaagacacctgggaagaaaaagaaaggcaagcccgggaaacgcaaggagcaggaaaagaaaaaacggcgaactcgctctgcctggttagactctggagtgactgggagtgggctagaaggggaccacctgtctgacacctccacaacgtcgctggagctc

SEQ ID NO: 163742 - DNA, 457 bp, Homo sapiens
  Payload ID: 12249
  Gene Symbol: PTHLH
  Gene Name: parathyroid hormone-like hormone
  ENST ID: ENST00000534890
  CDS Start-End: 125-457
acccgccctcgccgccacctggccctcctgatcgacgacacacgcacttgaaacttgttctcagggtgtgtggaatcaactttccggaagcaaccagcccaccagaggaggtagacagacagctatgtcccgagcgcgagcggagacgatgcagcggagactggttcagcagtggagcgtcgcggtgttcctgctgagctacgcggtgccctcctgcgggcgctcggtggagggtctcagccgccgcctcaaaagagctgtgtctgaacatcagctcctccatgacaaggggaagtccatccaagatttacggcgacgattcttccttcaccatctgatcgcagaaatccacacagctgaaatcagagctacctcggaggtgtcccctaactccaagccctctcccaacacaaagaaccaccccgtccgatttgggtctgatgatgagggcagatac

SEQ ID NO: 163743 - DNA, 1619 bp, Homo sapiens
  Payload ID: 12250
  Gene Symbol: PACRG
  Gene Name: PARK2 co-regulated
  Uniprot ID: Q96M98
  ENST ID: ENST00000337019
  CDS Start-End: 225-1115
agatctatctggaggagtttctgtggagccagccaccctcaccaggtgccttccattagagtttaatgctttgctgcggtttcctgaaagagccccacagagagtgggtctcgatgggtcctgaaccgcaccacaaccggccagtgagacctcctgctcacatccgtaaagcccactgattcttttactacactttttatgagaacaagacattttctaggaagatggtggcagaaaaagagaccctgagcttaaacaaatgcccagacaagatgccgaagaggaccaagctgctggcacaacagccgctcccggtgcaccagcctcactctctggtttctgagggtttcacagtcaaagccatgatgaaaaactcagtcgtgagaggccctccagctgcaggggcatttaaagaaagaccaaccaagcccacagcatttcgaaaattctatgagcgaggtgacttcccaattgcccttgagcatgattcgaaaggaaacaaaatcgcctggaaggtagaaattgagaagctggattaccatcattatctgcctctgttttttgatgggctttgtgaaatgacatttccctatgagttttttgctcggcaaggaatccacgacatgctggaacacggtgggaacaagatcctacctgtccttccacagctcattatcccgataaaaaatgccttgaacctccgaaaccgacaggtcatctgtgtcactctcaaggtcctccagcatctggttgtgtcagctgagatggtgggcaaggccttggtgccttattaccgtcaaatcctccctgtcctgaacatctttaagaatatgaatgggtcttactctttgcccaggctggagtgcagtggcgcgatcatggctcgttgcaacctcgaccacctgggctcaagtgatcctcccacctcagcctctcaagtagctgagattatagtgaactccggagacggcattgactacagccagcagaagagggagaacattggggacttgatccaggagacactggaggccttcgagcgctacggaggagaaaatgcctttatcaacattaagtacgtggtcccaacctacgagtcttgcttgctaaactaacagtggcagcagctgggacttgaaacctcccgttggtgttgggatcatctgtctctgttgcttttagcatctcattccttgtgacttccacagctttcttttctacagctgctaaaatagtggcttatgggccattggactgttagccctattgagagcaaggctttccaatacataaatagtgtctgtttcttagattacaatagtgtactgtgcttatttgttctaagagaagaattgcttctttatacagctccgacagaagcaggagtccgagttaaaccttcagttgtatagacaataaactataattttcatatgcaattcagcaattgctgttctgtgtgtgcctgccctgggggtgatgtcagaggttgtaagggaagagtttatgctgactgcttactaggtgtttgtcatggaagagaagcatgggttcagcagtgcctctctagcagctgtgcggaataatgtgctttgacattcaataaaactgttgaatct

SEQ ID NO: 163744 - DNA, 1373 bp, Homo sapiens
  Payload ID: 12250
  Gene Symbol: PACRG
  Gene Name: PARK2 co-regulated
  Uniprot ID: Q96M98
  ENST ID: ENST00000366888
  CDS Start-End: 276-1049
gtgttgaccagtcgcttagcaaccgggaggcttacctttggaagcttgttgcagctctagccaaggtcctgccctcttcccgccccgcccctagggtccagctcccttcacctaggagctgccaaacatctggatcaacctgggcactacgaggggttgaatttctaccattatcgcgccttttgatatttttttccagacctcctgctcacatccgtaaagcccactgattcttttactacactttttatgagaacaagacattttctaggaagatggtggcagaaaaagagaccctgagcttaaacaaatgcccagacaagatgccgaagaggaccaagctgctggcacaacagccgctcccggtgcaccagcctcactctctggtttctgagggtttcacagtcaaagccatgatgaaaaactcagtcgtgagaggccctccagctgcaggggcatttaaagaaagaccaaccaagcccacagcatttcgaaaattctatgagcgaggtgacttcccaattgcccttgagcatgattcgaaaggaaacaaaatcgcctggaaggtagaaattgagaagctggattaccatcattatctgcctctgttttttgatgggctttgtgaaatgacatttccctatgagttttttgctcggcaaggaatccacgacatgctggaacacggtgggaacaagatcctacctgtccttccacagctcattatcccgataaaaaatgccttgaacctccgaaaccgacaggtcatctgtgtcactctcaaggtcctccagcatctggttgtgtcagctgagatggtgggcaaggccttggtgccttattaccgtcaaatcctccctgtcctgaacatctttaagaatatgaatgtgaactccggagacggcattgactacagccagcagaagagggagaacattggggacttgatccaggagacactggaggccttcgagcgctacggaggagaaaatgcctttatcaacattaagtacgtggtcccaacctacgagtcttgcttgctaaactaacagtggcagcagctgggacttgaaacctcccgttggtgttgggatcatctgtctctgttgcttttagcatctcattccttgtgacttccacagctttcttttctacagctgctaaaatagtggcttatgggccattggactgttagccctattgagagcaaggctttccaatacataaatagtgtctgtttcttagattacaatagtgtactgtgcttatttgttctaagagaagaattgcttctttatacagctccgacagaagcaggagtccgagttaaaccttcagttgtatagacaataaactataattttcatatgcaa

SEQ ID NO: 163745 - DNA, 1503 bp, Homo sapiens
  Payload ID: 12250
  Gene Symbol: PACRG
  Gene Name: PARK2 co-regulated
  Uniprot ID: Q96M98
  ENST ID: ENST00000366889
  CDS Start-End: 225-998
agatctatctggaggagtttctgtggagccagccaccctcaccaggtgccttccattagagtttaatgctttgctgcggtttcctgaaagagccccacagagagtgggtctcgatgggtcctgaaccgcaccacaaccggccagtgagacctcctgctcacatccgtaaagcccactgattcttttactacactttttatgagaacaagacattttctaggaagatggtggcagaaaaagagaccctgagcttaaacaaatgcccagacaagatgccgaagaggaccaagctgctggcacaacagccgctcccggtgcaccagcctcactctctggtttctgagggtttcacagtcaaagccatgatgaaaaactcagtcgtgagaggccctccagctgcaggggcatttaaagaaagaccaaccaagcccacagcatttcgaaaattctatgagcgaggtgacttcccaattgcccttgagcatgattcgaaaggaaacaaaatcgcctggaaggtagaaattgagaagctggattaccatcattatctgcctctgttttttgatgggctttgtgaaatgacatttccctatgagttttttgctcggcaaggaatccacgacatgctggaacacggtgggaacaagatcctacctgtccttccacagctcattatcccgataaaaaatgccttgaacctccgaaaccgacaggtcatctgtgtcactctcaaggtcctccagcatctggttgtgtcagctgagatggtgggcaaggccttggtgccttattaccgtcaaatcctccctgtcctgaacatctttaagaatatgaatgtgaactccggagacggcattgactacagccagcagaagagggagaacattggggacttgatccaggagacactggaggccttcgagcgctacggaggagaaaatgcctttatcaacattaagtacgtggtcccaacctacgagtcttgcttgctaaactaacagtggcagcagctgggacttgaaacctcccgttggtgttgggatcatctgtctctgttgcttttagcatctcattccttgtgacttccacagctttcttttctacagctgctaaaatagtggcttatgggccattggactgttagccctattgagagcaaggctttccaatacataaatagtgtctgtttcttagattacaatagtgtactgtgcttatttgttctaagagaagaattgcttctttatacagctccgacagaagcaggagtccgagttaaaccttcagttgtatagacaataaactataattttcatatgcaattcagcaattgctgttctgtgtgtgcctgccctgggggtgatgtcagaggttgtaagggaagagtttatgctgactgcttactaggtgtttgtcatggaagagaagcatgggttcagcagtgcctctctagcagctgtgcggaataatgtgctttgacattcaataaaactgttgaatcta

SEQ ID NO: 163746 - DNA, 415 bp, Homo sapiens
  Payload ID: 12250
  Gene Symbol: PACRG
  Gene Name: PARK2 co-regulated
  ENST ID: ENST00000542936
  CDS Start-End: 1-383
tacctgtccttccacagctcattatcccgataaaaaatgccttgaacctccgaaaccgacaggtcatctgtgtcactctcaaggtcctccagcatctggttgtgtcagctgagatggtgggcaaggccttggtgccttattaccgtcaaatcctccctgtcctgaacatctttaagaatatgaatgtaacccatcgacaaagaagtgaattgtcctccatgttagcgaagtggggaggtccagacttgctccttgtctttctaccattttctaccatcattgtatgtaaaagtctaatcttcattttaagtcagtttatgcttcccagactaaactctgcaacaaataatatgaatgtcacacatttcatcatttgtaattaattccaaactaaataaaacaaggagttgtgaaa

SEQ ID NO: 163747 - DNA, 907 bp, Homo sapiens
  Payload ID: 12250
  Gene Symbol: PACRG
  Gene Name: PARK2 co-regulated
  ENST ID: ENST00000541974
  CDS Start-End: 1-187
aggccctccagctgcaggggcatttaaagaaagaccaaccaagcccacagcatttcgaaaattctatgagcgaggtgacttcccaattgcccttgagcatgattcgaaaggaaacaaaatcgcctggaagattctaggaatgaaaaattacaaaaccacatcaccttggcccttaagtaacagatgaaaactactgacagacggcagcgaatcatgtcttccaatgaatagcagaataatgctggaaattggaaaaattcaatgtcaaggtagaaattgagaagctggattaccatcattatctgcctctgttttttgatgggctttgtgaaatgacatttccctatgagttttttgctcggcaaggaatccacgacatgctggaacacggtgggaacaagatcctacctgtccttccacagctcattatcccgataaaaaatgccttgaacctccgaaaccgacaggtcatctgtgtcactctcaaggtcctccagcatctggttgtgtcagctgagatggtgggcaaggccttggtgccttattaccgtcaaatcctccctgtcctgaacatctttaagaatatgaatgtgaactccggagacggcattgactacagccagcagaagagggagaacattggggacttgatccaggagacactggaggccttcgagcgctacggaggagaaaatgcctttatcaacattaagtacgtggtcccaacctacgagtcttgcttgctaaactaacagtggcagcagctgggacttgaaacctcccgttggtgttgggatcatctgtctctgttgcttttagcatctcattccttgtgacttccacagctttcttttctacagctgctaaaatagtggcttatgggccattggactgttagccctattga

SEQ ID NO: 163748 - DNA, 545 bp, Homo sapiens
  Payload ID: 12250
  Gene Symbol: PACRG
  Gene Name: PARK2 co-regulated
  ENST ID: ENST00000534958
  CDS Start-End: 1-376
tgagcatgattcgaaaggaaacaaaatcgcctggaaggtagaaattgagaagctggattaccatcattatctgcctctgttttttgatgggctttgtgaaatgacatttccctatgagttttttgctcggcaaggaatccacgacatgctggaacacggtgggaacaagatcctacctgtccttccacagctcattatcccgataaaaaatgccttgaacctccgaaaccgacaggtcatctgtgtcactctcaaggtcctccagcatctggttgtgtcagctgagatggtgggcaaggccttggtgccttattaccgtcaaatcctccctgtcctgaacatctttaagaatatgaatggctgggctcctccgtaggttctcctgccaacaagcgagacagaaaggaggcggcagctgggggaactcagccttccttcccaccacacctgcaccttgctgagccactgctcccaagacgaggcacagaattcccagagcagcctggcttcaacctactcatttggtgttctttaaattaaaaaaa

SEQ ID NO: 163749 - DNA, 360 bp, Homo sapiens
  Payload ID: 12250
  Gene Symbol: PACRG
  Gene Name: PARK2 co-regulated
  ENST ID: ENST00000621363
  CDS Start-End: 1-360
agctggaaggtagaaattgagaagctggattaccatcattatctgcctctgttttttgatgggctttgtgaaatgacatttccctatgagttttttgctcggcaaggaatccacgacatgctggaacacggtgggaacaagatcctacctgtccttccacagctcattatcccgataaaaaatgccttgaacctccgaaaccgacaggtcatctgtgtcactctcaaggtcctccagcatctggttgtgtcagctgagatggtgggcaaggccttggtgccttattaccgtcaaatcctccctgtcctgaacatctttaagaatatgaatggtgagtctgctccaggcatagactattca

SEQ ID NO: 163750 - DNA, 279 bp, Homo sapiens
  Payload ID: 12250
  Gene Symbol: PACRG
  Gene Name: PARK2 co-regulated
  ENST ID: ENST00000611387
  CDS Start-End: 1-279
gggtcttactctttgcccaggctggagtgcagtggcgcgatcatggctcgttgcaacctcgaccacctgggctcaagtgatcctcccacctcagcctctcaagtagctgagattatagtgaactccggagacggcattgactacagccagcagaagagggagaacattggggacttgatccaggagacactggaggccttcgagcgctacggaggagaaaatgcctttatcaacattaagtacgtggtcccaacctacgagtcttgcttgctaaactaa

SEQ ID NO: 163751 - DNA, 1937 bp, Homo sapiens
  Payload ID: 12251
  Gene Symbol: PACRGL
  Gene Name: PARK2 co-regulated-like
  Uniprot ID: Q8N7B6
  ENST ID: ENST00000295290
  CDS Start-End: 297-962
cggcgcgaccaggttcaggggcgggccgcgcggagcctcatttccccaaacgcaggcgctcggtggcggtagccgcggttgttggccgaccgagtgccggtcataagccccccccggtggggggcagctggtgtgcggatcgcggcgggagagaggcgcggtaggaacgggtccccggagccgtgaaccgcgggtacagtttgttacaggaacaactttttgacgtgaaggaagatagaaatttagccataaaattccatccaaaacttccactgaattggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgtttggtgaacagtcacgagtgccttctgcatttgcagctatttactctaaaggaggtattccttgcagattggtacatggttcagtaaaacacagattacagtgggaatgtcctcctgaaagtctttcatttgatccacttcttattactttagctgagggtctgagagagactaagcatccatacacttttgtgtcaaaggagggttttagagaattacttttggtcaaaggtgctcctgaaaaagctattcctttgctacctagactgattcctgtgctaaaggcagctctggtccattcggatgatgaagtgtttgaaagaggattgaatgctctagttcagctaagtgtcgttgttggtccttctctaaacgaccatctgaagcatctgcttacaagcgggagccttagcatcatcaaatctaaaattccaacatactgctccatatgctgttgaagaagggagccaacaaaaattgttttttctacctgttgacgtgtcaagcactaactgtgggtactcatttattttattcttttgtaaatcacagccaccattcattatttactaggttaagatgaatagacactgaatcaaagttattcatcaacaaaaaagaacagttactaatggaaagttattaaaataagttctataagagtacaattttgaggtttattttttgtatttttattatttgtgcgaagaaccattattgagtttgcaagataagatgtatttgtattttctagtgtctttttatttataacaacacttttttggcaatcagtttgtagctgtgcccttatttttatagatagtttgccatttcttgggtttaatgtttaacaaggctatagaagtttaaaatagtggacaaatgtttgtgaatacacttttaaaaaattgttttaaaagagaaaagcggtcttgctttgttgcccagactggagtgcagtggcataatcatagctcaccgcaagcctcaaatttttgtgctcagatgatccttttcatctcagcctcctgattagctgggactataggcgtgtgccaccatgcccagctaattttgaaatttgcttgtagagatgggatctcactctgttgtccaggctggtctcagaattctggtgagtgatcctcccacagtggacttccaaagtgctgggattacaggtgtgagccaccatgcctggccccatgaatacactactaatattatttgtaaatatgtattttataatgtacaatgcttggaaaattttcagagtattctagtttaaaaaattttttctaattctgtaaattctattacaagtatgttgtttattacaactcattacaactacctaaattttaggtgttaactgtatttaagtaaatgtgttatttttgcatttcatagccagaaaatactgatgttcactt

SEQ ID NO: 163752 - DNA, 2073 bp, Homo sapiens
  Payload ID: 12251
  Gene Symbol: PACRGL
  Gene Name: PARK2 co-regulated-like
  Uniprot ID: Q8N7B6
  ENST ID: ENST00000360916
  CDS Start-End: 392-1057
attgcgcggcgcgaccaggttcaggggcgggccgcgcggagcctcatttccccaaacgcaggcgctcggtggcggtagccgcggttgttggccgaccgagtgccggtcataagccccccccggtggggggcagctggtgtgcggatcgcggcgggagagaggcgcggtaggaacgggtccccggagccgtgaaccgcgggtacaggtgtcctgtctgcgctctctgccaagccggcttgcttcctgatctgttgctagggccgctggaccccgttgctaaggacccttgagatcgtgagcgcttggagtgtacccctcctttcctggggtagagggtcagtcgagagtagccttcgttaaccttaattgaaactggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgtttggtgaacagtcacgagtgccttctgcatttgcagctatttactctaaaggaggtattccttgcagattggtacatggttcagtaaaacacagattacagtgggaatgtcctcctgaaagtctttcatttgatccacttcttattactttagctgagggtctgagagagactaagcatccatacacttttgtgtcaaaggagggttttagagaattacttttggtcaaaggtgctcctgaaaaagctattcctttgctacctagactgattcctgtgctaaaggcagctctggtccattcggatgatgaagtgtttgaaagaggattgaatgctctagttcagctaagtgtcgttgttggtccttctctaaacgaccatctgaagcatctgcttacaagcgggagccttagcatcatcaaatctaaaattccaacatactgctccatatgctgttgaagaagggagccaacaaaaattgttttttctacctgttgacgtgtcaagcactaactgtgggtactcatttattttattcttttgtaaatcacagccaccattcattatttactaggttaagatgaatagacactgaatcaaagttattcatcaacaaaaaagaacagttactaatggaaagttattaaaataagttctataagagtacaattttgaggtttattttttgtatttttattatttgtgcgaagaaccattattgagtttgcaagataagatgtatttgtattttctagtgtctttttatttataacaacacttttttggcaatcagtttgtagctgtgcccttatttttatagatagtttgccatttcttgggtttaatgtttaacaaggctatagaagtttaaaatagtggacaaatgtttgtgaatacacttttaaaaaattgttttaaaagagaaaagcggtcttgctttgttgcccagactggagtgcagtggcataatcatagctcaccgcaagcctcaaatttttgtgctcagatgatccttttcatctcagcctcctgattagctgggactataggcgtgtgccaccatgcccagctaattttgaaatttgcttgtagagatgggatctcactctgttgtccaggctggtctcagaattctggtgagtgatcctcccacagtggacttccaaagtgctgggattacaggtgtgagccaccatgcctggccccatgaatacactactaatattatttgtaaatatgtattttataatgtacaatgcttggaaaattttcagagtattctagtttaaaaaattttttctaattctgtaaattctattacaagtatgttgtttattacaactcattacaactacctaaattttaggtgttaactgtatttaagtaaatgtgttatttttgcatttcatagccagaaaatactgatgttcacttaaagatattcagcaattaaaatgttaaaacttgtacatgca

SEQ ID NO: 163753 - DNA, 1720 bp, Homo sapiens
  Payload ID: 12251
  Gene Symbol: PACRGL
  Gene Name: PARK2 co-regulated-like
  Uniprot ID: Q8N7B6
  ENST ID: ENST00000444671
  CDS Start-End: 369-740
ggggcgggccgcgcggagcctcatttccccaaacgcaggcgctcggtggcggtagccgcggttgttggccgaccgagtgccggtcataagccccccccggtggggggcagctggtgtgcggatcgcggcgggagagaggcgcggtaggaacgggtccccggagccgtgaaccgcgggtacaggtgtcctgtctgcgctctctgccaagccggcttgcttcctgatctgttgctagggccgctggaccccgttgctaaggacccttgagatcgtgagcgcttggagtgtacccctcctttcctggggtagagggtcagtcgagagtagccttcgttaaccttaattgaaactggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccggtccattcggatgatgaagtgtttgaaagaggattgaatgctctagttcagctaagtgtcgttgttggtccttctctaaacgaccatctgaagcatctgcttacaagcgggagccttagcatcatcaaatctaaaattccaacatactgctccatatgctgttgaagaagggagccaacaaaaattgttttttctacctgttgacgtgtcaagcactaactgtgggtactcatttattttattcttttgtaaatcacagccaccattcattatttactaggttaagatgaatagacactgaatcaaagttattcatcaacaaaaaagaacagttactaatggaaagttattaaaataagttctataagagtacaattttgaggtttattttttgtatttttattatttgtgcgaagaaccattattgagtttgcaagataagatgtatttgtattttctagtgtctttttatttataacaacacttttttggcaatcagtttgtagctgtgcccttatttttatagatagtttgccatttcttgggtttaatgtttaacaaggctatagaagtttaaaatagtggacaaatgtttgtgaatacacttttaaaaaattgttttaaaagagaaaagcggtcttgctttgttgcccagactggagtgcagtggcataatcatagctcaccgcaagcctcaaatttttgtgctcagatgatccttttcatctcagcctcctgattagctgggactataggcgtgtgccaccatgcccagctaattttgaaatttgcttgtagagatgggatctcactctgttgtccaggctggtctcagaattctggtgagtgatcctcccacagtggacttccaaagtgctgggattacaggtgtgagccaccatgcctggccccatgaatacactactaatattatttgtaaatatgtattttataatgtacaatgcttggaaaattttcagagtattctagtttaaaaaattttttctaattctgtaaattctattacaagtatgttgtttattacaactcattacaactacctaaattttaggtgttaactgtatttaagtaaatgtgttatttttgcatttcatagccagaaaatactgatgttcacttaaaga

SEQ ID NO: 163754 - DNA, 620 bp, Homo sapiens
  Payload ID: 12251
  Gene Symbol: PACRGL
  Gene Name: PARK2 co-regulated-like
  ENST ID: ENST00000504630
  CDS Start-End: 346-620
tttccccaaacgcaggcgctcggtggcggtagccgcggttgttggccgaccgagtgccggtcataagccccccccggtggggggcagctggtgtgcggatcgcggcgggagagaggcgcggtaggaacgggtccccggagccgtgaaccgcgggtacaggtgtcctgtctgcgctctctgccaagccggcttgcttcctgatctgttgctagggccgctggaccccgttgctaaggacccttgagatctttgttacaggaacaactttttgacgtgaaggaagatagaaatttagccataaaattccatccaaaacttccactgaattggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgtttggtgaacagtcacgagtgccttctgcatttgcagctatttactctaaaggaggtattccttgcag

SEQ ID NO: 163755 - DNA, 573 bp, Homo sapiens
  Payload ID: 12251
  Gene Symbol: PACRGL
  Gene Name: PARK2 co-regulated-like
  ENST ID: ENST00000514663
  CDS Start-End: 267-573
atttccccaaacgcaggcgctcggtggcggtagccgcggttgttggccgaccgagtgccggtcataagccccccccggtggggggcagctggtgtgcggatcgcggcgggagagaggcgcggtaggaacgggtccccggagccgtgaaccgcgggtacagaaacttgtgttgttccccctccaggagcttctcaaaacagaagtcaggcacaatattaaatacttgttgaatgatcacagaagtacaatagagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgtttggtgaacagtcacgagtgccttctgcatttgcagctatttactctaaaggaggtattccttgcagattggtacatggttcagtaaaacacagattac

SEQ ID NO: 163756 - DNA, 647 bp, Homo sapiens
  Payload ID: 12251
  Gene Symbol: PACRGL
  Gene Name: PARK2 co-regulated-like
  ENST ID: ENST00000511089
  CDS Start-End: 196-647
gtggcggtagccgcggttgttggccgaccgagtgccggtcataagccccccccggtggggggcagctggtgtgcggatcgcggcgggagagaggcgcgtttgttacaggaacaactttttgacgtgaaggaagatagaaatttagccataaaattccatccaaaacttccactgaattggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgggtctgagagagactaagcatccatacacttttgtgtcaaaggagggttttagagaattacttttggtcaaaggtgctcctgaaaaagctattcctttgctacctagactgattcctgtgctaaaggcagctctggtccattcggatgatgaagtgtttgaaagaggattgaatgctctagttcagctaagtgtcgttgttggtccttctctaaacgaccatctgaagcatctgcttacaagcgt

SEQ ID NO: 163757 - DNA, 556 bp, Homo sapiens
  Payload ID: 12251
  Gene Symbol: PACRGL
  Gene Name: PARK2 co-regulated-like
  ENST ID: ENST00000511160
  CDS Start-End: 514-556
tttccccaaacgcaggcgctcggtggcggtagccgcggttgttggccgaccgagtgccggtcataagccccccccggtggggggcagctggtgtgcggatcgcggcgggagagaggcgcggtaggaacgggtccccggagccgtgaaccgcgggtacaggtgtcctgtctgcgctctctgccaagccggcttgcttcctgatctgttgctagggccgctggaccccgttgctaaggacccttgagatcgtgagcgcttggagtgtacccctcctttcctggggtagaggtctctttcagatacccaaatccacccatgccaaagtcctccagtctgctctccgtatccgtggttgggtcaaatctatagatgtggaacccgcatatacggagagccaactgtaatttgtcgttaagtttgttacaggaacaactttttgacgtgaaggaagatagaaatttagccataaaattccatccaaaacttccactgaattggagtgaaagggaagcaatgcagaaatcagagggctctggaggtacacagttgaaaaaca

SEQ ID NO: 163758 - DNA, 936 bp, Homo sapiens
  Payload ID: 12251
  Gene Symbol: PACRGL
  Gene Name: PARK2 co-regulated-like
  ENST ID: ENST00000506951
  CDS Start-End: 163-420
aaacgcaggcgctcggtggcggtagccgcggttgttggccgaccgagtgccggtcataagccccccccggtggggggcagctggtgtgcggatcgcggcgggagagaggcgcggtaggaacgggtccccggagccgtgaaccgcgggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgattggtacatggttcagtaaaacacagattacagtgggaatgtcctcctgaaagtctttcatttgatccacttcttattactttagctgagggtctgagagagactaagcatccatacacttttgtgtcaaaggagggttttagagaattacttttggtcaaaggtgctcctgaaaaagctattcctttgctacctagactgattcctgtgctaaaggcagctctggtccattcggatgatgaagtgtttgaaagaggattgaatgctctagttcagctaagtgtcgttgttggtccttctctaaacgaccatctgaagcatctgcttacaagcgttttggtatcagcatgatgctggcctcataaaatgagttagggaggattccctctttttctattgattggaatagtttcagaagaatggtacaagctcctccttgtacctctggtggaattcagctgtgaatccatctggtcctggactttttttggttgctttccaagagattaatggacaagaaattcaaagagccaatcaccagcgcattacaaaagctagagcaacat

SEQ ID NO: 163759 - DNA, 564 bp, Homo sapiens
  Payload ID: 12251
  Gene Symbol: PACRGL
  Gene Name: PARK2 co-regulated-like
  ENST ID: ENST00000513861
  CDS Start-End: 138-564
atttccccaaacgcaggcgctcggtggcggtagccgcggttgttggccgaccgagtgccggtcataagccccccccggtggggggcagctggtgtgcggatcgcggcgggagagaggcgcggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgggtctgagagagactaagcatccatacacttttgtgtcaaaggagggttttagagaattacttttggtcaaaggtgctcctgaaaaagctattcctttgctacctagactgattcctgtgctaaaggcagctctggtccattcggatgatgaagtgtttgaaagaggattgaatgctctagttcagctaagtgtcgttgttggtccttctctaaacgacc

SEQ ID NO: 163760 - DNA, 915 bp, Homo sapiens
  Payload ID: 12251
  Gene Symbol: PACRGL
  Gene Name: PARK2 co-regulated-like
  ENST ID: ENST00000513590
  CDS Start-End: 306-915
tttccccaaacgcaggcgctcggtggcggtagccgcggttgttggccgaccgagtgccggtcataagccccccccggtggggggcagctggtgtgcggatcgcggcgggagagaggcgcggtaggaacgggtccccggagccgtgaaccgcgggtacaggtgtcctgtctgcgctctctgccaagccggcttgcttcctgatctgttgctagggccgctggaccccgttgctaaggacccttgagatcgtgagcgcttggagtgtacccctcctttcctggggtagagggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgtttggtgaacagtcacgagtgccttctgcatttgcagctatttactctaaaggaggtattccttgcagattggtacatggttcagtaaaacacagattacagtgggaatgtcctcctgaaagtctttcatttgatccacttcttattactttagctgagggtctgagagagactaagcatccatacacttttgtgtcaaaggagggttttagagaattacttttggtcaaaggtgctcctgaaaaagctattcctttgctacctagactgattcctgtgctaaaggcagctctggtccattcggatgatgaagtgtttgaaagaggattgaatgctctagttcagctaagtgtcgttgttggtccttctctaaacgaccatctgaagcatctgcttacaagcg

SEQ ID NO: 163761 - DNA, 848 bp, Homo sapiens
  Payload ID: 12251
  Gene Symbol: PACRGL
  Gene Name: PARK2 co-regulated-like
  ENST ID: ENST00000503747
  CDS Start-End: 332-613
ggcgctcggtggcggtagccgcggttgttggccgaccgagtgccggtcataagccccccccggtggggggcagctggtgtgcggatcgcggcgggagagaggcgcggtaggaacgggtccccggagccgtgaaccgcgggtacaggtgtcctgtctgcgctctctgccaagccggcttgcttcctgatctgttgctagggccgctggaccccgttgctaaggacccttgagatcgtgagcgcttggagtgtacccctcctttcctggggtagagggtcagtcgagagtagccttcgttaaccttaattgaaactggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgtttggtgaacagtcacgagtgccttctgcatttgcagctatttactctaaaggaggtattccttgcagggtctgagagagactaagcatccatacacttttgtgtcaaaggagggttttagagaattacttttggtcaaaggtgctcctgaaaaagctattcctttgctacctagactgattcctgtgctaaaggcagctctggtccattcggatgatgaagtgtttgaaagaggattgaatgctctagttcagctaagtgtcgttgttggtccttctctaaacgaccatctgaagcatctgcttacaag

SEQ ID NO: 163762 - DNA, 580 bp, Homo sapiens
  Payload ID: 12251
  Gene Symbol: PACRGL
  Gene Name: PARK2 co-regulated-like
  ENST ID: ENST00000509469
  CDS Start-End: 171-580
atttccccaaacgcaggcgctcggtggcggtagccgcggttgttggccgaccgagtgccggtcataagccccccccggtggggggcagctggtgtgcggatcgcggcgggagagaggcgcggtaggaacgggtccccggagccgtgaaccgcgggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgtttggtgaacagtcacgagtgccttctgcatttgcagctatttactctaaaggaggtattccttgcagattggtacatggttcagtaaaacacagattacagtgggaatgtcctcctgaaagtctttcatttgatccacttcttattactttagctgagggtctgagagagactaagcatccatacacttttgtgtcaaagga

SEQ ID NO: 163763 - DNA, 625 bp, Homo sapiens
  Payload ID: 12251
  Gene Symbol: PACRGL
  Gene Name: PARK2 co-regulated-like
  ENST ID: ENST00000510700
  CDS Start-End: 579-625
gcgggccgcgcggagcctcatttccccaaacgcaggcgctcggtggcggtagccgcggttgttggccgaccgagtgccggtcataagccccccccggtggggggcagctggtgtgcggatcgcggcgggagagaggcgcggtaggaacgggtccccggagccgtgaaccgcgggtacaggtgtcctgtctgcgctctctgccaagccggcttgcttcctgatctgttgctagggccgctggaccccgttgctaaggacccttgagatcgtgagcgcttggagtgtacccctcctttcctggggtagagggtcagtcgagagtagccttcgttaaccttaattgaaactggttcgcttctccccatcactgcccctttacaccatcctctacatgttatttaatgaaaaaccacttgaaagggttaccaaggataagatttttaaagcttgctttcacaaacaactcatgctccaggcttgtcagtggcatgcttccagtctctttcagatacccaaatccacccatgccaaagtcctccagtctgctctccgtatccgtggttgggtcaaatctatagatgtggaacccgcatatacggagagccaactgtaatttgtcgttaag

SEQ ID NO: 163764 - DNA, 1373 bp, Homo sapiens
  Payload ID: 12251
  Gene Symbol: PACRGL
  Gene Name: PARK2 co-regulated-like
  Uniprot ID: Q8N7B6
  ENST ID: ENST00000467997
  CDS Start-End: 328-993
ctcggtggcggtagccgcggttgttggccgaccgagtgccggtcataagccccccccggtggggggcagctggtgtgcggatcgcggcgggagagaggcgcggtaggaacgggtccccggagccgtgaaccgcgggtacaggtgtcctgtctgcgctctctgccaagccggcttgcttcctgatctgttgctagggccgctggaccccgttgctaaggacccttgagatcgtgagcgcttggagtgtacccctcctttcctggggtagagggtcagtcgagagtagccttcgttaaccttaattgaaactggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgtttggtgaacagtcacgagtgccttctgcatttgcagctatttactctaaaggaggtattccttgcagattggtacatggttcagtaaaacacagattacagtgggaatgtcctcctgaaagtctttcatttgatccacttcttattactttagctgagggtctgagagagactaagcatccatacacttttgtgtcaaaggagggttttagagaattacttttggtcaaaggtgctcctgaaaaagctattcctttgctacctagactgattcctgtgctaaaggcagctctggtccattcggatgatgaagtgtttgaaagaggattgaatgctctagttcagctaagtgtcgttgttggtccttctctaaacgaccatctgaagcatctgcttacaagcgggagccttagcatcatcaaatctaaaattccaacatactgctccatatgctgttgaagaagggagccaacaaaaattgttttttctacctgttgacgtgtcaagcactaactgatttctgttgtgtgtctaggtgacgagttctaatttaatgcaattttctgctcaataaaagacaagataattatgtcctaaaaatcaatggtccttctgatggagtttggatttcttctggcaagcacttgaagacagtggaaagttttaaagaagaggagtgaagccactggctttgactgggtgagagaaagaagcaaaggcaaaggaatgtccagctaggcagaaaactggataaaatgacgaaaagagaaactgtctacaaaagcatctatggttctggttttactcaactgtgttcttaagcactcaataaatatttg

SEQ ID NO: 163765 - DNA, 981 bp, Homo sapiens
  Payload ID: 12251
  Gene Symbol: PACRGL
  Gene Name: PARK2 co-regulated-like
  ENST ID: ENST00000510051
  CDS Start-End: 247-981
attgcgcggcgcgaccaggttcaggggcgggccgcgcggagcctcatttccccaaacgcaggcgctcggtggcggtagccgcggttgttggccgaccgagtgccggtcataagccccccccggtggggggcagctggtgtgcggatcgcggcgggagagaggcgcgtctctttcagatacccaaatccacccatgccaaagtcctccagtctgctctccgtatccgtggttgggtcaaatctatagatgtggaacccgcatatacggagagccaactgtaatttgtcgttaagtttgttacaggaacaactttttgacgtgaaggaagatagaaatttagccataaaattccatccaaaacttccactgaattggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgtttggtgaacagtcacgagtgccttctgcatttgcagctatttactctaaaggaggtattccttgcagattggtacatggttcagtaaaacacagattacagtgggaatgtcctcctgaaagtctttcatttgatccacttcttattactttagctgagggtctgagagagactaagcatccatacacttttgtgtcaaaggagggttttagagaattacttttggtcaaaggtgctcctgaaaaagctattcctttgctacctagactgattcctgtgctaaaggcagctctggtccattcggatgatgaagtgtttgaaagaggattgaatgctctagttcagctaagtgtcgttgttggtccttctctaaacgaccatctg

SEQ ID NO: 163766 - DNA, 577 bp, Homo sapiens
  Payload ID: 12251
  Gene Symbol: PACRGL
  Gene Name: PARK2 co-regulated-like
  ENST ID: ENST00000505160
  CDS Start-End: 561-577
aaacgcaggcgctcggtggcggtagccgcggttgttggccgaccgagtgccggtcataagccccccccggtggggggcagctggtgtgcggatcgcggcgggagagaggcgcggtaggaacgggtccccggagccgtgaaccgcgggtacaggtgtcctgtctgcgctctctgccaagccggcttgcttcctgatctgttgctagggccgctggaccccgttgctaaggacccttgagatcgtgagcgcttggagtgtacccctcctttcctggggtagagggtcagtcgagagtagccttcgttaaccttaattgaaactgttcttacaggttcgcttctccccatcactgcccctttacaccatcctctacatgttatttaatgaaaaaccacttgaaagggttaccaaggataagatttttaaagcttgctttcacaaacaactcatgctccaggcttgtcagtggcatgcttccagtctctttcagatacccaaatccacccatgccaaagtcctccagtctgctctccgtatccgtggttgggtcaaatctatagatgtggaacccgcatat

SEQ ID NO: 163767 - DNA, 1233 bp, Homo sapiens
  Payload ID: 12251
  Gene Symbol: PACRGL
  Gene Name: PARK2 co-regulated-like
  Uniprot ID: Q8N7B6
  ENST ID: ENST00000506702
  CDS Start-End: 176-841
tttccccaaacgcaggcgctcggtggcggtagccgcggttgttggccgaccgagtgccggtcataagccccccccggtggggggcagctggtgtgcggatcgcggcgggagagaggcgcggtaggaacgggtccccggagccgtgaaccgcgggtacaggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgtttggtgaacagtcacgagtgccttctgcatttgcagctatttactctaaaggaggtattccttgcagattggtacatggttcagtaaaacacagattacagtgggaatgtcctcctgaaagtctttcatttgatccacttcttattactttagctgagggtctgagagagactaagcatccatacacttttgtgtcaaaggagggttttagagaattacttttggtcaaaggtgctcctgaaaaagctattcctttgctacctagactgattcctgtgctaaaggcagctctggtccattcggatgatgaagtgtttgaaagaggattgaatgctctagttcagctaagtgtcgttgttggtccttctctaaacgaccatctgaagcatctgcttacaagcgggagccttagcatcatcaaatctaaaattccaacatactgctccatatgctgttgaagaagggagccaacaaaaattgttttttctacctgttgacgtgtcaagcactaactgatttctgttgtgtgtctaggtgacgagttctaatttaatgcaattttctgctcaataaaagacaagataattatgtcctaaaaatcaatggtccttctgatggagtttggatttcttctggcaagcacttgaagacagtggaaagttttaaagaagaggagtgaagccactggctttgactgggtgagagaaagaagcaaaggcaaaggaatgtccagctaggcagaaaactggataaaatgacgaaaagagaaactgtctacaaaagcatctatggttctggttttactcaactgtgttcttaagcactcaataaatatttgttaaaagagtga

SEQ ID NO: 163768 - DNA, 1582 bp, Homo sapiens
  Payload ID: 12251
  Gene Symbol: PACRGL
  Gene Name: PARK2 co-regulated-like
  Uniprot ID: Q8N7B6
  ENST ID: ENST00000503585
  CDS Start-End: 392-1138
attgcgcggcgcgaccaggttcaggggcgggccgcgcggagcctcatttccccaaacgcaggcgctcggtggcggtagccgcggttgttggccgaccgagtgccggtcataagccccccccggtggggggcagctggtgtgcggatcgcggcgggagagaggcgcggtaggaacgggtccccggagccgtgaaccgcgggtacaggtgtcctgtctgcgctctctgccaagccggcttgcttcctgatctgttgctagggccgctggaccccgttgctaaggacccttgagatcgtgagcgcttggagtgtacccctcctttcctggggtagagggtcagtcgagagtagccttcgttaaccttaattgaaactggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgtttggtgaacagtcacgagtgccttctgcatttgcagctatttactctaaaggaggtattccttgcagattggtacatggttcagtaaaacacagattacagtgggaatgtcctcctgaaagtctttcatttgatccacttcttattactttagctgagggtctgagagagactaagcatccatacacttttgtgtcaaaggagggttttagagaattacttttggtcaaaggtgctcctgaaaaagctattcctttgctacctagactgattcctgtgctaaaggcagctctggtccattcggatgatgaagtgtttgaaagaggattgaatgctctagttcagctaagtgtcgttgttggtccttctctaaacgaccatctgaagcatctgcttacaagcctttccaagagattaatggacaagaaattcaaagagccaatcaccagcgcattacaaaagctagagcaacatggtggaagtgggagccttagcatcatcaaatctaaaattccaacatactgctccatatgctgttgaagaagggagccaacaaaaattgttttttctacctgttgacgtgtcaagcactaactgtgggtactcatttattttattcttttgtaaatcacagccaccattcattatttactaggttaagatgaatagacactgaatcaaagttattcatcaacaaaaaagaacagttactaatggaaagttattaaaataagttctataagagtacaattttgaggtttattttttgtatttttattatttgtgcgaagaaccattattgagtttgcaagataagatgtatttgtattttctagtgtctttttatttataacaacacttttttggcaatcagtttgtagctgtgcccttatttttatagatagtttgccatttcttgggtttaatgtttaacaaggctatagaagtttaaaatagtggacaaatgtttgtgaatacactttt

SEQ ID NO: 163769 - DNA, 1394 bp, Homo sapiens
  Payload ID: 12251
  Gene Symbol: PACRGL
  Gene Name: PARK2 co-regulated-like
  Uniprot ID: Q8N7B6
  ENST ID: ENST00000471979
  CDS Start-End: 249-995
aggcttcagattggaagaatagattacctcctggatagttaagaggagattggaattagctctcaatgagaacctggaatgaaaaacacatgagcaatctacaagaatgaaggataaatgactgaggaccagaaagaccaaagtacgtatatcctagcagatgacaacagaggaccagatgccacactcctccaagcctcatcctctcaacacaattccaaggagagaaagggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgtttggtgaacagtcacgagtgccttctgcatttgcagctatttactctaaaggaggtattccttgcagattggtacatggttcagtaaaacacagattacagtgggaatgtcctcctgaaagtctttcatttgatccacttcttattactttagctgagggtctgagagagactaagcatccatacacttttgtgtcaaaggagggttttagagaattacttttggtcaaaggtgctcctgaaaaagctattcctttgctacctagactgattcctgtgctaaaggcagctctggtccattcggatgatgaagtgtttgaaagaggattgaatgctctagttcagctaagtgtcgttgttggtccttctctaaacgaccatctgaagcatctgcttacaagcctttccaagagattaatggacaagaaattcaaagagccaatcaccagcgcattacaaaagctagagcaacatggtggaagtgggagccttagcatcatcaaatctaaaattccaacatactgctccatatgctgttgaagaagggagccaacaaaaattgttttttctacctgttgacgtgtcaagcactaactgatttctgttgtgtgtctaggtgacgagttctaatttaatgcaattttctgctcaataaaagacaagataattatgtcctaaaaatcaatggtccttctgatggagtttggatttcttctggcaagcacttgaagacagtggaaagttttaaagaagaggagtgaagccactggctttgactgggtgagagaaagaagcaaaggcaaaggaatgtccagctaggcagaaaactggataaaatgacgaaaagagaaactgtctacaaaagcatctatggttctggttttactcaactgtgttcttaagcactcaataaatatttgttaaaagagtgattaactg

SEQ ID NO: 163770 - DNA, 681 bp, Homo sapiens
  Payload ID: 12251
  Gene Symbol: PACRGL
  Gene Name: PARK2 co-regulated-like
  ENST ID: ENST00000506745
  CDS Start-End: 428-681
atttccccaaacgcaggcgctcggtggcggtagccgcggttgttggccgaccgagtgccggtcataagccccccccggtggggggcagctggtgtgcggatcgcggcgggagagaggcgcggtaggaacgggtccccggagccgtgaaccgcgggtacaggtgtcctgtctgcgctctctgccaagccggcttgcttcctgatctgttgctagggccgctggaccccgttgctaaggacccttgagatcgtgagcgcttggagtgtacccctcctttcctggggtagagggtcagtcgagagtagccttcgttaaccttaattgaaactgtttgttacaggaacaactttttgacgtgaaggaagatagaaatttagccataaaattccatccaaaacttccactgaattggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgtttggtgaacagtcacgagtgccttctgcatttgcagctatttactc

SEQ ID NO: 163771 - DNA, 580 bp, Homo sapiens
  Payload ID: 12251
  Gene Symbol: PACRGL
  Gene Name: PARK2 co-regulated-like
  ENST ID: ENST00000514292
  CDS Start-End: 265-580
tttccccaaacgcaggcgctcggtggcggtagccgcggttgttggccgaccgagtgccggtcataagccccccccggtggggggcagctggtgtgcggatcgcggcgggagagaggcgcggtaggaacgggtccccggagccgtgaaccgcgggtacaggtgtcctgtctgcgctctctgccaagccggcttgcttcctgatctgttgctagggccgctggaccccgttgctaaggacccttgagatcgagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccggtccattcggatgatgaagtgtttgaaagaggattgaatgctctagttcagctaagtgtcgttgttggtccttctctaaacgaccatctgaagcatctgcttacaagcg

SEQ ID NO: 163772 - DNA, 810 bp, Homo sapiens
  Payload ID: 12251
  Gene Symbol: PACRGL
  Gene Name: PARK2 co-regulated-like
  ENST ID: ENST00000502938
  CDS Start-End: 346-609
tttccccaaacgcaggcgctcggtggcggtagccgcggttgttggccgaccgagtgccggtcataagccccccccggtggggggcagctggtgtgcggatcgcggcgggagagaggcgcggtaggaacgggtccccggagccgtgaaccgcgggtacaggtgtcctgtctgcgctctctgccaagccggcttgcttcctgatctgttgctagggccgctggaccccgttgctaaggacccttgagatcgtgagcgcttggagtgtacccctcctttcctggggtagagggtcagtcgagagtagccttcgttaaccttaattgaaactggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccggggagccttagcatcatcaaatctaaaattccaacatactgctccatatgctgttgaagaagggagccaacaaaaattgttttttctacctgttgacgtgtcaagcactaactgtgggtactcatttattttattcttttgtaaatcacagccaccattcattatttactaggttaagatgaatagacactgaatcaaagttattcatcaacaaaaaagaacagttactaatggaaagttattaaaataagttctata

SEQ ID NO: 163773 - DNA, 987 bp, Homo sapiens
  Payload ID: 12251
  Gene Symbol: PACRGL
  Gene Name: PARK2 co-regulated-like
  ENST ID: ENST00000508952
  CDS Start-End: 171-452
atttccccaaacgcaggcgctcggtggcggtagccgcggttgttggccgaccgagtgccggtcataagccccccccggtggggggcagctggtgtgcggatcgcggcgggagagaggcgcggtaggaacgggtccccggagccgtgaaccgcgggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgtttggtgaacagtcacgagtgccttctgcatttgcagctatttactctaaaggaggtattccttgcagggtctgagagagactaagcatccatacacttttgtgtcaaaggagggttttagagaattacttttggtcaaaggtgctcctgaaaaagctattcctttgctacctagactgattcctgtgctaaaggcagctctggtccattcggatgatgaagtgtttgaaagaggattgaatgctctagttcagctaagtgtcgttgttggtccttctctaaacgaccatctgaagcatctgcttacaagcctttccaagagattaatggacaagaaattcaaagagccaatcaccagcgcattacaaaagctagagcaacatggtggaagtgggagccttagcatcatcaaatctaaaattccaacatactgctccatatgctgttgaagaagggagccaacaaaaattgttttttctacctgttgacgtgtcaagcactaactgtgggtactcatttattttattcttttgtaaatcacagccaccattcattatttactaggttaagatgaatagacactgaatcaaagttattcatcaacaaaaaa

SEQ ID NO: 163774 - DNA, 1034 bp, Homo sapiens
  Payload ID: 12251
  Gene Symbol: PACRGL
  Gene Name: PARK2 co-regulated-like
  Uniprot ID: Q8N7B6
  ENST ID: ENST00000502374
  CDS Start-End: 138-740
atttccccaaacgcaggcgctcggtggcggtagccgcggttgttggccgaccgagtgccggtcataagccccccccggtggggggcagctggtgtgcggatcgcggcgggagagaggcgcggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgggtctgagagagactaagcatccatacacttttgtgtcaaaggagggttttagagaattacttttggtcaaaggtgctcctgaaaaagctattcctttgctacctagactgattcctgtgctaaaggcagctctggtccattcggatgatgaagtgtttgaaagaggattgaatgctctagttcagctaagtgtcgttgttggtccttctctaaacgaccatctgaagcatctgcttacaagcgaccctgtgcagctcatgaggttcccaagaccactcttaggtttgatgatttgccagaaggatccatggaactcaggaaagctgttactggctgttatggtttcttacaacacacaaaaaataaagattaaaatcagcaaaggggagccttagcatcatcaaatctaaaattccaacatactgctccatatgctgttgaagaagggagccaacaaaaattgttttttctacctgttgacgtgtcaagcactaactgtgggtactcatttattttattcttttgtaaatcacagccaccattcattatttactaggttaagatgaatagacactgaatcaaagttattcatcaacaaaaaagaacagttactaatggaaagttattaaaataagttctataagagtacaattttgaggtttattttttgtatttttattatttgtgcg

SEQ ID NO: 163775 - DNA, 1142 bp, Homo sapiens
  Payload ID: 12251
  Gene Symbol: PACRGL
  Gene Name: PARK2 co-regulated-like
  Uniprot ID: Q8N7B6
  ENST ID: ENST00000507634
  CDS Start-End: 124-789
aggcgctcggtggcggtagccgcggttgttggccgaccgagtgccggtcataagccccccccggtggggggcagctggtgtgcggatcgcggcgggagagaggcgcggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgtttggtgaacagtcacgagtgccttctgcatttgcagctatttactctaaaggaggtattccttgcagattggtacatggttcagtaaaacacagattacagtgggaatgtcctcctgaaagtctttcatttgatccacttcttattactttagctgagggtctgagagagactaagcatccatacacttttgtgtcaaaggagggttttagagaattacttttggtcaaaggtgctcctgaaaaagctattcctttgctacctagactgattcctgtgctaaaggcagctctggtccattcggatgatgaagtgtttgaaagaggattgaatgctctagttcagctaagtgtcgttgttggtccttctctaaacgaccatctgaagcatctgcttacaagcgggagccttagcatcatcaaatctaaaattccaacatactgctccatatgctgttgaagaagggagccaacaaaaattgttttttctacctgttgacgtgtcaagcactaactgatttctgttgtgtgtctaggtgacgagttctaatttaatgcaattttctgctcaataaaagacaagataattatgtcctaaaaatcaatggtccttctgatggagtttggatttcttctggcaagcacttgaagacagtggaaagttttaaagaagaggagtgaagccactggctttgactgggtgagagaaagaagcaaaggcaaaggaatgtccagctaggcagaaaactggataaaatgacgaaaagagaaactgtctacaaaagcatctatggttctggttttactcaactg

SEQ ID NO: 163776 - DNA, 1773 bp, Homo sapiens
  Payload ID: 12251
  Gene Symbol: PACRGL
  Gene Name: PARK2 co-regulated-like
  ENST ID: ENST00000513459
  CDS Start-End: 289-795
gctcggtggcggtagccgcggttgttggccgaccgagtgccggtcataagccccccccggtggggggcagctggtgtgcggatcgcggcgggagagaggcgcggtaggaacgggtccccggagccgtgaaccgcgggtacaggtgtcctgtctgcgctctctgccaagccggcttgcttcctgatctgttgctagggccgctggaccccgttgctaaggacccttgagatcgtgagcgcttggagtgtacccctcctttcctggggtagagggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgggtctgagagagactaagcatccatacacttttgtgtcaaaggagggttttagagaattacttttggtcaaaggtgctcctgaaaaagctattcctttgctacctagactgattcctgtgctaaaggcagctctggtccattcggatgatgaagtgtttgaaagaggattgaatgctctagttcagctaagtgtcgttgttggtccttctctaaacgaccatctgaagcatctgcttacaagcgggagccttagcatcatcaaatctaaaattccaacatactgctccatatgctgttgaagaagggagccaacaaaaattgttttttctacctgttgacgtgtcaagcactaactgtgggtactcatttattttattcttttgtaaatcacagccaccattcattatttactaggttaagatgaatagacactgaatcaaagttattcatcaacaaaaaagaacagttactaatggaaagttattaaaataagttctataagagtacaattttgaggtttattttttgtatttttattatttgtgcgaagaaccattattgagtttgcaagataagatgtatttgtattttctagtgtctttttatttataacaacacttttttggcaatcagtttgtagctgtgcccttatttttatagatagtttgccatttcttgggtttaatgtttaacaaggctatagaagtttaaaatagtggacaaatgtttgtgaatacacttttaaaaaattgttttaaaagagaaaagcggtcttgctttgttgcccagactggagtgcagtggcataatcatagctcaccgcaagcctcaaatttttgtgctcagatgatccttttcatctcagcctcctgattagctgggactataggcgtgtgccaccatgcccagctaattttgaaatttgcttgtagagatgggatctcactctgttgtccaggctggtctcagaattctggtgagtgatcctcccacagtggacttccaaagtgctgggattacaggtgtgagccaccatgcctggccccatgaatacactactaatattatttgtaaatatgtattttataatgtacaatgcttggaaaattttcagagtattctagtttaaaaaattttttctaattctgtaaattctattacaagtatgttgtttattacaactcattacaactacctaaattttaggtgttaactgtatttaagtaaatgtgttatttttgcatttcatagccagaaaatactgatgttcacttaaa

SEQ ID NO: 163777 - DNA, 223 bp, Homo sapiens
  Payload ID: 12251
  Gene Symbol: PACRGL
  Gene Name: PARK2 co-regulated-like
  ENST ID: ENST00000506457
  CDS Start-End: 1-205
gtttggtgaacagtcacgagtgccttctgcatttgcagctatttactctaaaggaggtattccttgcagattggtacatggttcagtaaaacacagattacagtgggaatgtcctcctgaaagtctttcatttgatccacttcttattactttagctgaggtaaatatgccatctcttgaatatttatcagaaaataaacattaaaaattgcattaaatgcta

SEQ ID NO: 163778 - DNA, 860 bp, Homo sapiens
  Payload ID: 12251
  Gene Symbol: PACRGL
  Gene Name: PARK2 co-regulated-like
  ENST ID: ENST00000514485
  CDS Start-End: 494-860
ccaggttcaggggcgggccgcgcggagcctcatttccccaaacgcaggcgctcggtggcggtagccgcggttgttggccgaccgagtgccggtcataagccccccccggtggggggcagctggtgtgcggatcgcggcgggagagaggcgcgggccgctggaccccgttgctaaggacccttgagatcgtgagcgcttggagtgtacccctcctttcctggggtagagggtcagtcgagagtagccttcgttaaccttaattgaaactgtctctttcagatacccaaatccacccatgccaaagtcctccagtctgctctccgtatccgtggttgggtcaaatctatagatgtggaacccgcatatacggagagccaactgtaatttgtcgttaagtttgttacaggaacaactttttgacgtgaaggaagatagaaatttagccataaaattccatccaaaacttccactgaattggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgtttggtgaacagtcacgagtgccttctgcatttgcagctatttactctaaaggaggtattccttgcagattggtacatggttcagtaaaacacagattacagtgggaatgtcctcctgaaagtctttcatttgatccacttcttattactttagctgagg

SEQ ID NO: 163779 - DNA, 543 bp, Homo sapiens
  Payload ID: 12251
  Gene Symbol: PACRGL
  Gene Name: PARK2 co-regulated-like
  ENST ID: ENST00000515339
  CDS Start-End: 307-543
atttccccaaacgcaggcgctcggtggcggtagccgcggttgttggccgaccgagtgccggtcataagccccccccggtggggggcagctggtgtgcggatcgcggcgggagagaggcgcggtaggaacgggtccccggagccgtgaaccgcgggtacaggtgtcctgtctgcgctctctgccaagccggcttgcttcctgatctgttgctagggccgctggaccccgttgctaaggacccttgagatcgtgagcgcttggagtgtacccctcctttcctggggtagagggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccggtccattcggatgatgaagtgtttgaaaga

SEQ ID NO: 163780 - DNA, 543 bp, Homo sapiens
  Payload ID: 12251
  Gene Symbol: PACRGL
  Gene Name: PARK2 co-regulated-like
  ENST ID: ENST00000509625
  CDS Start-End: 441-543
ttccccaaacgcaggcgctcggtggcggtagccgcggttgttggccgaccgagtgccggtcataagccccccccggtggggggcagctggtgtgcggatcgcggcgggagagaggcgcggtaggaacgggtccccggagccgtgaaccgcgggtacaggtgtcctgtctgcgctctctgccaagccggcttgcttcctgatctgttgctagggccgctggaccccgttgctaaggacccttgagatcgtgagcgcttggagtgtacccctcctttcctggggtagagggtcagtcgagagtagccttcgttaaccttaattgaaactgaattggctccaggactccctccctccccccagtctctttcagatacccaaatccacccatgccaaagtcctccagtctgctctccgtatccgtggttgggtcaaatctatagatgtggaacccgcatatacggagagccaactgtaatttgtcgttaagtttgttacaggaacaactttttgacgtgaaggaagatagaaatttagccataaaat

SEQ ID NO: 163781 - DNA, 1276 bp, Homo sapiens
  Payload ID: 12252
  Gene Symbol: PARK2
  Gene Name: parkin RBR E3 ubiquitin protein ligase
  Uniprot ID: O60260
  ENST ID: ENST00000338468
  CDS Start-End: 452-1276
atgatagtgtttgtcaggttcaactccagccatggtttcccagtggaggtcgattctgacaccagcatcttccagctcaaggaggtggttgctaagcgacagggggttccggctgaccagttgcgtgtgattttcgcagggaaggagctgaggaatgactggactgtgcagaattgtgacctggatcagcagagcattgttcacattgtgcagagaccgtggagaaaaggtcaagaaatgaatgcaactggaggcgacgaccccagaaacgcggcgggaggctgtgagcgggagccccagagcttgactcgggtggacctcagcagctcagtcctcccaggagactctgtggggctggctgtcattctgcacactgacagcaggaaggactcaccaccagctggaagtccagggtccatcttgctgggatgatgttttaattccaaaccggatgagtggtgaatgccaatccccacactgccctgggactagtgcagaatttttctttaaatgtggagcacaccccacctctgacaaggaaacatcagtagctttgcacctgatcgcaacaaatagtcggaacatcacttgcattacgtgcacagacgtcaggagccccgtcctggttttccagtgcaactcccgccacgtgatttgcttagactgtttccacttatactgtgtgacaagactcaatgatcggcagtttgttcacgaccctcaacttggctactccctgccttgtgtggctggctgtcccaactccttgattaaagagctccatcacttcaggattctgggagaagagcagtacaaccggtaccagcagtatggtgcagaggagtgtgtcctgcagatggggggcgtgttatgcccccgccctggctgtggagcggggctgctgccggagcctgaccagaggaaagtcacctgcgaagggggcaatggcctgggctgtgggtttgccttctgccgggaatgtaaagaagcgtaccatgaaggggagtgcagtgccgtatttgaagcctcaggaacaactactcaggcctacagagtcgatgaaagagccgccgagcaggctcgttgggaagcagcctccaaagaaaccatcaagaaaaccaccaagccctgtccccgctgccatgtaccagtggaaaaaaatggaggctgcatgcacatgaagtgtccgcagccccagtgcaggctcgagtggtgctggaactgtggctgcgagtggaaccgcgtctgcatgggggaccactggttcgacgtgtag

SEQ ID NO: 163782 - DNA, 1505 bp, Homo sapiens
  Payload ID: 12252
  Gene Symbol: PARK2
  Gene Name: parkin RBR E3 ubiquitin protein ligase
  ENST ID: ENST00000366892
  CDS Start-End: 97-1203
gatttaacccaggagagccgctggtgggaggcgcggctggcgccgctgcgcgcatgggcctgttcctggcccgcagccgccacctacccagtgaccatgatagtgtttgtcaggttcaactccagccatggtttcccagtggaggtcgattctgacaccagcatcttccagctcaaggaggtggttgctaagcgacagggggttccggctgaccagttgcgtgtgattttcgcagggaaggagctgaggaatgactggactgtgcagaattgtgacctggatcagcagagcattgttcacattgtgcagagaccgtggagaaaaggtcaagaaatgaatgcaactggaggcgacgaccccagaaacgcggcgggaggctgtgagcgggagccccagagcttgactcgggtggacctcagcagctcagtcctcccaggagactctgtggggctggctgtcattctgcacactgacagcaggaaggactcaccaccagctggaagtccagcaggtagatcaatctacaacagcttttatgtgtattgcaaaggcccctgtcaaagagtgcagccgggaaaactcagggtacagtgcagcacctgcaggcaggcaacgctcaccttgacccagggtccatcttgctgggatgatgttttaattccaaaccggatgagtggtgaatgccaatccccacactgccctgggactagtgcagaatttttctttaaatgtggagcacaccccacctctgacaaggaaacatcagtagctttgcacctgatcgcaacaaatagtcggaacatcacttgcattacgtgcacagacgtcaggagccccgtcctggttttccagtgcaactcccgccacgtgatttgcttagactgtttccacttatactgtgtgacaagactcaatgatcggcagtttgttcacgaccctcaacttggctactccctgccttgtgtggctggctgtcccaactccttgattaaagagctccatcacttcaggattctgggagaagagcagtacaaccggtaccagcagtatggtgcagaggagtgtgtcctgcagatggggggcgtgttatgcccccgccctggctgtggagcggggctgctgccggagcctgaccagaggaaagtcacctgcgaagggggcaatggcctgggctgtgggtatggacaacgaagaacaaaataagctgcctcagggagaagtgagtgcctcattcaatacatcgttcaaggaaaagtcattggtagcaaagctatagaagaattacagagttccagatgtggaaaaagccctagacgtcattaactccagtgattatcaggatgtggttcacagatttattgtaagatgcctgtgaattcacccgtgcttaatttttttttccctcaattatcaagatagaaaaagtacaactcttaccatgtgggtatgcaagaaatgttagctgttacaaaaaaaatcgcgtataaaaaagttgaaaaccaaat

SEQ ID NO: 163783 - DNA, 1157 bp, Homo sapiens
  Payload ID: 12252
  Gene Symbol: PARK2
  Gene Name: parkin RBR E3 ubiquitin protein ligase
  Uniprot ID: O60260
  ENST ID: ENST00000366894
  CDS Start-End: 333-1157
atgatagtgtttgtcaggttcaactccagccatggtttcccagtggaggtcgattctgacaccagcatcttccagctcaaggaggtggttgctaagcgacagggggttccggctgaccagttgcgtgtgattttcgcagggaaggagctgaggaatgactggactgtgcagcaggtagatcaatctacaacagcttttatgtgtattgcaaaggcccctgtcaaagagtgcagccgggaaaactcagggtacagtgcagcacctgcaggcaggcaacgctcaccttgacccagggtccatcttgctgggatgatgttttaattccaaaccggatgagtggtgaatgccaatccccacactgccctgggactagtgcagaatttttctttaaatgtggagcacaccccacctctgacaaggaaacatcagtagctttgcacctgatcgcaacaaatagtcggaacatcacttgcattacgtgcacagacgtcaggagccccgtcctggttttccagtgcaactcccgccacgtgatttgcttagactgtttccacttatactgtgtgacaagactcaatgatcggcagtttgttcacgaccctcaacttggctactccctgccttgtgtggctggctgtcccaactccttgattaaagagctccatcacttcaggattctgggagaagagcagtacaaccggtaccagcagtatggtgcagaggagtgtgtcctgcagatggggggcgtgttatgcccccgccctggctgtggagcggggctgctgccggagcctgaccagaggaaagtcacctgcgaagggggcaatggcctgggctgtgggtttgccttctgccgggaatgtaaagaagcgtaccatgaaggggagtgcagtgccgtatttgaagcctcaggaacaactactcaggcctacagagtcgatgaaagagccgccgagcaggctcgttgggaagcagcctccaaagaaaccatcaagaaaaccaccaagccctgtccccgctgccatgtaccagtggaaaaaaatggaggctgcatgcacatgaagtgtccgcagccccagtgcaggctcgagtggtgctggaactgtggctgcgagtggaaccgcgtctgcatgggggaccactggttcgacgtgtag

SEQ ID NO: 163784 - DNA, 2514 bp, Homo sapiens
  Payload ID: 12252
  Gene Symbol: PARK2
  Gene Name: parkin RBR E3 ubiquitin protein ligase
  Uniprot ID: O60260
  ENST ID: ENST00000366896
  CDS Start-End: 104-1054
cctggaggatttaacccaggagagccgctggtgggaggcgcggctggcgccgctgcgcgcatgggcctgttcctggcccgcagccgccacctacccagtgaccatgatagtgtttgtcaggttcaactccagccatggtttcccagtggaggtcgattctgacaccagcatcttccagctcaaggaggtggttgctaagcgacagggggttccggctgaccagttgcgtgtgattttcgcagggaaggagctgaggaatgactggactgtgcaggaatttttctttaaatgtggagcacaccccacctctgacaaggaaacatcagtagctttgcacctgatcgcaacaaatagtcggaacatcacttgcattacgtgcacagacgtcaggagccccgtcctggttttccagtgcaactcccgccacgtgatttgcttagactgtttccacttatactgtgtgacaagactcaatgatcggcagtttgttcacgaccctcaacttggctactccctgccttgtgtggctggctgtcccaactccttgattaaagagctccatcacttcaggattctgggagaagagcagtacaaccggtaccagcagtatggtgcagaggagtgtgtcctgcagatggggggcgtgttatgcccccgccctggctgtggagcggggctgctgccggagcctgaccagaggaaagtcacctgcgaagggggcaatggcctgggctgtgggtttgccttctgccgggaatgtaaagaagcgtaccatgaaggggagtgcagtgccgtatttgaagcctcaggaacaactactcaggcctacagagtcgatgaaagagccgccgagcaggctcgttgggaagcagcctccaaagaaaccatcaagaaaaccaccaagccctgtccccgctgccatgtaccagtggaaaaaaatggaggctgcatgcacatgaagtgtccgcagccccagtgcaggctcgagtggtgctggaactgtggctgcgagtggaaccgcgtctgcatgggggaccactggttcgacgtgtagccagggcggccgggcgccccatcgccacatcctgggggagcatacccagtgtctaccttcattttctaattctcttttcaaacacacacacacacgcgcgcgcgcgcacacacactcttcaagtttttttcaaagtccaactacagccaaattgcagaagaaactcctggatccctttcactatgtccatgaaaaacagcagagtaaaattacagaagaagctcctgaatccctttcagtttgtccacacaagacagcagagccatctgcgacaccaccaacaggcgttctcagcctccggatgacacaaataccagagcacagattcaagtgcaatccatgtatctgtatgggtcattctcacctgaattcgagacaggcagaatcagtagctggagagagagttctcacatttaatatcctgccttttaccttcagtaaacaccatgaagatgccattgacaaggtgtttctctgtaaaatgaactgcagtgggttctccaaactagattcatggctttaacagtaatgttcttatttaaattttcagaaagcatctattcccaaagaaccccaggcaatagtcaaaaacatttgtttatccttaagaattccatctatataaatcgcattaatgaaataccaactatgcgtaaatcaacttgtcacaaagtgagaaattatgaaagttaatttgaatgttgaatgtttgaattacagggaagaaatcaagttaatgtactttcattccctttcatgatttgcaactttagaaagaaattgtttttctgaaagtatcaccaaaaaatctatagtttgattctgagtattcattttgcaacttggagattttgctaatacatttggctccactgtaaatttaatagataaagtgcctataaaggaaacacgtttagaaatgatttcaaaatgatattcaatcttaacaaaagtgaacattattaaatcagaatctttaaagaggagcctttccagaactaccaaaatgaagacacgcccgactctctccatcagaagggtttatacccctttggcacaccctctctgtccaatctgcaagtcccagggagctctgcataccaggggttccccaggagagaccttctcttaggacagtaaactcactagaatattccttatgttgacatggattggatttcagttcaatcaaactttcagcttttttttcagccattcacaacacaatcaaaagattaacaacactgcatgcggcaaaccgcatgctcttacccacactacgcagaagagaaagtacaaccactatcttttgttctacctgtattgtctgacttctcaggaagatcgtgaacataactgagggcatgagtctcactagcacatggaggcccttttggatttagagactgtaaattattaaatcggcaacagggcttctctttttagatgtagcactgaaa

SEQ ID NO: 163785 - DNA, 2877 bp, Homo sapiens
  Payload ID: 12252
  Gene Symbol: PARK2
  Gene Name: parkin RBR E3 ubiquitin protein ligase
  Uniprot ID: O60260
  ENST ID: ENST00000366897
  CDS Start-End: 104-1417
cctggaggatttaacccaggagagccgctggtgggaggcgcggctggcgccgctgcgcgcatgggcctgttcctggcccgcagccgccacctacccagtgaccatgatagtgtttgtcaggttcaactccagccatggtttcccagtggaggtcgattctgacaccagcatcttccagctcaaggaggtggttgctaagcgacagggggttccggctgaccagttgcgtgtgattttcgcagggaaggagctgaggaatgactggactgtgcagaattgtgacctggatcagcagagcattgttcacattgtgcagagaccgtggagaaaaggtcaagaaatgaatgcaactggaggcgacgaccccagaaacgcggcgggaggctgtgagcgggagccccagagcttgactcgggtggacctcagcagctcagtcctcccaggagactctgtggggctggctgtcattctgcacactgacagcaggaaggactcaccaccagctggaagtccagcaggtagatcaatctacaacagcttttatgtgtattgcaaaggcccctgtcaaagagtgcagccgggaaaactcagggtacagtgcagcacctgcaggcaggcaacgctcaccttgacccaggaatttttctttaaatgtggagcacaccccacctctgacaaggaaacatcagtagctttgcacctgatcgcaacaaatagtcggaacatcacttgcattacgtgcacagacgtcaggagccccgtcctggttttccagtgcaactcccgccacgtgatttgcttagactgtttccacttatactgtgtgacaagactcaatgatcggcagtttgttcacgaccctcaacttggctactccctgccttgtgtggctggctgtcccaactccttgattaaagagctccatcacttcaggattctgggagaagagcagtacaaccggtaccagcagtatggtgcagaggagtgtgtcctgcagatggggggcgtgttatgcccccgccctggctgtggagcggggctgctgccggagcctgaccagaggaaagtcacctgcgaagggggcaatggcctgggctgtgggtttgccttctgccgggaatgtaaagaagcgtaccatgaaggggagtgcagtgccgtatttgaagcctcaggaacaactactcaggcctacagagtcgatgaaagagccgccgagcaggctcgttgggaagcagcctccaaagaaaccatcaagaaaaccaccaagccctgtccccgctgccatgtaccagtggaaaaaaatggaggctgcatgcacatgaagtgtccgcagccccagtgcaggctcgagtggtgctggaactgtggctgcgagtggaaccgcgtctgcatgggggaccactggttcgacgtgtagccagggcggccgggcgccccatcgccacatcctgggggagcatacccagtgtctaccttcattttctaattctcttttcaaacacacacacacacgcgcgcgcgcgcacacacactcttcaagtttttttcaaagtccaactacagccaaattgcagaagaaactcctggatccctttcactatgtccatgaaaaacagcagagtaaaattacagaagaagctcctgaatccctttcagtttgtccacacaagacagcagagccatctgcgacaccaccaacaggcgttctcagcctccggatgacacaaataccagagcacagattcaagtgcaatccatgtatctgtatgggtcattctcacctgaattcgagacaggcagaatcagtagctggagagagagttctcacatttaatatcctgccttttaccttcagtaaacaccatgaagatgccattgacaaggtgtttctctgtaaaatgaactgcagtgggttctccaaactagattcatggctttaacagtaatgttcttatttaaattttcagaaagcatctattcccaaagaaccccaggcaatagtcaaaaacatttgtttatccttaagaattccatctatataaatcgcattaatgaaataccaactatgcgtaaatcaacttgtcacaaagtgagaaattatgaaagttaatttgaatgttgaatgtttgaattacagggaagaaatcaagttaatgtactttcattccctttcatgatttgcaactttagaaagaaattgtttttctgaaagtatcaccaaaaaatctatagtttgattctgagtattcattttgcaacttggagattttgctaatacatttggctccactgtaaatttaatagataaagtgcctataaaggaaacacgtttagaaatgatttcaaaatgatattcaatcttaacaaaagtgaacattattaaatcagaatctttaaagaggagcctttccagaactaccaaaatgaagacacgcccgactctctccatcagaagggtttatacccctttggcacaccctctctgtccaatctgcaagtcccagggagctctgcataccaggggttccccaggagagaccttctcttaggacagtaaactcactagaatattccttatgttgacatggattggatttcagttcaatcaaactttcagcttttttttcagccattcacaacacaatcaaaagattaacaacactgcatgcggcaaaccgcatgctcttacccacactacgcagaagagaaagtacaaccactatcttttgttctacctgtattgtctgacttctcaggaagatcgtgaacataactgagggcatgagtctcactagcacatggaggcccttttggatttagagactgtaaattattaaatcggcaacagggcttctctttttagatgtagcactgaaa

SEQ ID NO: 163786 - DNA, 4180 bp, Homo sapiens
  Payload ID: 12252
  Gene Symbol: PARK2
  Gene Name: parkin RBR E3 ubiquitin protein ligase
  Uniprot ID: O60260
  ENST ID: ENST00000366898
  CDS Start-End: 104-1501
cctggaggatttaacccaggagagccgctggtgggaggcgcggctggcgccgctgcgcgcatgggcctgttcctggcccgcagccgccacctacccagtgaccatgatagtgtttgtcaggttcaactccagccatggtttcccagtggaggtcgattctgacaccagcatcttccagctcaaggaggtggttgctaagcgacagggggttccggctgaccagttgcgtgtgattttcgcagggaaggagctgaggaatgactggactgtgcagaattgtgacctggatcagcagagcattgttcacattgtgcagagaccgtggagaaaaggtcaagaaatgaatgcaactggaggcgacgaccccagaaacgcggcgggaggctgtgagcgggagccccagagcttgactcgggtggacctcagcagctcagtcctcccaggagactctgtggggctggctgtcattctgcacactgacagcaggaaggactcaccaccagctggaagtccagcaggtagatcaatctacaacagcttttatgtgtattgcaaaggcccctgtcaaagagtgcagccgggaaaactcagggtacagtgcagcacctgcaggcaggcaacgctcaccttgacccagggtccatcttgctgggatgatgttttaattccaaaccggatgagtggtgaatgccaatccccacactgccctgggactagtgcagaatttttctttaaatgtggagcacaccccacctctgacaaggaaacatcagtagctttgcacctgatcgcaacaaatagtcggaacatcacttgcattacgtgcacagacgtcaggagccccgtcctggttttccagtgcaactcccgccacgtgatttgcttagactgtttccacttatactgtgtgacaagactcaatgatcggcagtttgttcacgaccctcaacttggctactccctgccttgtgtggctggctgtcccaactccttgattaaagagctccatcacttcaggattctgggagaagagcagtacaaccggtaccagcagtatggtgcagaggagtgtgtcctgcagatggggggcgtgttatgcccccgccctggctgtggagcggggctgctgccggagcctgaccagaggaaagtcacctgcgaagggggcaatggcctgggctgtgggtttgccttctgccgggaatgtaaagaagcgtaccatgaaggggagtgcagtgccgtatttgaagcctcaggaacaactactcaggcctacagagtcgatgaaagagccgccgagcaggctcgttgggaagcagcctccaaagaaaccatcaagaaaaccaccaagccctgtccccgctgccatgtaccagtggaaaaaaatggaggctgcatgcacatgaagtgtccgcagccccagtgcaggctcgagtggtgctggaactgtggctgcgagtggaaccgcgtctgcatgggggaccactggttcgacgtgtagccagggcggccgggcgccccatcgccacatcctgggggagcatacccagtgtctaccttcattttctaattctcttttcaaacacacacacacacgcgcgcgcgcgcacacacactcttcaagtttttttcaaagtccaactacagccaaattgcagaagaaactcctggatccctttcactatgtccatgaaaaacagcagagtaaaattacagaagaagctcctgaatccctttcagtttgtccacacaagacagcagagccatctgcgacaccaccaacaggcgttctcagcctccggatgacacaaataccagagcacagattcaagtgcaatccatgtatctgtatgggtcattctcacctgaattcgagacaggcagaatcagtagctggagagagagttctcacatttaatatcctgccttttaccttcagtaaacaccatgaagatgccattgacaaggtgtttctctgtaaaatgaactgcagtgggttctccaaactagattcatggctttaacagtaatgttcttatttaaattttcagaaagcatctattcccaaagaaccccaggcaatagtcaaaaacatttgtttatccttaagaattccatctatataaatcgcattaatgaaataccaactatgcgtaaatcaacttgtcacaaagtgagaaattatgaaagttaatttgaatgttgaatgtttgaattacagggaagaaatcaagttaatgtactttcattccctttcatgatttgcaactttagaaagaaattgtttttctgaaagtatcaccaaaaaatctatagtttgattctgagtattcattttgcaacttggagattttgctaatacatttggctccactgtaaatttaatagataaagtgcctataaaggaaacacgtttagaaatgatttcaaaatgatattcaatcttaacaaaagtgaacattattaaatcagaatctttaaagaggagcctttccagaactaccaaaatgaagacacgcccgactctctccatcagaagggtttatacccctttggcacaccctctctgtccaatctgcaagtcccagggagctctgcataccaggggttccccaggagagaccttctcttaggacagtaaactcactagaatattccttatgttgacatggattggatttcagttcaatcaaactttcagcttttttttcagccattcacaacacaatcaaaagattaacaacactgcatgcggcaaaccgcatgctcttacccacactacgcagaagagaaagtacaaccactatcttttgttctacctgtattgtctgacttctcaggaagatcgtgaacataactgagggcatgagtctcactagcacatggaggcccttttggatttagagactgtaaattattaaatcggcaacagggcttctctttttagatgtagcactgaaatccttgctggagggaagagaggggatgaactcaagttttccacatcctgggacacctgtccctcttttcctaactgcctaagataacccatttcttccaaccatctgaggacagtcccgtcgtctcagaggccctgcaccggggagagactgggctctgcagcagccacatcagcattcacagcttcatgtggcttcactgtctgaaaatctaccgactccaacatggccccacggtgacaacagacctgtgacaggaagcccaaagctcacatagaaatggtggacagatcaaagtctctatagtaagggaaaaaaagagaggtggcaggcatgagccccctgcacccagtggctcgtgtccatactgagtccagaccctgatcaaggcctgacttagtgtcactggcagtcccactaaattacacttccttacactggcccgatgcgacaaatcaggtggctcccttctgtcacgtggagcacacagtgttttccatcatccatagctttcttcctgatggtgtttgcattattgcgccttcccaatctgcatgctgcgttgggcttgcggtgcctgaacaaggtttgctcccatgagctcaggcaccctaggatcccctgttagactattaggctgtccagcatggtctcctttcccttcttggtggtggtcttttccctttccagaatagaacagtgattcttaaaataagttagagcaggccgggcgcggtggctcatgcctgtaatcccagcactttgggaggccgaggtgggtggatcacgaggtcaggagttcaagaccagcctggccaagatgatgaaaccccgtctctattaaaaatacaaaaattagctgggcgtggtggcaggcacctgtaatcccagcttcctgggaggctgaggcaggagaatcacttgaacccggggggcagaggttgcagtgagccgagatcacgccactgaactccagcctgggcaacagagtgagactctgtctcaaaaaaaaaaaaaaaacaaaaacaaaaaagcaagatcatccactacacatgaacatgaatcacagtattatttgcacaggaagggtgtaacaaaatatgaatgtatcaaaaaatagaaataaagtctttgcagaaaaagtctgtttttctctgaagtgtgttgagattatctgacaactctaagattgtacttaaattgtcaataaagcatcaaaa

SEQ ID NO: 163787 - DNA, 904 bp, Homo sapiens
  Payload ID: 12252
  Gene Symbol: PARK2
  Gene Name: parkin RBR E3 ubiquitin protein ligase
  Uniprot ID: O60260
  ENST ID: ENST00000479615
  CDS Start-End: 74-730
atgatagaattgtgacctggatcagcagagcattgttcacattgtgcagagaccgtggagaaaaggtcaagaaatgaatgcaactggaggcgacgaccccagaaacgcggcgggaggctgtgagcgggagccccagagcttgactcgggtggacctcagcagctcagtcctcccaggagactctgtggggctggctgtcattctgcacactgacagcaggaaggactcaccaccagctggaagtccagcaggtagatcaatctacaacagcttttatgtgtattgcaaaggcccctgtcaaagagtgcagccgggaaaactcagggtacagtgcagcacctgcaggcaggcaacgctcaccttgacccagggtccatcttgctgggatgatgttttaattccaaaccggatgagtggtgaatgccaatccccacactgccctgggactagtgcagaatttttctttaaatgtggagcacaccccacctctgacaaggaaacatcagtagctttgcacctgatcgcaacaaatagtcggaacatcacttgcattacgtgcacagacgtcaggagccccgtcctggttttccagtgcaactcccgccacgtgatttgcttagactgtttccacttatactgtgtgacaagactcaatgatcggcagtttgttcacgaccctcaacttggctactccctgccttgtgtggtttgccttctgccgggaatgtaaagaagcgtaccatgaaggggagtgcagtgccgtatttgaagcctcaggaacaactactcaggaggctgcatgcacatgaagtgtccgcagccccagtgcaggctcgagtggtgctggaactgtggctgcgagtggaaccgcgtctgcatgggggaccactggttcgacgtgtag

SEQ ID NO: 163788 - DNA, 603 bp, Homo sapiens
  Payload ID: 12252
  Gene Symbol: PARK2
  Gene Name: parkin RBR E3 ubiquitin protein ligase
  ENST ID: ENST00000612540
  CDS Start-End: 1-603
atacaaaatttatctctgagtaaactggagtgcagtggtgcaatctccactcactgcaagctccacctcccaggttcacaccattctcttgcctcagcctcgctggagtggactggtgcgatcttggttcactgcaacgtccacatcccaggttcgagagattctcctgcctcagcctctcaagtagccaggattacaggttatttaagaaagaactcaatctatcaatacccagtaaccatagacagtggtacagtaaagtcaaagattaagcaattaatgatttcagaaacagggatgccaactgagacttttagaattcataggaggggtaaggaagacagaaactgttttactatacagaattgtgacctggatcagcagagcattgttcacattgtgcagagaccgtggagaaaaggtcaagaaatgaatgcaactggaggcgacgaccccagaaacgcggcgggaggctgtgagcgggagccccagagcttgactcgggtggacctcagcagctcagtcctcccaggagactctgtggggctggctgtcattctgcacactgacagcaggaaggactcaccaccagctggaagtcca

SEQ ID NO: 163789 - DNA, 225 bp, Homo sapiens
  Payload ID: 12252
  Gene Symbol: PARK2
  Gene Name: parkin RBR E3 ubiquitin protein ligase
  ENST ID: ENST00000612485
  CDS Start-End: 4-225
acagctggctgtcccaactccttgattaaagagctccatcacttcaggattctgggagaagagcagtacaaccggtaccagcagtatggtgcagaggagtgtgtcctgcagatggggggcgtgttatgcccccgccctggctgtggagcggggctgctgccggagcctgaccagaggaaagtcacctgcgaagggggcaatggcctgggctgtgggtttcccttt

SEQ ID NO: 163790 - DNA, 531 bp, Homo sapiens
  Payload ID: 12252
  Gene Symbol: PARK2
  Gene Name: parkin RBR E3 ubiquitin protein ligase
  ENST ID: ENST00000610470
  CDS Start-End: 1-531
acagctggctgtcccaactccttgattaaagagctccatcacttcaggattctgggagaagagcagtacaaccggtaccagcagtatggtgcagaggagtgtgtcctgcagatggggggcgtgttatgcccccgccctggctgtggagcggggctgctgccggagcctgaccagaggaaagtcacctgcgaagggggcaatggcctgggctgtgggtttgccttctgccgggaatgtaaagaagcgtaccatgaaggggagtgcagtgccgtatttgaagcctcaggaacaactactcaggcctacagagtcgatgaaagagccgccgagcaggctcgttgggaagcagcctccaaagaaaccatcaagaaaaccaccaagccctgtccccgctgccatgtaccagtggaaaaaaatggaggctgcatgcacatgaagtgtccgcagccccagtgcaggctcgagtggtgctggaactgtggctgcgagtggaaccgcgtctgcatgggggaccactggttcgacgtgtag

SEQ ID NO: 163791 - DNA, 261 bp, Homo sapiens
  Payload ID: 12252
  Gene Symbol: PARK2
  Gene Name: parkin RBR E3 ubiquitin protein ligase
  ENST ID: ENST00000615065
  CDS Start-End: 1-261
cagaattgtgacctggatcagcagagcattgttcacattgtgcagagaccgtggagaaaaggtcaagaaatgaatgcaactggaggcgacgaccccagaaacgcggcgggaggctgtgagcgggagccccagagcttgactcgggtggacctcagcagctcagtcctcccaggagactctgtggggctggctgtcattctgcacactgacagcaggaaggactcaccaccagctggaagtccaggtaattgtctgcatgga

SEQ ID NO: 163792 - DNA, 4357 bp, Homo sapiens
  Payload ID: 12253
  Gene Symbol: PDDC1
  Gene Name: Parkinson disease 7 domain containing 1
  Uniprot ID: Q8NB37
  ENST ID: ENST00000319863
  CDS Start-End: 23-685
gacccagcgccgagcccgagccatggcgtccgagcggctccctaacaggcccgcctgtctgctcgtggccagcggcgccgccgaaggtgtgtcggcccagtccttcctccactgtttcacgatggccagcaccgccttcaacctgcaggtggccacccctggggggaaagccatggaatttgtggatgtgactgagagcaatgcacgctgggtgcaagacttccgcctcaaggcttacgccagccccgccaagctcgagtccatcgatggtgcccggtaccatgccctcctgatccccagctgtcctggggccctgaccgacctggccagcagtggctccctggcccgtatcctgcagcacttccactctgagagcaaacccatctgcgccgtcggccacggtgtcgccgccctgtgctgtgccaccaacgaggacagatcctgggtgttcgacagctacagcctgacagggccctctgtgtgtgagctcgtcagggcccccggcttcgcccgcctgccgctcgtggtggaggacttcgtgaaggattcgggcgcctgcttcagtgcaagcgagcctgacgctgtccacgtcgtgctggaccgccacctggtcacaggccagaatgccagctccactgtcccggccgtgcagaacctgctcttcctctgtggcagccggaaatgaacctgctgggtagatgcaccccctgagacagcccaggtgtctccagaggcagccccgtctcaggcttcagggaccccgcctcttccctcctgacaagggccctggatggcagcctggtctggccctgatgggattgttggaggcctcctggaatcagctctgagggggtgtcggctctcctggagggtccaaacccccatcctcctgcatgttctctggtaggaggcagagaaaagaccccacgtgcctggagagctgtgctagctgctaggtggtcctcgggaattccaggctgggttttctagggaggactggttgtcacgtgtggtcactgttgactagacagagtcggctcgggggtcctctgtgtgggtttgccctgctgtggcctgtctgccacccaccacctctttcactgttggtgggggccttgaggggagggcccagccggcgggagctggctcagaactttggccaaaggtgaacggaattttttaggagcagcagcctcctgccccaaggccgaccggcactggcagcactttcctgttgaagaaatcttcctggcgtgtggtttcaaagtgtaagcacctcagtgatgcaccctgtcctaagcattgagaggcacgtttacttgtgaatatgagaccatgagattctcaatgataggaaagtgctgtcccccacggccttgcacagtggcctcgggtagagcggctatcaagagcagacagtggtccagcctgctgggcacctggcctgggctgtggccctccagcgggctgccccctggccccaggttagggcgtccaggagaggcttaggccctctacttcctcacagttccccagtttgagccatcgaaggccttcttcctgcccacctccccgtctcagccacagccgttcccaagcaccagcgtggctcctggtgccagtgacctgccaggaggccccttgtgattataaaaccgttcagttgggccgggcgcagtggctcacacctgtaaccccagcactttgggaggccgaggcgggcggatcacgaggtcaggagatcgagaccatcctggctaacatggtgaaaccccatctctactaaaaaacaaaaatacaaaaagttagcctggcatggtggtgggtgtgtgtagtcccagctacttgggaggctgaggcaggagaatggcgtgaacctgggaggcagagcttgcagtgagctgagatcgtgccactgcactccagcctgggcaatagagtgagactccatctcaaaaaaaaaacgttcagttggctgggcgcggtggctcacgcctgtaatcccagcactttgggaggccaaggtgggtggatcatctgaagtcaggagtttgggaaaagcctggccaacatggtgaaactaaaatacaaaaatgagccgggtgtggtgtcaggcgcctgtattcccagctacttgggaggctgagacgtgagaattgcttgaacctgggaggcggaagttgcagtgagccaagattgcgccattgcactccaacctgggcaatgagtgaaactccgtctcaaaaataaaaaataataaaataaagccgttcaataaggagaatttggaaaaaagtggaagaaggaagcgctgcagccacatccccgccctgaaggctgcgtccctccagtgcctcgcagattagtcaggatgcccacttagcactggccacggggccttgctctgtcccgggtccactctcatccccgtgtggtgatggacctctgtggacaaatgctttttattttatttattttttgagatggagtttgtctctcgtcacccaggctggagtgcagtggcacaatcttggctcactgcaacctctgtctcccgggttcaagcgattctcctgcctcagcctccggagtagctgggattacaggtgtgcgccaccacgcctggctaatttttgtatttttcgtagagaccgagtttcaccatgttggccaggctggtctcgaactcctgacctcaagtgatcctcccgcctcggcctcccaaagtgttaggattacaggcgtgagccactgcgcccggcgtaatttttgtttttagtagagatggggtttcatcatgttggccaggctggtcttgaactcctgacctcaggtgatccatcttcctcagcctcccaaagtgctgggattacaggcgtgagccgccacgtccggctaacaagtacttttttatttttattttattttttggatggagtctcactctgtcgcccaggctggaacacagtggcacgatctcggctcactgcagcctccgcctcccgggttcaagtgattctcctgcctcagcctcccaagtagctaggactacaggtgcacaccaccacacccagctaatttttgtatttttcctttttttttttttttgagatggagtcttgctctgttggcaggctggagtgcagtggcgcgatctcagctcactgcaacctctgcctctgcctcccagattcaagcagttctcctgcctcagcctcccgagtaactgggactacaggtgcatgccactacgcccagctagtttttgtattttcagtagagacggggtttcaccatgttggccaggatggtctcgatctcttgacctcatgatctgcccgcctcggcttcccaaagtgctgggactacaggcaagctcatgtcttaatgtcctagtccatttgggctcctataagaaaatactgtaaactggccgggcacggtggctcacgcctgtaatcccagcactttgggaggctgaggcaggtggatcacctgaggtcaggagttcgagaccagcctggccaagatggtgaaaccccgtctctactaaaaatacagaaattagccgggcgcggtggtgggcgcctgtaatcccatttacttgggaggctgaggcaggagaatcgcttgaacccaggaggcggaggttgcagtgagctgacatcgtgccactgcactctagtctgggtgacagagcaagactccatctcaaaaaaaaaaaaaaagaaaatattgtaaacctagtggcttataaacaacagaaatcagtttcagttttggaggctggaagcccaagatgaaagcaccagtagatgcaacctcttttgtgagggtgatggtcccatgatgaggctgtgcccctgccctgtgaccggatgacctcccaaatgccccacctaataccatccccttgcaggtgaggacttaagcaggtgggttttggggggacgtgctcaggccacagcagggtgcatgaagagccagtgagcctcattgagcccctctggtcagccagatctgacattgagcccagcattgaagatcaaagcaggtggggctttgggatgtgaagtgggttctgacgcggggccccacagacctgtctccgcgtgagctgcctgcaggcccctgcgtcattcctcagctgcgtgcgaggcctctggcttggagagcctccccgctgtgcacagttctctctttgccagggcagggcttggggcagcaccaggctggggcagaggaggaaagcaagaggacagacctccagaagagcagcggagggcgggtgaggatttccccatataccagtgtgtgttcatctacccatgaggaataaaaccatgcagcagcatgc

SEQ ID NO: 163793 - DNA, 3973 bp, Homo sapiens
  Payload ID: 12253
  Gene Symbol: PDDC1
  Gene Name: Parkinson disease 7 domain containing 1
  Uniprot ID: Q8NB37
  ENST ID: ENST00000354286
  CDS Start-End: 27-581
cgcagacccagcgccgagcccgagccatggcgtccgagcggctccctaacaggcccgcctgtctgctcgtggccagcggcgccgccgaaggtgtgtcggcccagtccttcctccactgtttcacgatggccagcaccgccttcaacctgcaggtggccacccctggggggaaagccatggaatttgtggatgtgactgagagcaatgcacgctgggtgcaagacttccgcctcaaggcttacgccagccccgccaagctcgagtccatcgatgaacccatctgcgccgtcggccacggtgtcgccgccctgtgctgtgccaccaacgaggacagatcctgggtgttcgacagctacagcctgacagggccctctgtgtgtgagctcgtcagggcccccggcttcgcccgcctgccgctcgtggtggaggacttcgtgaaggattcgggcgcctgcttcagtgcaagcgagcctgacgctgtccacgtcgtgctggaccgccacctggtcacaggccagaatgccagctccactgtcccggccgtgcagaacctgctcttcctctgtggcagccggaaatgaacctgctgggtagatgcaccccctgagacagcccaggtgtctccagaggcagccccgtctcaggcttcagggaccccgcctcttccctcctgacaagggccctggatggcagcctggtctggccctgatgggattgttggaggcctcctggaatcagctctgagggggtgtcggctctcctggagggtccaaacccccatcctcctgcatgttctctggagcagcagcctcctgccccaaggccgaccggcactggcagcactttcctgttgaagaaatcttcctggcgtgtggtttcaaagtgtaagcacctcagtgatgcaccctgtcctaagcattgagaggcacgtttacttgtgaatatgagaccatgagattctcaatgataggaaagtgctgtcccccacggccttgcacagtggcctcgggtagagcggctatcaagagcagacagtggtccagcctgctgggcacctggcctgggctgtggccctccagcgggctgccccctggccccaggttagggcgtccaggagaggcttaggccctctacttcctcacagttccccagtttgagccatcgaaggccttcttcctgcccacctccccgtctcagccacagccgttcccaagcaccagcgtggctcctggtgccagtgacctgccaggaggccccttgtgattataaaaccgttcagttgggccgggcgcagtggctcacacctgtaaccccagcactttgggaggccgaggcgggcggatcacgaggtcaggagatcgagaccatcctggctaacatggtgaaaccccatctctactaaaaaacaaaaatacaaaaagttagcctggcatggtggtgggtgtgtgtagtcccagctacttgggaggctgaggcaggagaatggcgtgaacctgggaggcagagcttgcagtgagctgagatcgtgccactgcactccagcctgggcaatagagtgagactccatctcaaaaaaaaaacgttcagttggctgggcgcggtggctcacgcctgtaatcccagcactttgggaggccaaggtgggtggatcatctgaagtcaggagtttgggaaaagcctggccaacatggtgaaactaaaatacaaaaatgagccgggtgtggtgtcaggcgcctgtattcccagctacttgggaggctgagacgtgagaattgcttgaacctgggaggcggaagttgcagtgagccaagattgcgccattgcactccaacctgggcaatgagtgaaactccgtctcaaaaataaaaaataataaaataaagccgttcaataaggagaatttggaaaaaagtggaagaaggaagcgctgcagccacatccccgccctgaaggctgcgtccctccagtgcctcgcagattagtcaggatgcccacttagcactggccacggggccttgctctgtcccgggtccactctcatccccgtgtggtgatggacctctgtggacaaatgctttttattttatttattttttgagatggagtttgtctctcgtcacccaggctggagtgcagtggcacaatcttggctcactgcaacctctgtctcccgggttcaagcgattctcctgcctcagcctccggagtagctgggattacaggtgtgcgccaccacgcctggctaatttttgtatttttcgtagagaccgagtttcaccatgttggccaggctggtctcgaactcctgacctcaagtgatcctcccgcctcggcctcccaaagtgttaggattacaggcgtgagccactgcgcccggcgtaatttttgtttttagtagagatggggtttcatcatgttggccaggctggtcttgaactcctgacctcaggtgatccatcttcctcagcctcccaaagtgctgggattacaggcgtgagccgccacgtccggctaacaagtacttttttatttttattttattttttggatggagtctcactctgtcgcccaggctggaacacagtggcacgatctcggctcactgcagcctccgcctcccgggttcaagtgattctcctgcctcagcctcccaagtagctaggactacaggtgcacaccaccacacccagctaatttttgtatttttcctttttttttttttttgagatggagtcttgctctgttggcaggctggagtgcagtggcgcgatctcagctcactgcaacctctgcctctgcctcccagattcaagcagttctcctgcctcagcctcccgagtaactgggactacaggtgcatgccactacgcccagctagtttttgtattttcagtagagacggggtttcaccatgttggccaggatggtctcgatctcttgacctcatgatctgcccgcctcggcttcccaaagtgctgggactacaggcaagctcatgtcttaatgtcctagtccatttgggctcctataagaaaatactgtaaactggccgggcacggtggctcacgcctgtaatcccagcactttgggaggctgaggcaggtggatcacctgaggtcaggagttcgagaccagcctggccaagatggtgaaaccccgtctctactaaaaatacagaaattagccgggcgcggtggtgggcgcctgtaatcccatttacttgggaggctgaggcaggagaatcgcttgaacccaggaggcggaggttgcagtgagctgacatcgtgccactgcactctagtctgggtgacagagcaagactccatctcaaaaaaaaaaaaaaagaaaatattgtaaacctagtggcttataaacaacagaaatcagtttcagttttggaggctggaagcccaagatgaaagcaccagtagatgcaacctcttttgtgagggtgatggtcccatgatgaggctgtgcccctgccctgtgaccggatgacctcccaaatgccccacctaataccatccccttgcaggtgaggacttaagcaggtgggttttggggggacgtgctcaggccacagcagggtgcatgaagagccagtgagcctcattgagcccctctggtcagccagatctgacattgagcccagcattgaagatcaaagcaggtggggctttgggatgtgaagtgggttctgacgcggggccccacagacctgtctccgcgtgagctgcctgcaggcccctgcgtcattcctcagctgcgtgcgaggcctctggcttggagagcctccccgctgtgcacagttctctctttgccagggcagggcttggggcagcaccaggctggggcagaggaggaaagcaagaggacagacctccagaagagcagcggagggcgggtgaggatttccccatataccagtgtgtgttcatctacccatgaggaataaaaccatgcagcagcatgc

SEQ ID NO: 163794 - DNA, 790 bp, Homo sapiens
  Payload ID: 12253
  Gene Symbol: PDDC1
  Gene Name: Parkinson disease 7 domain containing 1
  Uniprot ID: Q8NB37
  ENST ID: ENST00000397472
  CDS Start-End: 10-762
gcccgagccatggcgtccgagcggctccctaacaggcccgcctgtctgctcgtggccagcggcgccgccgaaggtgtgtcggcccagtccttcctccactgtttcacgatggccagcaccgccttcaacctgcaggtggccacccctggggggaaagccatggaatttgtggatgtgactgagagcaatgcacgctgggtgcaagacttccgcctcaaggcttacgccagccccgccaagctcgagtccatcgatggtgcccggtaccatgccctcctgatccccagctgtcctggggccctgaccgacctggccagcagtggctccctggcccgtatcctgcagcacttccactctgagagcaaacccatctgcgccgtcggccacggtgtcgccgccctgtgctgtgccaccaacgaggacagatcctgggtgttcgacagctacagcctgacagggccctctgtgtgtgagctcgtcagggcccccggcttcgcccgcctgccgctcgtggtggaggacttcgtgaaggattcgggcgcctgcttcagtggagcagcagcctcctgccccaaggccgaccggcactggcagcactttcctgttgaagaaatcttcctggcgtgtggtttcaaagtggcagggcttggggcagcaccaggctggggcagaggaggaaagcaagaggacagacctccagaagagcagcggagggcgggtgaggatttccccatataccagtgtgtgttcatctacccatgaggaataaaaccatgcagcagcatgcaaa

SEQ ID NO: 163795 - DNA, 995 bp, Homo sapiens
  Payload ID: 12253
  Gene Symbol: PDDC1
  Gene Name: Parkinson disease 7 domain containing 1
  Uniprot ID: Q8NB37
  ENST ID: ENST00000524550
  CDS Start-End: 14-568
ccgagcccgagccatggcgtccgagcggctccctaacaggcccgcctgtctgctcgtggccagcggcgccgccgaaggtgtgtcggcccagtccttcctccactgtttcacgatggccagcaccgccttcaacctgcaggtggccacccctggggggaaagccatggaatttgtggatgtgactgagagcaatgcacgctgggtgcaagacttccgcctcaaggcttacgccagccccgccaagctcgagtccatcgatgaacccatctgcgccgtcggccacggtgtcgccgccctgtgctgtgccaccaacgaggacagatcctgggtgttcgacagctacagcctgacagggccctctgtgtgtgagctcgtcagggcccccggcttcgcccgcctgccgctcgtggtggaggacttcgtgaaggattcgggcgcctgcttcagtgcaagcgagcctgacgctgtccacgtcgtgctggaccgccacctggtcacaggccagaatgccagctccactgtcccggccgtgcagaacctgctcttcctctgtggcagccggaaatgaacctgctgggtagatgcaccccctgagacagcccaggtgtctccagaggcagccccgtctcaggcttcagggaccccgcctcttccctcctgacaagggccctggatggcagcctggtctggccctgatgggattgttggaggcctcctggaatcagctctgagggggtgtcggctctcctggagggtccaaacccccatcctcctgcatgttctctggtaggaggcagagaaaagaccccacgtgcctggagagctgtgctagctgctaggtggtcctcgggaattccaggctgggttttctagggaggactggttgtcacgtgtggtcactgttgactagacagagtcggctcgggggtcctctgtgtgggtttgccctgctgtggcctgtctgccacccaccacctctttcactgttggtgggg

SEQ ID NO: 163796 - DNA, 756 bp, Homo sapiens
  Payload ID: 12253
  Gene Symbol: PDDC1
  Gene Name: Parkinson disease 7 domain containing 1
  ENST ID: ENST00000526325
  CDS Start-End: 26-586
gcagacccagcgccgagcccgagccatggcgtccgagcggctccctaacaggcccgcctgtctgctcgtggccagcggcgccgccgaaggtgtgtcggcccagtccttcctccactgtttcacgatggccagcaccgccttcaacctgcaggtggccacccctggggggaaagccatggaatttgtggatgtgactgagagcaatgcacgctgggtgcaagacttccgcctcaaggcttacgccagccccgccaagctcgagtccatcgatggtgcccggtaccatgccctcctgatccccagctgtcctggggccctgaccgacctggccagcagtggctccctggcccgtatcctgcagcacttccactctgagagcaaacccatctgcgccgtcggccacggtgtcgccgccctgtgctgtgccaccaacgaggacagatcctgggtgttcgacagctacagcctgacagggggcctgggcctgtctcaggagcccccaccccgctcccgcagccctctgtgtgtgagctcgtcagggcccccggcttcgcccgcctgccgctcgtggtggaggacttcgtgaaggattcgggcgcctgcttcagtgggcagggcttggggcagcaccaggctggggcagaggaggaaagcaagaggacagacctccagaagagcagcggagggcgggtgaggatttccccatataccagtgtgtgttcatctacccatgaggaataaaaccatgcagcagca

SEQ ID NO: 163797 - DNA, 457 bp, Homo sapiens
  Payload ID: 12253
  Gene Symbol: PDDC1
  Gene Name: Parkinson disease 7 domain containing 1
  ENST ID: ENST00000526650
  CDS Start-End: 1-435
aagctcgagtccatcgatggtgcccggtaccatgccctcctgatccccagctgtcctggggccctgaccgacctggccagcagtggctccctggcccgtatcctgcagcacttccactctgagagcaaacccatctgcgccgtcggccacggtgtcgccgccctgtgctgtgccaccaacgaggacagatcctgggtgttcgacagctacagcctgacagggccctctgtgtgtgagctcgtcagggcccccggcttcgcccgcctgccgctcgtggtggaggacttcgtgaaggattcgggcgcctgcttcagtgggcttggggcagcaccaggctggggcagaggaggaaagcaagaggacagacctccagaagagcagcggagggcgggtgaggatttccccatataccagtgtgtgttcatctacccatgaggaataaaaccatgcagcagca

SEQ ID NO: 163798 - DNA, 446 bp, Homo sapiens
  Payload ID: 12253
  Gene Symbol: PDDC1
  Gene Name: Parkinson disease 7 domain containing 1
  ENST ID: ENST00000465313
  CDS Start-End: 1-262
gccctctgtgtgtgagctcgtcagggcccccggcttcgcccgcctgccgctcgtggtggaggacttcgtgaaggattcgggcgcctgcttcagtgcaagcgagcctgacgctgtccacgtcgtgctggaccgccacctggtcacaggccagaatgccagctccactgtcccggccgtgcagaacctgctcttcctctgtggcagccggagcagcagcctcctgccccaaggccgaccggcactggcagcactttcctgttgaagaaatcttcctggcgtgtggtttcaaagtggcagggcttggggcagcaccaggctggggcagaggaggaaagcaagaggacagacctccagaagagcagcggagggcgggtgaggatttccccatataccagtgtgtgttcatctacccatgaggaataaaaccatgcagcagcatgcaaatg

SEQ ID NO: 163799 - DNA, 863 bp, Homo sapiens
  Payload ID: 12253
  Gene Symbol: PDDC1
  Gene Name: Parkinson disease 7 domain containing 1
  ENST ID: ENST00000534603
  CDS Start-End: 22-384
acccagcgccgagcccgagccatggcgtccgagcggctccctaacaggcccgcctgtctgctcgtggccagcggcgccgccgaaggtgtgtcggcccagtccttcctccactgtttcacgatggccagcaccgccttcaacctgcaggtggccacccctggggggaaagccatggaatttgtggatgtgactgagagcaatgcacgctgggtgcaagacttccgcctcaaggcttacgccagccccgccaagctcgagtccatcgatggtgcccggtaccatgccctcctgatccccagctgtcctggggccctgaccgacctggccagcagtggctccctggcccgtatcctgcagcacttccactctgagagcagtaggtgacccctgggacccaggggaggggttggatgtgcagtgtcacaagaaatgggtctcccaccagcagaagagaggtgggaagactccagaacccatctgcgccgtcggccacggtgtcgccgccctgtgctgtgccaccaacgaggacagatcctgggtgttcgacagctacagcctgacagggccctctgtgtgtgagctcgtcagggcccccggcttcgcccgcctgccgctcgtggtggaggacttcgtgaaggattcgggcgcctgcttcagtgcaagcgagcctgacgctgtccacgtcgtgctggaccgccacctggtcacaggccagaatgccagctccactgtcccggccgtgcagaacctgctcttcctctgtggcagccggaaatgaacctgctgggtagatgcaccccctgagacagcccaggtgtctccagaggcagccccgtctcaggcttcagggaccccgcctcttc

SEQ ID NO: 163800 - DNA, 510 bp, Homo sapiens
  Payload ID: 12253
  Gene Symbol: PDDC1
  Gene Name: Parkinson disease 7 domain containing 1
  ENST ID: ENST00000528309
  CDS Start-End: 1-489
tgggtgcaagacttccgcctcaaggcttacgccagccccgccaagctcgagtccatcgatggtgcccggtaccatgccctcctgatccccagctgtcctggggccctgaccgacctggccagcagtggctccctggcccgtatcctgcagcacttccactctgagagcaaacccatctgcgccgtcggccacggtgtcgccgccctgtgctgtgccaccaacgaggacagatcctgggtgttcgacagctacagcctgacagggccctctgtgtgtgagctcgtcagggcccccggcttcgcccgcctgccgctcgtggtggaggacttcgtgaaggattcgggcgcctgcttcagtgggcagggcttggggcagcaccaggctggggcagaggaggaaagcaagaggacagacctccagaagagcagcggagggcgggtgaggatttccccatataccagtgtgtgttcatctacccatgaggaataaaaccatgcagcagcatgcaaa

SEQ ID NO: 163801 - DNA, 949 bp, Homo sapiens
  Payload ID: 12254
  Gene Symbol: PARK7
  Gene Name: parkinson protein 7
  Uniprot ID: Q99497
  ENST ID: ENST00000338639
  CDS Start-End: 155-724
gcagtgtggggctgagggaggccggacggcgcgcgtgcgtgctggcgtgcgttcattttcagcctggtgtggggtgagtggtacccaacgggccggggcgccgcgtccgcaggaagaggcgcggggtgcaggcttgtaaacatataacataaaaatggcttccaaaagagctctggtcatcctggctaaaggagcagaggaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaagagggaccatatgatgtggtggttctaccaggaggtaatctgggcgcacagaatttatctgagtctgctgctgtgaaggagatactgaaggagcaggaaaaccggaagggcctgatagccgccatctgtgcaggtcctactgctctgttggctcatgaaataggttttggaagtaaagttacaacacaccctcttgctaaagacaaaatgatgaatggaggtcattacacctactctgagaatcgtgtggaaaaagacggcctgattcttacaagccgggggcctgggaccagcttcgagtttgcgcttgcaattgttgaagccctgaatggcaaggaggtggcggctcaagtgaaggctccacttgttcttaaagactagagcagcgaactgcgacgatcacttagagaaacaggccgttaggaatccattctcactgtgttcgctctaaacaaaacagtggtaggttaatgtgttcagaagtcgctgtccttactacttttgcggaagtatggaagtcacaactacacagagatttctcagcctacaaattgtgtctatacatttctaagccttgtttgcagaataaacagggcatttagcaaa

SEQ ID NO: 163802 - DNA, 783 bp, Homo sapiens
  Payload ID: 12254
  Gene Symbol: PARK7
  Gene Name: parkinson protein 7
  Uniprot ID: Q99497
  ENST ID: ENST00000377488
  CDS Start-End: 157-726
tttgactgaccgccagcgtggtggcaacgctgaagcgtccagaatcttctgcctaacctctcgccggcatggaactggctagccgttttattaaactctgttttgcgtggacggtaaaccctccagataatctgcttgtaaacatataacataaaaatggcttccaaaagagctctggtcatcctggctaaaggagcagaggaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaagagggaccatatgatgtggtggttctaccaggaggtaatctgggcgcacagaatttatctgagtctgctgctgtgaaggagatactgaaggagcaggaaaaccggaagggcctgatagccgccatctgtgcaggtcctactgctctgttggctcatgaaataggttttggaagtaaagttacaacacaccctcttgctaaagacaaaatgatgaatggaggtcattacacctactctgagaatcgtgtggaaaaagacggcctgattcttacaagccgggggcctgggaccagcttcgagtttgcgcttgcaattgttgaagccctgaatggcaaggaggtggcggctcaagtgaaggctccacttgttcttaaagactagagcagcgaactgcgacgatcacttagagaaacaggccgttaggaatccattctcact

SEQ ID NO: 163803 - DNA, 977 bp, Homo sapiens
  Payload ID: 12254
  Gene Symbol: PARK7
  Gene Name: parkinson protein 7
  Uniprot ID: Q99497
  ENST ID: ENST00000377491
  CDS Start-End: 212-781
agaaccggcgcggggcctgggtcggggccgccctcgcttccggcctcccagtcgggccctgtcgctggcgttggatttgactgaccgccagcgtggtggcaacgctgaagcgtccagaatcttctgcctaacctctcgccggcatggaactggctagccgttttattaaactctgttttgcgtggacggcttgtaaacatataacataaaaatggcttccaaaagagctctggtcatcctggctaaaggagcagaggaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaagagggaccatatgatgtggtggttctaccaggaggtaatctgggcgcacagaatttatctgagtctgctgctgtgaaggagatactgaaggagcaggaaaaccggaagggcctgatagccgccatctgtgcaggtcctactgctctgttggctcatgaaataggttttggaagtaaagttacaacacaccctcttgctaaagacaaaatgatgaatggaggtcattacacctactctgagaatcgtgtggaaaaagacggcctgattcttacaagccgggggcctgggaccagcttcgagtttgcgcttgcaattgttgaagccctgaatggcaaggaggtggcggctcaagtgaaggctccacttgttcttaaagactagagcagcgaactgcgacgatcacttagagaaacaggccgttaggaatccattctcactgtgttcgctctaaacaaaacagtggtaggttaatgtgttcagaagtcgctgtccttactacttttgcggaagtatggaagtcacaactacacagagatttctcagcctacaaattgtgtctatacatttctaagccttg

SEQ ID NO: 163804 - DNA, 1088 bp, Homo sapiens
  Payload ID: 12254
  Gene Symbol: PARK7
  Gene Name: parkinson protein 7
  Uniprot ID: Q99497
  ENST ID: ENST00000493678
  CDS Start-End: 68-637
cgcgcgtgcgtgctggcgtgcgttcattttcagcctggtgtggggcttgtaaacatataacataaaaatggcttccaaaagagctctggtcatcctggctaaaggagcagaggaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaagagggaccatatgatgtggtggttctaccaggaggtaatctgggcgcacagaatttatctgagtctgctgctgtgaaggagatactgaaggagcaggaaaaccggaagggcctgatagccgccatctgtgcaggtcctactgctctgttggctcatgaaataggttttggaagtaaagttacaacacaccctcttgctaaagacaaaatgatgaatggaggtcattacacctactctgagaatcgtgtggaaaaagacggcctgattcttacaagccgggggcctgggaccagcttcgagtttgcgcttgcaattgttgaagccctgaatggcaaggaggtggcggctcaagtgaaggctccacttgttcttaaagactagagcagcgaactgcgacgatcacttagagaaacaggccgttaggaatccattctcactgtgttcgctctaaacaaaacagtggtaggttaatgtgttcagaagtcgctgtccttactacttttgcggaagtatggaagtcacaactacacagagatttctcagcctacaaattgtgtctatacatttctaagccttgtttgcagaataaacagggcatttagcaaactactgattgtttcttgttttgtctctcatttcttttgtgaaattaaattccgtatcaccttcatttgcagctcttaactgtccatatggcactgaaataaaagaacagtgaccacattttacacagcaaggaggaaaggcatacaaacagaatttaagaggcttgtgattttctctgcttattagctgtgtgtttttaatgtgctattaaaaaataccaatgagg

SEQ ID NO: 163805 - DNA, 624 bp, Homo sapiens
  Payload ID: 12254
  Gene Symbol: PARK7
  Gene Name: parkinson protein 7
  Uniprot ID: Q99497
  ENST ID: ENST00000493373
  CDS Start-End: 57-624
ccggaagtggacctacgtcatgcaggtcagtcggcttgtaaacatataacataaaaatggcttccaaaagagctctggtcatcctggctaaaggagcagaggaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaagagggaccatatgatgtggtggttctaccaggaggtaatctgggcgcacagaatttatctgagtctgctgctgtgaaggagatactgaaggagcaggaaaaccggaagggcctgatagccgccatctgtgcaggtcctactgctctgttggctcatgaaataggttttggaagtaaagttacaacacaccctcttgctaaagacaaaatgatgaatggaggtcattacacctactctgagaatcgtgtggaaaaagacggcctgattcttacaagccgggggcctgggaccagcttcgagtttgcgcttgcaattgttgaagccctgaatggcaaggaggtggcggctcaagtgaaggctccacttgttcttaaagact

SEQ ID NO: 163806 - DNA, 795 bp, Homo sapiens
  Payload ID: 12254
  Gene Symbol: PARK7
  Gene Name: parkinson protein 7
  ENST ID: ENST00000377493
  CDS Start-End: 59-568
gtgctggcgtgcgttcattttcagcctggtgtggggcttgtaaacatataacataaaaatggcttccaaaagagctctggtcatcctggctaaaggagcagaggaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaagagtctgctgctgtgaaggagatactgaaggagcaggaaaaccggaagggcctgatagccgccatctgtgcaggtcctactgctctgttggctcatgaaataggttttggaagtaaagttacaacacaccctcttgctaaagacaaaatgatgaatggaggtcattacacctactctgagaatcgtgtggaaaaagacggcctgattcttacaagccgggggcctgggaccagcttcgagtttgcgcttgcaattgttgaagccctgaatggcaaggaggtggcggctcaagtgaaggctccacttgttcttaaagactagagcagcgaactgcgacgatcacttagagaaacaggccgttaggaatccattctcactgtgttcgctctaaacaaaacagtggtaggttaatgtgttcagaagtcgctgtccttactacttttgcggaagtatggaagtcacaactacacagagatttctcagcctacaaattgtgtctatacatttctaagccttgtttgcagaataaacagggcatttagcaaact

SEQ ID NO: 163807 - DNA, 711 bp, Homo sapiens
  Payload ID: 12254
  Gene Symbol: PARK7
  Gene Name: parkinson protein 7
  ENST ID: ENST00000469225
  CDS Start-End: 1-483
ggaaaagacccagtacagtgtagccgtgatgtggtcatttgtcctgatgccagccttgaagatgcaaaaaaagagggaccatatgatgtggtggttctaccaggaggtaatctgggcgcacagaatttatctgagtctgctgctgtgaaggagatactgaaggagcaggaaaaccggaagggcctgatagccgccatctgtgcaggtcctactgctctgttggctcatgaaataggttttggaagtaaagttacaacacaccctcttgctaaagacaaaatgatgaatggaggatgtcaccttttctgtttctactttgcaggtcattacacctactctgagaatcgtgtggaaaaagacggcctgattcttacaagccgggggcctgggaccagcttcgagtttgcgcttgcaattgttgaagccctgaatggcaaggaggtggcggctcaagtgaaggctccacttgttcttaaagactagagcagcgaactgcgacgatcacttagagaaacaggccgttaggaatccattctcactgtgttcgctctaaacaaaacagtggtaggttaatgtgttcagaagtcgctgtccttactacttttgcggaagtatggaagtcacaactacacagagatttctcagcctacaaattgtgtctatacatttctaagccttgtttgcagaataaacagggcatttagcaaacta

SEQ ID NO: 163808 - DNA, 758 bp, Homo sapiens
  Payload ID: 12255
  Gene Symbol: PNKD
  Gene Name: paroxysmal nonkinesigenic dyskinesia
  Uniprot ID: Q8N490
  ENST ID: ENST00000248451
  CDS Start-End: 145-573
gagtagttctcctgggtccgctctgcgggcttctgggagatgtagtttctggtctgtaggcaggacggaaggagcgggggaggccccttacgcaaactacaattcccggcggggagcgcggtgaagcgggggtgggatctgaacatggcggcggtggtagctgctacggcgctgaagggccggggggcgagaaatgcccgcgtcctccgggggattctcgcaggagccacagctaacaaggcttctcataacaggacccgggccctgcaaagccacagctccccagagggcaaggaggaacctgaacccctatccccggagctggaatacattcccagaaagaggggcaagaaccccatgaaagctgtgggactggcctgggccatcggcttcccttgtggtatcctcctcttcatcctcaccaagcgggaagtggacaaggaccgtgtgaagcagatgaaggctcggcagaacatgcggttgtccaacacgggcgagtatgagagccagaggttcagggcttcctcccagagtgccccgtcccctgatgttgggtctggggtgcagacctgaggagcgctgcgaccctcctaggctattgactgttaagtcctcaggtttggcccagattccagttcgtgcctctgaggtccaccagagggcgcatgaagcccaggctgttgccaaaccctaccctgccccacaccaaggagccagccaaaggcaaataaagttattgagtgtttagtagaaaggaa

SEQ ID NO: 163809 - DNA, 2991 bp, Homo sapiens
  Payload ID: 12255
  Gene Symbol: PNKD
  Gene Name: paroxysmal nonkinesigenic dyskinesia
  Uniprot ID: Q8N490
  ENST ID: ENST00000258362
  CDS Start-End: 96-1181
cagagccggcaggcaggttccccgcggggggccggggccgggccgttgcctagcaacgccgagccccgcccggccggcgcgtgcctgcccccagcatggcttggcagggctggcccgcggcgtggcagtgggtcgccggctgctggctcctcctcgtccttgtcctcgtcctacttgtgagcccccgcggctgccgagcgcggcggggcctccgcggtctgctcatggcgcacagccagcggctgctcttccgaatcgggtacagcctgtacacccgcacctggctcgggtacctcttctaccgacagcagctgcgcagggctcggaatcgctaccctaaaggccactcgaaaacccagccccgcctcttcaatggagtgaaggtgcttcccatccctgtcctctcggacaactacagctacctcatcatcgacacccaggcccagctggctgtggctgtggacccttcagaccctcgggctgtgcaggcttccattgaaaaggaaggggtcaccttggtcgccattctgtgtactcacaagcactgggaccacagtggagggaaccgtgacctcagccggcggcaccgggactgtcgggtgtacgggagccctcaggacggcatcccctacctcacccatcccctgtgtcatcaagatgtggtcagcgtgggacggcttcagatccgggccctggctacacctggccacacacaaggccatctggtctacctactggatggggagccctacaagggtccctcctgcctcttctcaggggacctgctcttcctctctggctgtgggcggacctttgagggcaatgcagagaccatgctgagctcactggacactgtgctggggctaggggatgacacccttctgtggcctggtcatgagtatgcagaggagaacctgggctttgcaggtgtggtggagcccgagaacctggcccgggagaggaagatgcagtgggtgcagcggcagcggctggagcgcaagggcacgtgcccatctaccctgggagaggagcgctcctacaacccgttcctgagaacccactgcctggcgctacaggaggctctggggccggggccgggccccactggggatgatgactactcccgggcccagctcctggaagagctccgccggctgaaggatatgcacaagagcaagtgatgcccccagcgcccccagcccagcccactccccgcatggggaggccgccaccaccaacacctcatcatccttctcatcgctaacaccaccacctccatcggcacccaagcgggcatcatccccccacactgctcaggggaggggagggatcaggcgatgagactgtgaggccaaaagaagggggcctgttggaggctgggaaccccgcagcgcgaggctgcctcatcaacggcaagaggaaaggaggggtctcgggacatctccagaccctaccaactgggagggtcccctcctccttccctactcctgggacggcagcaaggacatgggggctgctgttagcttctccgtcaggaggcctcatctcactgtagccctggaacccagggtccatcttgcccttcccccatccatggttgggaaagaagctcagcccctcacagtggcctcaagtgtgatgccttacaaaagcaccactcagatgggcagctggactctggtgtcctgagactctgccctcttcccacagcctccctgccccacccatccctgcaaagccatttttcagacagagccattcctaagaacactgaagggctggaatgctggctggccactctctgcctcagtggcctccctacagcctggaagaaggagggtcctgattgccaaggaaacctcctcattgggctaaggagacactggagtctggagtgtggagccccacagtcttgcaggtcacatgctctccttgcacatctggcctggttgtacccactggcctctgcctctgccctgggccaaaagggcccctccttgccaggggagagacagccacggtcctctttggccgatgctgtattctcattttggcccttgttcttaggcccgtctgcccgccttcctccatctaacctttcctgttttatccgcagcccttttcttctttgagttagtaaagatttattctgtaacctgacactcatctggccctttgcagtttgccagccatattcccatgtgatttcccactggatccaggcccccatccggctggcaggagggggctctgacgtgcaggttggaaatcagaagtctgtgagagcgcgggagtgcatggcagctctgggtcccagacctggcccgacccctctgcttcacctccagctctgctgctcctctactcttgggtcgagatccctttggagccacagcgaggaaccctgtggtcctcaggcaggtgtaccttgagtcagccaggagccctcttttcctgtgtcaaagcctgccctcgggctctgctcacctctggtgaccctccaagatgcccctgccctcagtttcccctcatgatctggcctctgcccccttctctagccacagcctctagtacactttagcaataccaccagactagttagagttccccactcaccaagcaagacatgcagtttcatgcctctgtgccttcgctcatgctgtttcttccgactggaatgccttcccctgctcctcctgccttgtctgcctggcaagttcatctctcacgatcccctcaaaggccccctcctccaggaaggcaacccctgtgcccctcccctccaggctacctctgcactttgtcaatgcttctcttgtggcacttatcacactgtattttacttgtttacatgtttgtctccccttctagactgtgaatccttaagggcatggactgtatcttatgcatctctgtatttctgcgcctagcacggtgcctagcacacagtaggcgctcaataaatgttgaatgaatgaatgatttaatcaa

SEQ ID NO: 163810 - DNA, 3021 bp, Homo sapiens
  Payload ID: 12255
  Gene Symbol: PNKD
  Gene Name: paroxysmal nonkinesigenic dyskinesia
  Uniprot ID: Q8N490
  ENST ID: ENST00000273077
  CDS Start-End: 52-1209
aaactacaattcccggcggggagcgcggtgaagcgggggtgggatctgaacatggcggcggtggtagctgctacggcgctgaagggccggggggcgagaaatgcccgcgtcctccgggggattctcgcaggagccacagctaacaaggcttctcataacaggacccgggccctgcaaagccacagctccccagagggcaaggaggaacctgaacccctatccccggagctggaatacattcccagaaagaggggcaagaaccccatgaaagctgtgggactggcctggtacagcctgtacacccgcacctggctcgggtacctcttctaccgacagcagctgcgcagggctcggaatcgctaccctaaaggccactcgaaaacccagccccgcctcttcaatggagtgaaggtgcttcccatccctgtcctctcggacaactacagctacctcatcatcgacacccaggcccagctggctgtggctgtggacccttcagaccctcgggctgtgcaggcttccattgaaaaggaaggggtcaccttggtcgccattctgtgtactcacaagcactgggaccacagtggagggaaccgtgacctcagccggcggcaccgggactgtcgggtgtacgggagccctcaggacggcatcccctacctcacccatcccctgtgtcatcaagatgtggtcagcgtgggacggcttcagatccgggccctggctacacctggccacacacaaggccatctggtctacctactggatggggagccctacaagggtccctcctgcctcttctcaggggacctgctcttcctctctggctgtgggcggacctttgagggcaatgcagagaccatgctgagctcactggacactgtgctggggctaggggatgacacccttctgtggcctggtcatgagtatgcagaggagaacctgggctttgcaggtgtggtggagcccgagaacctggcccgggagaggaagatgcagtgggtgcagcggcagcggctggagcgcaagggcacgtgcccatctaccctgggagaggagcgctcctacaacccgttcctgagaacccactgcctggcgctacaggaggctctggggccggggccgggccccactggggatgatgactactcccgggcccagctcctggaagagctccgccggctgaaggatatgcacaagagcaagtgatgcccccagcgcccccagcccagcccactccccgcatggggaggccgccaccaccaacacctcatcatccttctcatcgctaacaccaccacctccatcggcacccaagcgggcatcatccccccacactgctcaggggaggggagggatcaggcgatgagactgtgaggccaaaagaagggggcctgttggaggctgggaaccccgcagcgcgaggctgcctcatcaacggcaagaggaaaggaggggtctcgggacatctccagaccctaccaactgggagggtcccctcctccttccctactcctgggacggcagcaaggacatgggggctgctgttagcttctccgtcaggaggcctcatctcactgtagccctggaacccagggtccatcttgcccttcccccatccatggttgggaaagaagctcagcccctcacagtggcctcaagtgtgatgccttacaaaagcaccactcagatgggcagctggactctggtgtcctgagactctgccctcttcccacagcctccctgccccacccatccctgcaaagccatttttcagacagagccattcctaagaacactgaagggctggaatgctggctggccactctctgcctcagtggcctccctacagcctggaagaaggagggtcctgattgccaaggaaacctcctcattgggctaaggagacactggagtctggagtgtggagccccacagtcttgcaggtcacatgctctccttgcacatctggcctggttgtacccactggcctctgcctctgccctgggccaaaagggcccctccttgccaggggagagacagccacggtcctctttggccgatgctgtattctcattttggcccttgttcttaggcccgtctgcccgccttcctccatctaacctttcctgttttatccgcagcccttttcttctttgagttagtaaagatttattctgtaacctgacactcatctggccctttgcagtttgccagccatattcccatgtgatttcccactggatccaggcccccatccggctggcaggagggggctctgacgtgcaggttggaaatcagaagtctgtgagagcgcgggagtgcatggcagctctgggtcccagacctggcccgacccctctgcttcacctccagctctgctgctcctctactcttgggtcgagatccctttggagccacagcgaggaaccctgtggtcctcaggcaggtgtaccttgagtcagccaggagccctcttttcctgtgtcaaagcctgccctcgggctctgctcacctctggtgaccctccaagatgcccctgccctcagtttcccctcatgatctggcctctgcccccttctctagccacagcctctagtacactttagcaataccaccagactagttagagttccccactcaccaagcaagacatgcagtttcatgcctctgtgccttcgctcatgctgtttcttccgactggaatgccttcccctgctcctcctgccttgtctgcctggcaagttcatctctcacgatcccctcaaaggccccctcctccaggaaggcaacccctgtgcccctcccctccaggctacctctgcactttgtcaatgcttctcttgtggcacttatcacactgtattttacttgtttacatgtttgtctccccttctagactgtgaatccttaagggcatggactgtatcttatgcatctctgtatttctgcgcctagcacggtgcctagcacacagtaggcgctcaataaatgttgaatgaatgaatgatttaatcaaga

SEQ ID NO: 163811 - DNA, 978 bp, Homo sapiens
  Payload ID: 12255
  Gene Symbol: PNKD
  Gene Name: paroxysmal nonkinesigenic dyskinesia
  Uniprot ID: Q8N490
  ENST ID: ENST00000436005
  CDS Start-End: 1-978
atgccctcctcagtgcatcataccaagaggcaaatgatgtctatatattgttactggtacagcctgtacacccgcacctggctcgggtacctcttctaccgacagcagctgcgcagggctcggaatcgctaccctaaaggccactcgaaaacccagccccgcctcttcaatggagtgaaggtgcttcccatccctgtcctctcggacaactacagctacctcatcatcgacacccaggcccagctggctgtggctgtggacccttcagaccctcgggctgtgcaggcttccattgaaaaggaaggggtcaccttggtcgccattctgtgtactcacaagcactgggaccacagtggagggaaccgtgacctcagccggcggcaccgggactgtcgggtgtacgggagccctcaggacggcatcccctacctcacccatcccctgtgtcatcaagatgtggtcagcgtgggacggcttcagatccgggccctggctacacctggccacacacaaggccatctggtctacctactggatggggagccctacaagggtccctcctgcctcttctcaggggacctgctcttcctctctggctgtgggcggacctttgagggcaatgcagagaccatgctgagctcactggacactgtgctggggctaggggatgacacccttctgtggcctggtcatgagtatgcagaggagaacctgggctttgcaggtgtggtggagcccgagaacctggcccgggagaggaagatgcagtgggtgcagcggcagcggctggagcgcaagggcacgtgcccatctaccctgggagaggagcgctcctacaacccgttcctgagaacccactgcctggcgctacaggaggctctggggccggggccgggccccactggggatgatgactactcccgggcccagctcctggaagagctccgccggctgaaggatatgcacaagagcaagtga

SEQ ID NO: 163812 - DNA, 3014 bp, Homo sapiens
  Payload ID: 12256
  Gene Symbol: PARPBP
  Gene Name: PARP1 binding protein
  Uniprot ID: Q9NWS1
  ENST ID: ENST00000327680
  CDS Start-End: 46-1785
ccgcacactgaagagtacgtcttcgggtctacccctaatcacataatggctgtgtttaatcagaagtctgtctcggatatgattaaagagtttcgaaaaaattggcgtgctctttgtaactctgagagaactactctatgtggtgcagactccatgctcttggcattgcagctttctatggcggagaacaacaaacagcacagtggagaatttacagtctctctcagtgatgttttattgacatggaaatacttgctccatgagaaattgaacttaccagttgaaaacatggacgtgactgaccattatgaggacgttaggaagatttatgatgatttcttgaagaacagtaatatgttagatctgattgatgtttatcaaaaatgtagggctttgacttctaattgtgaaaattataacacagtatctcctagtcaactactggattttctgtctggcaaacagtatgcagtaggtgatgaaactgatctttctataccaacatcaccaacaagtaaatacaaccgtgataatgaaaaggtgcagctgctagcaaggaaaattatcttttcatatttaaatctgctagtgaattcaaagaatgacctggctgtggcttatattctcaatattcctgatagaggactaggaagagaagccttcactgatttgaaacatgctgctcgagagaaacaaatgtctatctttttggtggccacgtcttttattagaacaatagagcttggagggaaaggatatgcaccaccaccatcagatcctttaaggacacatgtaaagggattgtctaattttattaatttcattgacaaattagatgagattcttggagaaataccaaacccaagcattgcagggggtcaaatactgtcagtgataaagatgcaactgattaaaggccaaaacagcagggatcctttttgcaaagcaatagaggaagttgctcaggatttggatttgaggattaaaaatattatcaattctcaagaaggtgttgtagctcttagcaccactgacatcagtcctgctcggccaaaatctcatgccataaaccatggtactgcatactgtggcagagatactgtgaaagccttattagttcttttggacgaagaagcagctaatgctcctaccaaaaacaaagcagagcttttatatgatgaggaaaacacaatccatcatcatggaacgtctattcttacactttttaggtctcccacacaggtgaataattcgataaaacccctaagagaacgcatctgtgtgtcaatgcaagagaaaaaaattaagatgaagcaaactttaattagatcccaatttgcttgtacttataaagatgactacatgataagcaaggataattggaataatgttaatttagcatcaaagcctttgtgtgttctttacatggaaaatgacctttctgagggtgtaaatccatctgttggaagatcaacaattggaacgagttttggaaatgttcatctggacagaagtaaaaatgaaaaagtatcaagaaaatcaaccagtcagacaggaaataaaagctcaaaaaggaaacaggtggatttggatggtgaaaatattctctgtgataatagaaatgaaccacctcaacataaaaatgctaaaatacctaagaaatcaaatgattcacagaatagattgtacggcaaactagctaaagtagcaaaaagtaataaatgtactgccaaggacaagttgatttctggccaggcaaagttaactcagttttttagactataaatttgtgtcttatatgctttaggtttatgtatctataaaccattcaccaaagacatgcttaatttttaagagatcaaggtgtaaattatgatgatttattattttggtctacagtgtatgtaaggttagtatgttaagcattgtttaaaaatactagtaagtcataattatgcagaattttcacaaagtttaatgcacagagaaagcatatcatttcagttactgatacatcttaacactactttcttttaaaacagacatttaacatacacaagttatagtagcagtatgggcttctcctcccattggcaattaaatgcttttattttcttctgaaaagatgatgtggaccaacaggtatcagacttgccaacaaggtcggtagactcttcccagcatacatctgagcactgaaggaagaagaaagtttaaattgtttaaaggactataattatcacacaaaatttattaagaaaaaaagaatggatctagtataactaattctgagtaaaccaaaatgataataattaattgttgctatttaatcccacatttttggcaggtgtaattgagccatggtcttatttgattttgttatgattgcatccaaattcactttaactcagagttctgtttaatggtggtaggatgtaagaattgaattttgaaaagactactcactgtcaaaatctctccttcctataggaaatttagctgagttttcttcatccccaatttctctcttttcttgtgttgattcagtattctgaactccattctcagctgggaaagctacagatccttttagtgcaagataaggttttatagccagattcagtggcagaccatgatttaagaaattatgtttggagcctgtgttctgtaaagagaaggttgatttggtttttagctatcgtattcggagtggaactataatacaattgtataatattcttgttgatcaattcaaagttactctgcactgtttttgactttttaaaaataccttagatgcaaatttataggagaaaaaacactttcagataagaggtgtttgctgggatggaagaactacctggcatgtaagaaatatcgtcagtcgtcctaatgcatattgtgactgtttgcatatacttctgtttataaaagtatcagttttacttttcagaggatttgtaagaatcatttaaattttcattgaaataaacgacaagtcacattgccactta

SEQ ID NO: 163813 - DNA, 835 bp, Homo sapiens
  Payload ID: 12256
  Gene Symbol: PARPBP
  Gene Name: PARP1 binding protein
  ENST ID: ENST00000392909
  CDS Start-End: 87-521
gactgcggcggccgcgggagggcatcccgttggggatccttccgcacactgaagagtacgtcttcgggtctacccctaatcacataatggctgtgtttaatcagaagtctgtctcggatatgattaaagagtttcgaaaaaattggcgtgctctttgtaactctgagagaactactctatgtggtgcagactccatgctcttggcattgcagctttctatggcggagaacaacaaacagcacagtggagaatttacagtctctctcagtgatgttttattgacatggaaatacttgctccatgagaaattgaacttaccagttgaaaacatggacgtgactgaccattatgaggacgttaggaagatttatgatgatttcttgaagaacagtaatatgttagatctgattgatgtttatcaaaaatgtagggctttgacttctaattgtgaaaattataacacagtatctcctggaaatttccagtgcggggaaaaagtagacaggaaaatatatccctagattgatttctcaaaaatgcactaagtataatcccaatttttgctgaaagtctctttcaaggggtcaactatacagccaccttcagaaagaggaagcttgctgctgtctaggccagatctcttggctcctggggaagatccaccagtgtcagcctcattgactctggagcggcagaagggagagtccctcttagcatggagctggtccctaaacttcagattgcctgggattcccatcacggtccagaagaagagacgagacctgaagaagctggcagctgtcatgcggcaagtgagacaatgggaaagccaccc

SEQ ID NO: 163814 - DNA, 1916 bp, Homo sapiens
  Payload ID: 12256
  Gene Symbol: PARPBP
  Gene Name: PARP1 binding protein
  Uniprot ID: Q9NWS1
  ENST ID: ENST00000392911
  CDS Start-End: 282-1778
gcacactgaagagtacgtcttcgggtctacccctaatcacataatggctgtgtttaatcagaagtctgtctcggatatgattaaagagtttcgaaaaaattggcgtgctctttgtaactctgagagaactactctatgtggtgcagactccatgctcttggcattgcagctttctatggcggagaacaacaaacagtggagaatttacagtctctctcagtgatgttttattgacatggaaatacttgctccatgagaaattgaacttaccagttgaaaacatggacgtgactgaccattatgaggacgttaggaagatttatgatgatttcttgaagaacagtaatatgttagatctgattgatgtttatcaaaaatgtagggctttgacttctaattgtgaaaattataacacagtatctcctagtcaactactggattttctgtctggcaaacagtatgcagtaggtgatgaaactgatctttctataccaacatcaccaacaagtaaatacaaccgtgataatgaaaaggtgcagctgctagcaaggaaaattatcttttcatatttaaatctgctagtgaattcaaagaatgacctggctgtggcttatattctcaatattcctgatagaggactaggaagagaagccttcactgatttgaaacatgctgctcgagagaaacaaatgtctatctttttggtggccacgtcttttattagaacaatagagcttggagggaaaggatatgcaccaccaccatcagatcctttaaggacacatgtaaagggattgtctaattttattaatttcattgacaaattagatgagattcttggagaaataccaaacccaagcattgcagggggtcaaatactgtcagtgataaagatgcaactgattaaaggccaaaacagcagggatcctttttgcaaagcaatagaggaagttgctcaggatttggatttgaggattaaaaatattatcaattctcaagaaggtgttgtagctcttagcaccactgacatcagtcctgctcggccaaaatctcatgccataaaccatggtactgcatactgtggcagagatactgtgaaagccttattagttcttttggacgaagaagcagctaatgctcctaccaaaaacaaagcagagcttttatatgatgaggaaaacacaatccatcatcatggaacgtctattcttacactttttaggtctcccacacaggtgaataattcgataaaacccctaagagaacgcatctgtgtgtcaatgcaagagaaaaaaattaagatgaagcaaactttaattagatcccaatttgcttgtacttataaagatgactacatgataagcaaggataattggaataatgttaatttagcatcaaagcctttgtgtgttctttacatggaaaatgacctttctgagggtgtaaatccatctgttggaagatcaacaattggaacgagttttggaaatgttcatctggacagaagtaaaaatgaaaaagtatcaagaaaatcaaccagtcagacaggaaataaaagctcaaaaaggaaacaggtggatttggatggtgaaaatattctctgtgataatagaaatgaaccacctcaacataaaaatgctaaaatacctaagaaatcaaatgattcacagaatagattgtacggcaaactagctaaagtagcaaaaagtaataaatgtactgccaaggacaagttgatttctggccaggcaaagttaactcagttttttagactataaatttgtgtcttatatgctttaggtttatgtatctataaaccattcaccaaagacatgcttaatttttaagagatcaaggtgtaaattatgatgatttattattttggtctacagtgtatgtaaggttagtatgttaag

SEQ ID NO: 163815 - DNA, 2133 bp, Homo sapiens
  Payload ID: 12256
  Gene Symbol: PARPBP
  Gene Name: PARP1 binding protein
  ENST ID: ENST00000412715
  CDS Start-End: 1-795
gcagactccatgctcttggcattgcagctttctatggcggagaacaacaaacagcacagtggagaatttacagtctctctcagtgatgttttattgacatggaaatacttgctccatgagaaattgaacttaccagttgaaaacatggacgtgactgaccattatgaggacgttaggaagatttatgatgatttcttgaagaacagtaatatgttagatctgattgatgtttatcaaaaatgtagggctttgacttctaattgtgaaaattataacacagtatctcctagtcaactactggattttctgtctggcaaacagtatgcagtaggtgatgaaactgatctttctataccaacatcaccaacaagtaaatacaaccgtgataatgaaaaggtgcagctgctagcaaggaaaattatcttttcatatttaaatctgctagtgaattcaaagaatgacctggctgtggcttatattctcaatattcctgatagaggactaggaagagaagccttcactgatttgaaacatgctgctcgagagaaacaaatgtctatctttttggtggccacgtcttttattagaacaatagagcttggagggaaaggatatgcaccaccaccatcagatcctttaaggacacatgtaaagggattgtctaattttattaatttcattgacaaattagatgagattcttggagaaataccaaacccaagagggtgtaaatccatctgttggaagatcaacaattggaacgagttttggaaatgttcatctggacagaagtaaaaatgaaaaagtatcaagaaaatcaaccagtcagacaggaaataaaagctcaaaaaggaaacaggtggatttggatggtgaaaatattctctgtgataatagaaatgaaccacctcaacataaaaatgctaaaatacctaagaaatcaaatgattcacagaatagattgtacggcaaactagctaaagtagcaaaaagtaataaatgtactgccaaggacaagttgatttctggccaggcaaagttaactcagttttttagactataaatttgtgtcttatatgctttaggtttatgtatctataaaccattcaccaaagacatgcttaatttttaagagatcaaggtgtaaattatgatgatttattattttggtctacagtgtatgtaaggttagtatgttaagcattgtttaaaaatactagtaagtcataattatgcagaattttcacaaagtttaatgcacagagaaagcatatcatttcagttactgatacatcttaacactactttcttttaaaacagacatttaacatacacaagttatagtagcagtatgggcttctcctcccattggcaattaaatgcttttattttcttctgaaaagatgatgtggaccaacaggtatcagacttgccaacaaggtcggtagactcttcccagcatacatctgagcactgaaggaagaagaaagtttaaattgtttaaaggactataattatcacacaaaatttattaagaaaaaaagaatggatctagtataactaattctgagtaaaccaaaatgataataattaattgttgctatttaatcccacatttttggcaggtgtaattgagccatggtcttatttgattttgttatgattgcatccaaattcactttaactcagagttctgtttaatggtggtaggatgtaagaattgaattttgaaaagactactcactgtcaaaatctctccttcctataggaaatttagctgagttttcttcatccccaatttctctcttttcttgtgttgattcagtattctgaactccattctcagctgggaaagctacagatccttttagtgcaagataaggttttatagccagattcagtggcagaccatgatttaagaaattatgtttggagcctgtgttctgtaaagagaaggttgatttggtttttagctatcgtattcggagtggaactataatacaattgtataatattcttgttgatcaattcaaagttactctgcactgtttttgactttttaaaaataccttagatgcaaatttataggagaaaaaacactttcagataagaggtgtttgctgggatggaaga

SEQ ID NO: 163816 - DNA, 2319 bp, Homo sapiens
  Payload ID: 12256
  Gene Symbol: PARPBP
  Gene Name: PARP1 binding protein
  ENST ID: ENST00000457614
  CDS Start-End: 1-195
gcagactccatgctcttggcattgcagctttctatggcggagaacaacaaacagagtcaactactggattttctgtctggcaaacagtatgcagtaggtgatgaaactgatctttctataccaacatcaccaacaagtaaatacaaccgtgataatgaaaaggtactgataaactgtggccacgtcttttattagaacaatagagcttggagggaaaggatatgcaccaccaccatcagatcctttaaggacacatgtaaagggattgtctaattttattaatttcattgacaaattagatgagattcttggagaaataccaaacccaagcattgcagggggtcaaatactgtcagtgataaagatgcaactgattaaaggccaaaacagcagggatcctttttgcaaagcaatagaggaagttgctcaggatttggatttgaggattaaaaatattatcaattctcaagaaggtgttgtagctcttagcaccactgacatcagtcctgctcggccaaaatctcatgccataaaccatggtactgcatactgtggcagagatactgtgaaagccttattagttcttttggacgaagaagcagctaatgctcctaccaaaaacaaagcagagcttttatatgatgaggaaaacacaatccatcatcatggaacgtctattcttacactttttaggtctcccacacaggtgaataattcgataaaacccctaagagaacgcatctgtgtgtcaatgcaagagaaaaaaattaagatgaagcaaactttaattagatcccaatttgcttgtacttataaagatgactacatgataagcaaggataattggaataatgttaatttagcatcaaagcctttgtgtgttctttacatggaaaatgacctttctgagggtgtaaatccatctgttggaagatcaacaattggaacgagttttggaaatgttcatctggacagaagtaaaaatgaaaaagtatcaagaaaatcaaccagtcagacaggaaataaaagctcaaaaaggaaacaggtggatttggatggtgaaaatattctctgtgataatagaaatgaaccacctcaacataaaaatgctaaaatacctaagaaatcaaatgattcacagaatagattgtacggcaaactagctaaagtagcaaaaagtaataaatgtactgccaaggacaagttgatttctggccaggcaaagttaactcagttttttagactataaatttgtgtcttatatgctttaggtttatgtatctataaaccattcaccaaagacatgcttaatttttaagagatcaaggtgtaaattatgatgatttattattttggtctacagtgtatgtaaggttagtatgttaagcattgtttaaaaatactagtaagtcataattatgcagaattttcacaaagtttaatgcacagagaaagcatatcatttcagttactgatacatcttaacactactttcttttaaaacagacatttaacatacacaagttatagtagcagtatgggcttctcctcccattggcaattaaatgcttttattttcttctgaaaagatgatgtggaccaacaggtatcagacttgccaacaaggtcggtagactcttcccagcatacatctgagcactgaaggaagaagaaagtttaaattgtttaaaggactataattatcacacaaaatttattaagaaaaaaagaatggatctagtataactaattctgagtaaaccaaaatgataataattaattgttgctatttaatcccacatttttggcaggtgtaattgagccatggtcttatttgattttgttatgattgcatccaaattcactttaactcagagttctgtttaatggtggtaggatgtaagaattgaattttgaaaagactactcactgtcaaaatctctccttcctataggaaatttagctgagttttcttcatccccaatttctctcttttcttgtgttgattcagtattctgaactccattctcagctgggaaagctacagatccttttagtgcaagataaggttttatagccagattcagtggcagaccatgatttaagaaattatgtttggagcctgtgttctgtaaagagaaggttgatttggtttttagctatcgtattcggagtggaactataatacaattgtataatattcttgttgatcaattcaaagttactctgcactgtttttgactttttaaaaataccttagatgcaaatttataggagaaaaaacactttcagataagaggtgtttgctgggatggaaga

SEQ ID NO: 163817 - DNA, 2212 bp, Homo sapiens
  Payload ID: 12256
  Gene Symbol: PARPBP
  Gene Name: PARP1 binding protein
  ENST ID: ENST00000417507
  CDS Start-End: 1-810
gcagactccatgctcttggcattgcagctttctatggcggagaacaacaaacagcacagtggagaatttacagtctctctcagtgatgttttattgacatggaaatacttgctccatgagaaattgaacttaccagttgaaaacatggacgtgactgaccattatgaggacgttaggaagatttatgatgatttcttgaagaacagtaatatgttagatctgattgatgtttatcaaaaatgtagggctttgacttctaattgtgaaaattataacacagtatctcctagtcaactactggattttctgtctggcaaacagtatgcagtaggtgatgaaactgatctttctataccaacatcaccaacaagtaaatacaaccgtgataatgaaaaggtgcagctgctagcaaggaaaattatcttttcatatttaaatctgctagtgaattcaaagaatgacctggctgtggcttatattctcaatattcctgatagaggactaggaagagaagccttcactgatttgaaacatgctgctcgagagaaacaaatgtctatctttttggtggccacgtcttttattagaacaatagagcttggagggaaaggatatgcaccaccaccatcagatcctttaaggacacatgtaaagggattgtctaattttattaatttcattgacaaattagatgagattcttggagaaataccaaacccaaggtctcccacacaggtgaataattcgataaaacccctaagagaacgcatctgtgtgtcaatgcaagagaaaaaaattaagagggtgtaaatccatctgttggaagatcaacaattggaacgagttttggaaatgttcatctggacagaagtaaaaatgaaaaagtatcaagaaaatcaaccagtcagacaggaaataaaagctcaaaaaggaaacaggtggatttggatggtgaaaatattctctgtgataatagaaatgaaccacctcaacataaaaatgctaaaatacctaagaaatcaaatgattcacagaatagattgtacggcaaactagctaaagtagcaaaaagtaataaatgtactgccaaggacaagttgatttctggccaggcaaagttaactcagttttttagactataaatttgtgtcttatatgctttaggtttatgtatctataaaccattcaccaaagacatgcttaatttttaagagatcaaggtgtaaattatgatgatttattattttggtctacagtgtatgtaaggttagtatgttaagcattgtttaaaaatactagtaagtcataattatgcagaattttcacaaagtttaatgcacagagaaagcatatcatttcagttactgatacatcttaacactactttcttttaaaacagacatttaacatacacaagttatagtagcagtatgggcttctcctcccattggcaattaaatgcttttattttcttctgaaaagatgatgtggaccaacaggtatcagacttgccaacaaggtcggtagactcttcccagcatacatctgagcactgaaggaagaagaaagtttaaattgtttaaaggactataattatcacacaaaatttattaagaaaaaaagaatggatctagtataactaattctgagtaaaccaaaatgataataattaattgttgctatttaatcccacatttttggcaggtgtaattgagccatggtcttatttgattttgttatgattgcatccaaattcactttaactcagagttctgtttaatggtggtaggatgtaagaattgaattttgaaaagactactcactgtcaaaatctctccttcctataggaaatttagctgagttttcttcatccccaatttctctcttttcttgtgttgattcagtattctgaactccattctcagctgggaaagctacagatccttttagtgcaagataaggttttatagccagattcagtggcagaccatgatttaagaaattatgtttggagcctgtgttctgtaaagagaaggttgatttggtttttagctatcgtattcggagtggaactataatacaattgtataatattcttgttgatcaattcaaagttactctgcactgtttttgactttttaaaaataccttagatgcaaatttataggagaaaaaacactttcagataagaggtgtttgctgggatggaaga

SEQ ID NO: 163818 - DNA, 2452 bp, Homo sapiens
  Payload ID: 12256
  Gene Symbol: PARPBP
  Gene Name: PARP1 binding protein
  ENST ID: ENST00000541394
  CDS Start-End: 106-2076
attcagcggcgacagcggcgactgcggcggccgcgggagggcatcccgttggggatccttccgcacactgaagagtacgtcttcgggtctacccctaatcacataatggctgtgtttaatcagaagtctgtctcggatatgattaaagagtttcgaaaaaattggcgtgctctttgtaactctgagagaactactctatgtggtgcagactccatgctcttggcattgcagctttctatggcggagaacaacaaacagcacagtggagaatttacagtctctctcagtgatgttttattgacatggaaatacttgctccatgagaaattgaacttaccagttgaaaacatggacgtgactgaccattatgaggacgttaggaagatttatgatgatttcttgaagaacagtaatatgttagatctgattgatgtttatcaaaaatgtagggctttgacttctaattgtgaaaattataacacagtatctcctgggtcaactatacagccaccttcagaaagaggaagcttgctgctgtctaggccagatctcttggctcctggggaagatccaccagtgtcagcctcattgactctggagcggcagaagggagagtccctcttagcatggagctggtccctaaacttcagattgcctgggattcccatcacggtccagaagaagagacgagacctgaagaagctggcagctgtcatgcggcaaagtcaactactggattttctgtctggcaaacagtatgcagtaggtgatgaaactgatctttctataccaacatcaccaacaagtaaatacaaccgtgataatgaaaaggtgcagctgctagcaaggaaaattatcttttcatatttaaatctgctagtgaattcaaagaatgacctggctgtggcttatattctcaatattcctgatagaggactaggaagagaagccttcactgatttgaaacatgctgctcgagagaaacaaatgtctatctttttggtggccacgtcttttattagaacaatagagcttggagggaaaggatatgcaccaccaccatcagatcctttaaggacacatgtaaagggattgtctaattttattaatttcattgacaaattagatgagattcttggagaaataccaaacccaagcattgcagggggtcaaatactgtcagtgataaagatgcaactgattaaaggccaaaacagcagggatcctttttgcaaagcaatagaggaagttgctcaggatttggatttgaggattaaaaatattatcaattctcaagaaggtgttgtagctcttagcaccactgacatcagtcctgctcggccaaaatctcatgccataaaccatggtactgcatactgtggcagagatactgtgaaagccttattagttcttttggacgaagaagcagctaatgctcctaccaaaaacaaagcagagcttttatatgatgaggaaaacacaatccatcatcatggaacgtctattcttacactttttaggtctcccacacaggtgaataattcgataaaacccctaagagaacgcatctgtgtgtcaatgcaagagaaaaaaattaagatgaagcaaactttaattagatcccaatttgcttgtacttataaagatgactacatgataagcaaggataattggaataatgttaatttagcatcaaagcctttgtgtgttctttacatggaaaatgacctttctgagggtgtaaatccatctgttggaagatcaacaattggaacgagttttggaaatgttcatctggacagaagtaaaaatgaaaaagtatcaagaaaatcaaccagtcagacaggaaataaaagctcaaaaaggaaacaggtggatttggatggtgaaaatattctctgtgataatagaaatgaaccacctcaacataaaaatgctaaaatacctaagaaatcaaatgattcacagaatagattgtacggcaaactagctaaagtagcaaaaagtaataaatgtactgccaaggacaagttgatttctggccaggcaaagttaactcagttttttagactataaatttgtgtcttatatgctttaggtttatgtatctataaaccattcaccaaagacatgcttaatttttaagagatcaaggtgtaaattatgatgatttattattttggtctacagtgtatgtaaggttagtatgttaagcattgtttaaaaatactagtaagtcataattatgcagaattttcacaaagtttaatgcacagagaaagcatatcatttcagttactgatacatcttaacactactttcttttaaaacagacatttaacatacacaagttatagtagcagtatgggcttctcctcccattggcaattaaatgcttttattttcttctgaaaagatgatgtggaccaacaggtatcagacttgccaacaa

SEQ ID NO: 163819 - DNA, 976 bp, Homo sapiens
  Payload ID: 12256
  Gene Symbol: PARPBP
  Gene Name: PARP1 binding protein
  Uniprot ID: Q9NWS1
  ENST ID: ENST00000537257
  CDS Start-End: 46-447
ccgcacactgaagagtacgtcttcgggtctacccctaatcacataatggctgtgtttaatcagaagtctgtctcggatatgattaaagagtttcgaaaaaattggcgtgctctttgtaactctgagagaactactctatgtggtgcagactccatgctcttggcattgcagctttctatggcggagaacaacaaacagcacagtggagaatttacagtctctctcagtgatgttttattgacatggaaatacttgctccatgagaaattgaacttaccagttgaaaacatggacgtgactgaccattatgaggacgttaggaagatttatgatgatttcttgaagaacagtaatatgttagatctgattgatgtttatcaaaaatgtagggctttgacttctaattgtgaaaattataacacagtatctcctgtaagtattttttaaacaattctattttaatcaaattaaaatttagctctatttattttgaattatagtatcaccagttatagtaacttggtaatgtttttgctttgtgaatcatgttaaaaatgggaaaatttagctacctgaaagctacttattacttgaaagaaagattttgtggtaaattttcttggacttgtgttattgttatttagttgctatacggatagcttcttattagatcaaaaatccctaacaaagaaattagtcccaaatgcctgatttctttttgaatcatgtcaaagattgcttttgtattcactttcttgatttaatgtgcatctgttcatttggcatatgttggataaatgattggtgtgactttttctatggattaataatgttattttactacatataggtatcatttattttatgaaaatagtattatgcaatatacatgagataatagactattctttttttgcacaagcatttttttaatggagtataaatgtaaaaattaaatggagtagtatcccttgca

SEQ ID NO: 163820 - DNA, 992 bp, Homo sapiens
  Payload ID: 12256
  Gene Symbol: PARPBP
  Gene Name: PARP1 binding protein
  ENST ID: ENST00000543784
  CDS Start-End: 96-647
gacagcggcgactgcggcggccgcgggagggcatcccgttggggatccttccgcacactgaagagtacgtcttcgggtctacccctaatcacataatggctgtgtttaatcagaagtctgtctcggatatgattaaagagtttcgaaaaaattggcgtgctctttgtaactctgagagaactactctatgtggtgcagactccatgctcttggcattgcagctttctatggcggagaacaacaaacaggtgcagctgctagcaaggaaaattatcttttcatatttaaatctgctagtgaattcaaagaatgacctggctgtggcttatattctcaatattcctgatagaggactaggaagagaagccttcactgatttgaaacatgctgctcgagagaaacaaatgtctatctttttggtggccacgtcttttattagaacaatagagcttggagggaaaggatatgcaccaccaccatcagatcctttaaggacacatgtaaagggattgtctaattttattaatttcattgacaaattagatgagattcttggagaaataccaaacccaagagggtgtaaatccatctgttggaagatcaacaattggaacgagttttggaaatgttcatctggacagaagtaaaaatgaaaaagtatcaagaaaatcaaccagtcagacaggaaataaaagctcaaaaaggaaacaggtggatttggatggtgaaaatattctctgtgataatagaaatgaaccacctcaacataaaaatgctaaaatacctaagaaatcaaatgattcacagaatagattgtacggcaaactagctaaagtagcaaaaagtaataaatgtactgccaaggacaagttgatttctggccaggcaaagttaactcagttttttagactataaatttgtgtcttatatgctttaggtttatgtatctataaaccattcaccaaagacatgcttaatttttaagagatcaa

SEQ ID NO: 163821 - DNA, 4003 bp, Homo sapiens
  Payload ID: 12257
  Gene Symbol: PALB2
  Gene Name: partner and localizer of BRCA2
  Uniprot ID: Q86YC2
  ENST ID: ENST00000261584
  CDS Start-End: 154-3714
gcccgcgtgggtcagctgatcgcgcactgagggtgcgatcccgggctccccattccttcctggggcgcctccccggcccagggccaactgggtcccggtgtcggcaggcctggggtcggcgacggctgctcttttcgttctgtcgcctgcccgatggacgagcctcccgggaagcccctcagctgtgaggagaaggaaaagttaaaggagaaattagcattcttgaaaagggaatacagcaagacactagcccgccttcagcgtgcccaaagagctgaaaagattaagcattctattaagaaaacagtagaagaacaagattgtttgtctcagcaggatctctcaccgcagctaaaacactcagaacctaaaaataaaatatgtgtttatgacaagttacacatcaaaacccatcttgatgaagaaactggagaaaagacatctatcacacttgatgttgggcctgagtcctttaaccctggagatggcccaggaggattacctatacaaagaacagatgacacccaagaacattttccccacagggtcagtgaccctagtggtgagcaaaagcagaagctgccaagcagaagaaagaagcagcagaagaggacatttatttcacaggagagagactgtgtctttggcactgattcactcagattgtctgggaaaagactaaaggaacaggaagaaatcagtagcaaaaatcctgctagatcaccagtaactgaaataagaactcaccttttaagtcttaaatctgaacttccagattctccagaaccagttacagaaattaatgaagacagtgtattaattccaccaactgcccaaccagaaaaaggtgttgatacattcctaagaagacctaatttcaccagggcgactacagttcctttacagactctatcagatagcggtagtagtcagcaccttgaacacattcctcctaaaggtagcagtgaacttactactcacgacctaaaaaacattagatttacttcacctgtaagtttggaggcacaaggcaaaaaaatgactgtctctacagataacctccttgtaaataaagctataagtaaaagtggccaactgcccacaagttctaatttagaggcaaatatttcatgttctctaaatgaactcacctacaataacttaccagcaaatgaaaaccaaaacttaaaagaacaaaatcaaacagagaaatctttaaaatctcccagtgacactcttgatggcaggaatgaaaatcttcaggaaagtgagattctaagtcaacctaagagtcttagcctggaagcaacctctcctctttctgcagaaaaacattcttgcacagtgcctgaaggccttctgtttcctgcagaatattatgttagaacaacacgaagcatgtccaattgccagaggaaagtagccgtggaggctgtcattcagagtcatttggatgtcaagaaaaaagggtttaaaaataaaaataaggatgcaagtaaaaatttaaacctttccaatgaggaaactgaccaaagtgaaattaggatgtctggcacatgcacaggacaaccaagttcaagaacctctcagaaacttctctcattaactaaagtcagctctcccgctgggcccactgaagataatgacttgtctaggaaggcagttgcccaagcacctggtagaagatacacaggaaaaagaaaatcagcctgcaccccagcatcagatcattgtgaaccacttttgccaacttctagcctgtcgattgttaacaggtccaaggaagaagtcacctcacacaaatatcagcacgaaaaattatttattcaagtgaaagggaagaaaagtcgtcatcaaaaagaggattccctttcttggagtaatagtgcttatttatccttggatgatgatgctttcacggctccatttcatagggatggaatgctgagtttaaagcaactactgtcttttctcagtatcacagactttcagttacctgatgaagactttggacctcttaagcttgaaaaagtgaagtcctgctcagaaaaaccagtggagccctttgagtcaaaaatgtttggagagagacatcttaaagagggaagctgtatttttccagaggaactgagtcctaaacgcatggatacagaaatggaggacttagaagaggaccttattgttctaccaggaaaatcacatcccaaaaggccaaactcgcaaagccagcatacaaagacgggcctttcttcatccatattactttatactcctttaaatacggttgcgcctgatgataatgacaggcctaccacagacatgtgttcacctgctttccccatcttaggtactactccagcctttggccctcaaggctcctatgaaaaagcatctacagaagttgctggacgaacttgctgcacaccccaacttgctcatttgaaagactcagtctgtcttgccagtgatactaaacaattcgacagttcaggcagcccagcaaaaccacataccaccctgcaagtgtcaggcaggcaaggacaacctacctgtgactgtgactctgtcccgccaggaacacctccacccattgagtcattcacttttaaagaaaatcagctctgtagaaacacatgccaggagctgcataaacattccgtcgaacagactgaaacagcagagcttcctgcttctgatagcataaacccaggcaacctacaattggtttcagagttaaagaatccttcaggttcctgttccgtagatgtgagtgccatgttttgggaaagagccggttgtaaagagccatgtatcataactgcttgcgaagatgtagtttctctttggaaagctctggatgcttggcagtgggaaaaactttatacctggcacttcgcagaggttccagtattacagatagttccagtgcctgatgtgtataatctcgtgtgtgtagctttgggaaatttggaaatcagagagatcagggcattgttttgttcctctgatgatgaaagtgaaaagcaagtactactgaagtctggaaatataaaagctgtgcttggcctgacaaagaggaggctagttagtagcagtgggaccctttctgatcaacaagtagaagtcatgacgtttgcagaagatggaggaggcaaagaaaaccaatttttgatgccccctgaggagactatactaacttttgctgaggtccaagggatgcaagaagctctgcttggtactactattatgaacaacattgttatttggaatttaaaaactggtcaactcctgaaaaagatgcacattgatgattcttaccaagcttcagtctgtcacaaagcctattctgaaatggggcttctctttattgtcctgagtcatccctgtgccaaagagagtgagtcgttgcgaagccctgtgtttcagctcattgtgattaaccctaagacgactctcagcgtgggtgtgatgctgtactgtcttcctccagggcaggctggcaggttcctggaaggtgacgtgaaagatcactgtgcagcagcaatcttgacttctggaacaattgccatttgggacttacttctcggtcagtgtactgccctcctcccacctgtctctgaccaacattggtcttttgtgaaatggtcgggtacagactctcatttgctggctggacaaaaagatggaaatatatttgtataccactattcataagttagggtaaagtgaaaacacaattttctggatatattgggcctcttagtattttttggagttttaaatataaaggagaatatctgaatgacacttaaaatgattgcttgtttatgtccagacagacttattttttattctaatgatggtagcaccactgatcttggatgtacatttatgtatactttgagaaaaagggttttaggttgatttttgtaatttcccacatttgtacatgtgcttttaaaggtgtacataaagcttcaaatggcaataaatatttattttt

SEQ ID NO: 163822 - DNA, 3963 bp, Homo sapiens
  Payload ID: 12257
  Gene Symbol: PALB2
  Gene Name: partner and localizer of BRCA2
  ENST ID: ENST00000568219
  CDS Start-End: 997-3672
actgagggtgcgatcccgggctccccattccttcctggggcgcctccccggcccagggccaactgggtcccggtgtcggcaggcctggggtcggcgacggctgctcttttcgttctgtcgcctgcccgatggacgagcctcccgggaagcccctcagctttaaaggagaaattagcattcttgaaaagggaatacagcaagacactagcccgccttcagcgtgcccaaagagctgaaaagattaagcattctattaagaaaacagtagaagaacaagattgtttgtctcagcaggatctctcaccgcagctaaaacactcagaacctaaaaataaaatatgtgtttatgacaagttacacatcaaaacccatcttgatgaagaaactggagaaaagacatctatcacacttgatgttgggcctgagtcctttaaccctggagatggcccaggaggattacctatacaaagaacagatgacacccaagaacattttccccacagggtcagtgaccctagtggtgagcaaaagcagaagctgccaagcagaagaaagaagcagcagaagaggacatttatttcacaggagagagactgtgtctttggcactgattcactcagattgtctgggaaaagactaaaggaacaggaagaaatcagtagcaaaaatcctgctagatcaccagtaactgaaataagaactcaccttttaagtcttaaatctgaacttccagattctccagaaccagttacagaaattaatgaagacagtgtattaattccaccaactgcccaaccagaaaaaggtgttgatacattcctaagaagacctaatttcaccagggcgactacagttcctttacagactctatcagatagcggtagtagtcagcaccttgaacacattcctcctaaaggtagcagtgaacttactactcacgacctaaaaaacattagatttacttcacctgtaagtttggaggcacaaggcaaaaaaatgactgtctctacagataacctccttgtaaataaagctataagtaaaagtggccaactgcccacaagttctaatttagaggcaaatatttcatgttctctaaatgaactcacctacaataacttaccagcaaatgaaaaccaaaacttaaaagaacaaaatcaaacagagaaatctttaaaatctcccagtgacactcttgatggcaggaatgaaaatcttcaggaaagtgagattctaagtcaacctaagagtcttagcctggaagcaacctctcctctttctgcagaaaaacattcttgcacagtgcctgaaggccttctgtttcctgcagaatattatgttagaacaacacgaagcatgtccaattgccagaggaaagtagccgtggaggctgtcattcagagtcatttggatgtcaagaaaaaagggtttaaaaataaaaataaggatgcaagtaaaaatttaaacctttccaatgaggaaactgaccaaagtgaaattaggatgtctggcacatgcacaggacaaccaagttcaagaacctctcagaaacttctctcattaactaaagtcagctctcccgctgggcccactgaagataatgacttgtctaggaaggcagttgcccaagcacctggtagaagatacacaggaaaaagaaaatcagcctgcaccccagcatcagatcattgtgaaccacttttgccaacttctagcctgtcgattgttaacaggtccaaggaagaagtcacctcacacaaatatcagcacgaaaaattatttattcaagtgaaagggaagaaaagtcgtcatcaaaaagaggattccctttcttggagtaatagtgcttatttatccttggatgatgatgctttcacggctccatttcatagggatggaatgctgagtttaaagcaactactgtcttttctcagtatcacagactttcagttacctgatgaagactttggacctcttaagcttgaaaaagtgaagtcctgctcagaaaaaccagtggagccctttgagtcaaaaatgtttggagagagacatcttaaagagggaagctgtatttttccagaggaactgagtcctaaacgcatggatacagaaatggaggacttagaagaggaccttattgttctaccaggaaaatcacatcccaaaaggccaaactcgcaaagccagcatacaaagacgggcctttcttcatccatattactttatactcctttaaatacggttgcgcctgatgataatgacaggcctaccacagacatgtgttcacctgctttccccatcttaggtactactccagcctttggccctcaaggctcctatgaaaaagcatctacagaagttgctggacgaacttgctgcacaccccaacttgctcatttgaaagactcagtctgtcttgccagtgatactaaacaattcgacagttcaggcagcccagcaaaaccacataccaccctgcaagtgtcaggcaggcaaggacaacctacctgtgactgtgactctgtcccgccaggaacacctccacccattgagtcattcacttttaaagaaaatcagctctgtagaaacacatgccaggagctgcataaacattccgtcgaacagactgaaacagcagagcttcctgcttctgatagcataaacccaggcaacctacaattggtttcagagttaaagaatccttcaggttcctgttccgtagatgtgagtgccatgttttgggaaagagccggttgtaaagagccatgtatcataactgcttgcgaagatgtagtttctctttggaaagctctggatgcttggcagtgggaaaaactttatacctggcacttcgcagaggttccagtattacagatagttccagtgcctgatgtgtataatctcgtgtgtgtagctttgggaaatttggaaatcagagagatcagggcattgttttgttcctctgatgatgaaagtgaaaagcaagtactactgaagtctggaaatataaaagctgtgcttggcctgacaaagaggaggctagttagtagcagtgggaccctttctgatcaacaagtagaagtcatgacgtttgcagaagatggaggaggcaaagaaaaccaatttttgatgccccctgaggagactatactaacttttgctgaggtccaagggatgcaagaagctctgcttggtactactattatgaacaacattgttatttggaatttaaaaactggtcaactcctgaaaaagatgcacattgatgattcttaccaagcttcagtctgtcacaaagcctattctgaaatggggcttctctttattgtcctgagtcatccctgtgccaaagagagtgagtcgttgcgaagccctgtgtttcagctcattgtgattaaccctaagacgactctcagcgtgggtgtgatgctgtactgtcttcctccagggcaggctggcaggttcctggaaggtgacgtgaaagatcactgtgcagcagcaatcttgacttctggaacaattgccatttgggacttacttctcggtcagtgtactgccctcctcccacctgtctctgaccaacattggtcttttgtgaaatggtcgggtacagactctcatttgctggctggacaaaaagatggaaatatatttgtataccactattcataagttagggtaaagtgaaaacacaattttctggatatattgggcctcttagtattttttggagttttaaatataaaggagaatatctgaatgacacttaaaatgattgcttgtttatgtccagacagacttattttttattctaatgatggtagcaccactgatcttggatgtacatttatgtatactttgagaaaaagggttttaggttgatttttgtaatttcccacatttgtacatgtgcttttaaaggtgtacataaagcttcaaatggcaataaatatttatttttat

SEQ ID NO: 163823 - DNA, 626 bp, Homo sapiens
  Payload ID: 12257
  Gene Symbol: PALB2
  Gene Name: partner and localizer of BRCA2
  ENST ID: ENST00000566069
  CDS Start-End: 1-131
ctactattatgaacaacattgttatttggaatttaaaaactggtcaactcctgaaaaagatgcacattgatgattcttaccaagcttcagtctgtcacaaagcctattctgaaatggttcctggaaggtgacgtgaaagatcactgtgcagcagcaatcttgacttctggaacaattgccatttgggacttacttctcggtcagtgtactgccctcctcccacctgtctctgaccaacattggtcttttgtgaaatggtcgggtacagactctcatttgctggctggacaaaaagatggaaatatatttgtataccactattcataagttagggtaaagtgaaaacacaattttctggatatattgggcctcttagtattttttggagttttaaatataaaggagaatatctgaatgacacttaaaatgattgcttgtttatgtccagacagacttattttttattctaatgatggtagcaccactgatcttggatgtacatttatgtatactttgagaaaaagggttttaggttgatttttgtaatttcccacatttgtacatgtgcttttaaaggtgtacataaagcttcaaatggcaataaatatttatttttatacattctg

SEQ ID NO: 163824 - DNA, 344 bp, Homo sapiens
  Payload ID: 12257
  Gene Symbol: PALB2
  Gene Name: partner and localizer of BRCA2
  ENST ID: ENST00000565038
  CDS Start-End: 1-91
aaagattaagcattctattaagaaaacagtagaagaacaagattgtttgtctcagcaggatctctcaccgcagctaaaacactcagactgaaacagcagagcttcctgcttctgatagcataaacccaggcaacctacaattggtttcagagttaaagaatccttcaggttcctgttccgtagatgtgagtgccatgttttgggaaagagccggttgtaaagagccatgtatcataactgcttgcgaagatgtagtttctctttggaaagctctggatgcttggcagtgggaaaaactttatacctggcacttcgcagaggttccagtattacagatagttcca

SEQ ID NO: 163825 - DNA, 815 bp, Homo sapiens
  Payload ID: 12257
  Gene Symbol: PALB2
  Gene Name: partner and localizer of BRCA2
  ENST ID: ENST00000561514
  CDS Start-End: 547-815
acccttgctcctcccccctcccacaccctcaatctttacttctccccccggacggcctcaagtaaatcttttaagtctggtacttccaggtcctttcgtgtgttaatgtgggtggtggaggaggggcgtatccctaaccaccaaaaaggaatcctatgtatattttttggagaagggaatgttcataaatggtatgatctgaatggttctgcaggttccgtttagctttcctgtcaggacatgtttatctaccttgctttcttttttaagttctagacagtatgttgtagtttggaagtgccctcgttttgtttcttttttcttccttttctgtttttcttcttttttgagacagagtctcactctgccacccatgctggggtgcagtggcgcgatctcggctcactgcaacctccgcttcctgggatcaagcgactctcctgcctcagcctcccgagtagctgggattacacgaacccgccactgcacctggccttggaagtgcccttgcttctttagactgtactttactgatagacttttaggatgtttccagcttgtgctgatgttattcttatcctggcttaccttctggtggagttaaaggagaaattagcattcttgaaaagggaatacagcaagacactagcccgccttcagcgtgcccaaagagctgaaaagattaagcattctattaagaaaacagtagaagaacaagattgtttgtctcagcaggatctctcaccgcagctaaaacactcagaacctaaaaataaaatatgtgtttatgacaagttacacatcaaaacccatct

SEQ ID NO: 163826 - DNA, 2286 bp, Homo sapiens
  Payload ID: 12258
  Gene Symbol: PNO1
  Gene Name: partner of NOB1 homolog
  Uniprot ID: Q9NRX1
  ENST ID: ENST00000263657
  CDS Start-End: 92-850
gcggagctgcaggggtggttggctgaggctggcttctgcgtggtgcagctgcgcacgtgtttcagccggcagcgctttaagatttccggggatggaatccgaaatggaaacgcagagcgccagggcagaggagggctttacccaggtcacccgcaagggtggccgacgggcgaagaaacgacaggctgaacagctgtccgcagcaggagagggcggggatgcgggccgcatggacacagaggaggccaggccggcgaagaggcccgtcttcccacccctctgtggggacgggctcctgagtgggaaagaagaaacaaggaaaattccagtcccagctaacagatacacaccattgaaagaaaactggatgaagatatttactcctattgtggaacatttgggacttcagatacgctttaacttgaaatcaaggaatgtagaaatcaggacttgtaaagaaaccaaggatgttagtgctctgacaaaagcagctgattttgtgaaagcttttattctcggctttcaggtggaggatgcacttgccctcatcaggttggatgacctcttcctagagtcttttgaaattacagatgttaaacccctaaagggagaccatctatccagggcaataggaagaatcgctggcaaaggaggaaaaaccaaattcaccatagagaatgtgacacggacaaggatagttttggctgatgtgaaagttcacatccttggctccttccaaaatatcaagatggcaagaactgccatttgcaacctaatcttgggaaatcctccttccaaggtttatggcaatattcgagctgtggctagcagatcagcagatcgattctgatttcaagtcagagactttttatcttgcctttggactctggtgaaaaatactttacagtggtcggtcacaagaaaccagctgaacaatttcagtcatttgaagcctccgtcccttcttccattctcagccagaagcataaacagaaaagaaagatttaagaggattcacactcaacaggttttaggataatttaaatatcaaaaattgattgttatacttaacacattaggtataatttatcatttatctgaaatcacatgtagcagattgcatagtctgtaatcctctcagagggaaacttcttgtttaaacagctctatatggatttatacttttatatttataaatttataacttcatacaaatttataaacatttctttataaattgtaatttaatagattatctcagaaaaacctctctgaatgatgacccttccttaatactgggtgatgtgtgaatatttgtttgttggcagacagggtctcactttgtcacccaggctagagtgcagtggtgcaatctcagctcactgcagcctctgcctcctgagttcaagtgatcctcctgcttcagcctccctagtagctgggactacaggtatgcaccaccatgcctggctaattttttgtattttttgtagagatggggtttcgccatgttgaccaggctggtcttgaactcctggcctcaagggatccgtccgcctcagcctcccaaagtgctgggattacaggcataagccactgcgcctggccttgatgtgtgaatatttgagaggtcataagcagtggttttggccataccgtattataccatatacatcagtaagagctcatcttggaacctgttttgcagtttcttgcagtttcaaaaattaaagacctacatcacagggttaatgtgaagaaagctttatttttcaaatgagtatttaatgaaagtatacataaccaatgttgggtatacagatgcttctcaacttatgatgggtttaggtccagataagcccactgtgagttgaaaataccaaaagtcaaacatcatagcttagcctaccttaaaagggctccgaacactacattagcctacagttgggcaaaatcgtctaatacaaagcctattttataataaagtatgttgaatatctcatgtaatttttgaagattacattgaaagtgaaaaacagaatggttgggtacttgaaatacagcttctactgaatgaataattctaaagttgaaaaataatagtaagaaccatcataagtctgtttcttctagtaaaggtgaaatgatgaaagaatgcttttttcccacccaaaaaactatgctctataaatgcagattagctagtttctgcctgtttaaatggtattattttatacattacaaaatggaaggaacttactttattaaacttaactttgatacttc

SEQ ID NO: 163827 - DNA, 616 bp, Homo sapiens
  Payload ID: 12258
  Gene Symbol: PNO1
  Gene Name: partner of NOB1 homolog
  ENST ID: ENST00000430742
  CDS Start-End: 19-429
gctttaagatttccggggatggaatccgaaatggaaacgcagagcgccagggcagaggagggctttacccaggtcacccgcaagggtggccgacgggcgaagaaacgacaggctgaacagctgtccgcagcaggagagggcggggatgcgggccgcatggacacagaggaggccaggccggcgaagaggcccgtcttcccacccctctgtggggacgggctcctgagtgggaaagaagaaacaaggaaaattccagtcccagctaacagatacacaccattgaaagaaaactggatgaagatatttactcctattgtggaacatttgggacttcagatacgctttaacttgaaatcaaggaatgtagaaatcaggtgcatgcaggtagttaggcctggagctgttggtttaagaaacatcagcatataaatgataactaagaagattaagtcaggaatcccagggaagactgccttgagagagaagagaagaggacattgggcattgaagggatggacagaagacttgtaaagaaaccaaggatgttagtgctctgacaaaagcagctgattttgtgaaagcttttattctcggctttcaggtggaggatgcactt

SEQ ID NO: 163828 - DNA, 595 bp, Homo sapiens
  Payload ID: 12259
  Gene Symbol: PVALB
  Gene Name: parvalbumin
  Uniprot ID: P20472
  ENST ID: ENST00000216200
  CDS Start-End: 57-389
accagcccagcctttcagtgcaggctccagccctccacccccacccgagttgcaggatgtcgatgacagacttgctgaacgctgaggacatcaagaaggcggtgggagcctttagcgctaccgactccttcgaccacaaaaagttcttccaaatggtcggcctgaagaaaaagagtgcggatgatgtgaagaaggtgtttcacatgctggacaaggacaaaagtggcttcatcgaggaggatgagctgggattcatcctaaaaggcttctccccagatgccagagacctgtctgctaaagaaaccaagatgctgatggctgctggagacaaagatggggacggcaaaattggggttgacgaattctccactctggtggctgaaagctaagaagcactgactgcccctggtcttccacctctctgccctgaacacccaatctcggcccctctcgccaccctcctgcatttctgttcagttcgtttatgttattttttactcccccatcccctgtggccctctaatgacaccattcttctggaaaatgctggagaagcaataaaggttgtaccagtcagactctgcttgctcaggaa

SEQ ID NO: 163829 - DNA, 568 bp, Homo sapiens
  Payload ID: 12259
  Gene Symbol: PVALB
  Gene Name: parvalbumin
  ENST ID: ENST00000406910
  CDS Start-End: 1-320
cgatgacagacttgctgaacgctgaggacatcaagaaggcggtgggagcctttagcgctaccgactccttcgaccacaaaaagttcttccaaatggtcggcctgaagaaaaagagtgcggatgatgtgaagaaggtgtttcacatgctggacaaggacaaaagtggcttcatcgaggaggatgagctgggattcatcctaaaaggcttctccccagatgccagagacctgtctgctaaagaaaccaagatgctgatggctgctggagacaaagatggggacggcaaaattggggttgacgatccagcagatgttgactgagtagcaactctgtgcccggcaatggaagagaattctccactctggtggctgaaagctaagaagcactgactgcccctggtcttccacctctctgccctgaacacccaatctcggcccctctcgccaccctcctgcatttctgttcagttcgtttatgttattttttactcccccatcccctgtggccctctaatgacaccattcttctggaaaatgctggagaagcaataaaggttgtaccagtcaga

SEQ ID NO: 163830 - DNA, 422 bp, Homo sapiens
  Payload ID: 12259
  Gene Symbol: PVALB
  Gene Name: parvalbumin
  ENST ID: ENST00000404171
  CDS Start-End: 63-299
ccgggctccctcagccctccaatggagctaccgactccttcgaccacaaaaagttcttccaaatggtcggcctgaagaaaaagagtgcggatgatgtgaagaaggtgtttcacatgctggacaaggacaaaagtggcttcatcgaggaggatgagctgggattcatcctaaaaggcttctccccagatgccagagacctgtctgctaaagaaaccaagatgctgatggctgctggagacaaagatggggacggcaaaattggggttgacgaattctccactctggtggctgaaagctaagaagcactgactgcccctggtcttccacctctctgccctgaacacccaatctcggcccctctcgccaccctcctgcatttctgttcagttcgtttatgttattttttactcccccatcccctg

SEQ ID NO: 163831 - DNA, 569 bp, Homo sapiens
  Payload ID: 12259
  Gene Symbol: PVALB
  Gene Name: parvalbumin
  Uniprot ID: P20472
  ENST ID: ENST00000417718
  CDS Start-End: 31-363
acttgctctgcccgctcaaacagttgcaggatgtcgatgacagacttgctgaacgctgaggacatcaagaaggcggtgggagcctttagcgctaccgactccttcgaccacaaaaagttcttccaaatggtcggcctgaagaaaaagagtgcggatgatgtgaagaaggtgtttcacatgctggacaaggacaaaagtggcttcatcgaggaggatgagctgggattcatcctaaaaggcttctccccagatgccagagacctgtctgctaaagaaaccaagatgctgatggctgctggagacaaagatggggacggcaaaattggggttgacgaattctccactctggtggctgaaagctaagaagcactgactgcccctggtcttccacctctctgccctgaacacccaatctcggcccctctcgccaccctcctgcatttctgttcagttcgtttatgttattttttactcccccatcccctgtggccctctaatgacaccattcttctggaaaatgctggagaagcaataaaggttgtaccagtcagactctgcttgctcaggaa

SEQ ID NO: 163832 - DNA, 470 bp, Homo sapiens
  Payload ID: 12259
  Gene Symbol: PVALB
  Gene Name: parvalbumin
  ENST ID: ENST00000443735
  CDS Start-End: 167-470
aggctgaggtaggagtggagagagaaagggagcagggcctaggaggtcctgaggtgcaggctggccgctgaaggttcaggatcttcccccacgcggcaggacatccgccaaggttcccagatctgagacggcgcacctcctgcgtgtccttgacggcagttgcaggatgtcgatgacagacttgctgaacgctgaggacatcaagaaggcggtgggagcctttagcgctaccgactccttcgaccacaaaaagttcttccaaatggtcggcctgaagaaaaagagtgcggatgatgtgaagaaggtgtttcacatgctggacaaggacaaaagtggcttcatcgaggaggatgagctgggattcatcctaaaaggcttctccccagatgccagagacctgtctgctaaagaaaccaagatgctgatggctgctggagacaaagatggggacggcaaaattggggttgacg

SEQ ID NO: 163833 - DNA, 595 bp, Homo sapiens; identical to SEQ ID NO: 163828
  Payload ID: 12259
  Gene Symbol: PVALB
  Gene Name: parvalbumin
  Uniprot ID: P20472
  ENST ID: ENST00000620986
  CDS Start-End: 57-389

SEQ ID NO: 163834 - DNA, 422 bp, Homo sapiens; identical to SEQ ID NO: 163830
  Payload ID: 12259
  Gene Symbol: PVALB
  Gene Name: parvalbumin
  ENST ID: ENST00000630974
  CDS Start-End: 63-299

SEQ ID NO: 163835 - DNA, 569 bp, Homo sapiens; identical to SEQ ID NO: 163831
  Payload ID: 12259
  Gene Symbol: PVALB
  Gene Name: parvalbumin
  Uniprot ID: P20472
  ENST ID: ENST00000625893
  CDS Start-End: 31-363

SEQ ID NO: 163836 - DNA, 470 bp, Homo sapiens; identical to SEQ ID NO: 163832
  Payload ID: 12259
  Gene Symbol: PVALB
  Gene Name: parvalbumin
  ENST ID: ENST00000628345
  CDS Start-End: 167-470

SEQ ID NO: 163837 - DNA, 568 bp, Homo sapiens; identical to SEQ ID NO: 163829
  Payload ID: 12259
  Gene Symbol: PVALB
  Gene Name: parvalbumin
  ENST ID: ENST00000627445
  CDS Start-End: 1-320

SEQ ID NO: 163838 - DNA, 4458 bp, Homo sapiens
  Payload ID: 12260
  Gene Symbol: PARVA
  Gene Name: parvin, alpha
  ENST ID: ENST00000334956
  CDS Start-End: 344-1582
acaggcagtagtgctggggcagagcgagctcaccagccgccggctggaagaccccgggagagtagcagggttgggttggttctcagatgtgttttgcgccaggctgtgtggtggggacagagcctgggtaaatgaagctttccggctcgaccgctcccaacctgggcacacacgtcctcctgtcctgcaaggggcagttttggggcatcctccctgcttggggcaacccaggggcgcaaggcgcggccccgggagcgcagctccttccagggcagagggcggcgcgagggagggagcgagggagggagcgagggaagggaaaggcgagcgtgagctgcctcaaatgcttggaataattccgcttccgtttggaaagccgcagcctcagtcccgccgccgcccgctgcgtccgcccagcgccagctccgcgtcccgaccggcccgcggcagcctgcgccgcgccatggccacctccccgcagaagtcgccttctgtccccaagtctcccactcccaagtcgcccccgtcccgcaagaaagatgattccttcttggggaaactcggagggaccctggcccggaggaagaaagccaaggaggtgtccgagctgcaggaggagggaatgaacgccatcaacctgcccctcagcccaattccctttgagctggaccccgaggacacgatgctggaggagaatgaggtgcgaacaatggtggatccaaactcacgcagtgaccccaagcttcaagaactgatgaaggtattaattgactggattaatgatgtgttggttggagaaagaatcattgtgaaagacctagctgaagatttgtatgatggacaagtcctgcagaagcttttcgagaaactggagagtgagaagctaaatgtggctgaggtcacccagtcagagattgctcagaagcaaaaactgcagactgtcctggagaagatcaatgaaaccctgaaacttcctcccaggagcatcaagtggaatgtggattctgttcatgccaagagcctggtggccatcttacacctgctcgttgctctgtctcagtatttccgcgcaccaattcgactcccagaccatgtttccatccaagtggttgtggtccagaaacgagaaggaatcctccagtctcggcaaatccaagaggaaataactggtaacacagaggctctttccgggaggcatgaacgtgatgcctttgacaccttgttcgaccatgccccagacaagctgaatgtggtgaaaaagacactcatcactttcgtgaacaagcacctgaataaactgaacctggaggtcacagaactggaaacccagtttgcagatggggtgtacctggtgctgctcatggggctcctggagggctactttgtgcccctgcacagcttcttcctgaccccggacagctttgaacagaaggtcttgaatgtctcctttgcctttgagctcatgcaagatggagggttggaaaagccaaaaccgcggccagaagacatagtcaactgtgacctgaaatctacactacgagtgttgtacaacctcttcaccaagtaccgtaacgtggagtgaggggctgccctgggcccaccactgcccaagagttcttgctgttggcgtactggaccctcctccgaactgccttaccctgcttattcctgtctcttgcactgtgctctcccacaagtccagctgcaacccagagatagtggaaactgaaattaggaaggaaatcatcaataactcagtgggctgacccatccctcccaggcgctggggaccaacctagcaatgaaggttgggaaggttgttcccttcccggtgccaggtccagatttccctccatgatttgggaaccagcttaggcaaaagagtccccacaagatgaaaataaagatcctagttaccattcaaaggatgctaactgtgtgtcaggccccacactaagtgctctgctctgatatactcaaggccattaatcttcaggactcccattgacgtaggtgtttcattccccttttacagatgaggaaactaaggcttggaggttaaatgacttgccagaagttggaatttttttcctctttgaacataacctctcccttctccctaaaggtaaccactattctgagtccaatcatcaaggttttgcttttctttttagctaagtatgcattcctcaatagtagacagtacaacatgtttataacaagccaattacattatgttctttgcatgttctaaagttgtgtatgtgtgtgcacatctgagcacgtgcacatgtacacctgagccaaaaacacgagaacccactgatctcaccactggggcaagctaggtcagagcttagtgattcacactgaaattggcaaattggatttaacccaattaatagtgtgtgtgtggcaggagtcatgtccctcacatcctttgtacaaatgaaaattactcttaattccttcagatttataataactctgtactttggtttcagggtgacatttgggaaggattttgtttagaattaatggagtggcacattttgcagcctttttgcttgattgcatgtaatggaaatgccctatattttcctgcaaaataagtactaaattcattatcgttaagcaaatgtacaatatgctcaggcaccgcagagagctgggcacgggcccatgtgagcatcactttggaagtagggctcttcaacagggacccttgaactttaaagaaaggaacttctttttgccttctaattgatcatttagactattctggctaagtctgcccacatgtaattaccggctaattcaagcgaggaaaaatgtaagtcatttagaccaaagccaagcagtttctttgcgtgggttactcaagggcttgtggttacttgtatctcctctatgtgaacttgactttgaaagacagagctctagtgtgccagcctgctaagtcctgtaagaatagggaagggcggaggggggtgggcagtgactaggggacgagaagcatggggaaaatatttgcactctaaacatacagagatagaggtggggcttgtggtacttaacacttgtagccatcaactgactgagaccttgggctaaataatcaattgtgctgatattacatctcgttatggaatgttcctaaatatgccaggtagacaccagcccaagtaccctcctccagaagtctgtgactaccttgtcactactttaggcccattccacaaagcccatctctggtttgagaattcattttgatctgtatctacaccacccaaagttaggcctcctataatgtccaaaacattcctttcagcctttttatttcttactgtactgtctcttactgtactgtctatctgcagtaattgaggacccataaaatttagataactacatgtctttgctcttagaattgtcactcagcataatgagcatttaacatacaaaggcaatgtactgttttgtgttgatctatgtaaaagaatacaattcttttttacataattagtgaaattttattttttattaggaaacactaaatagtgtaatatttcttttgcttttaaaaaaattcctggtagcaaatcaagataaataattgcttcattttcttgagcaatactgaagcaggatgaagtaagaggaatgcattcatttaaacatgctttgctttatgaattttgtctcttttttggtctctttttcttatattcaagttacaaatgtacaagtatccttactaagagtgctccttttgtattttacatatatacagtatgaaaatacattggaacactaggaaagtttttaaataacagttctaatttatcagaaaattgtgttttgggattgagttctttgtctcagcccagaatcccaggtcctgggcctggttttctaatgctgtcatctcagttcgatattttactttagaacctggaatctcctacttaatatatgaccatgactttgaaaggcaaaagaggaatcaagaataaataaaacaaacttaatcttcatctttaaaaaaaagaaaaaagaaaccaaaatgagaatcaacacttcataggctcactgggttttcttttcttttctgttaatttaaactcagttatttttaatgcttaatacatacatggtgcaaaatttaaaaagcgcaaataggtatctagtggaaaacctaagcctccctctctcctccggcacccattacctctccctggaggcaactgttttgatccatttcttacacacactgccagagatactctaggcatgtaaagcacaaacatacatataaaatctgcgggcttcaaaaaatataagtaggatgtcatctatactgtcatacactttgttttttatcacttaatgttatatcttggatattgtattaccctgggtattaaaaagaactcctttcacattttaaaataacaa

SEQ ID NO: 163839 - DNA, 897 bp, Homo sapiens
  Payload ID: 12260
  Gene Symbol: PARVA
  Gene Name: parvin, alpha
  ENST ID: ENST00000528916
  CDS Start-End: 270-897
agaggcgagaggcagaatcccgcttgctttgcagcaggtctgtgagtctccagtggcatcgtattaaattatataggcagccacttgtttgcaactgacgcactgagctgagagttgtgccgagcaggaggcattctcttcgggaagcatttgagaagatcctatagcttcacagacctccagttggtctgaaagcagaagggtagaaaccacagggagggggtcagctctgggcagaagatgccatgattgccatgaaatcctagaccatgggctgcggggcactttgccctcaagtgtccgagctgcaggaggagggaatgaacgccatcaacctgcccctcagcccaattccctttgagctggaccccgaggacacgatgctggaggagaatgaggtgcgaacaatggtggatccaaactcacgcagtgaccccaagcttcaagaactgatgaaggtattaattgactggattaatgatgtgttggttggagaaagaatcattgtgaaagacctagctgaagatttgtatgatggacaagtcctgcagaagcttttcgagaaactggagagtgagaagctaaatgtggctgaggtcacccagtcagagattgctcagaagcaaaaactgcagactgtcctggagaagatcaatgaaaccctgaaacttcctcccaggagcatcaagtggaatgtggattctgttcatgccaagagcctggtggccatcttacacctgctcgttgctctgtctcagtatttccgcgcaccaattcgactcccagaccatgtttccatccaagtggttgtggtccagaaacgagaaggaatcctccagtctcggcaaatccaagaggaaataactggtaacacagaggctctttccgggaggcatg

SEQ ID NO: 163840 - DNA, 5429 bp, Homo sapiens
  Payload ID: 12261
  Gene Symbol: PARVB
  Gene Name: parvin, beta
  Uniprot ID: Q9HBI1
  ENST ID: ENST00000338758
  CDS Start-End: 64-1158
ctccccggggcgaccgggcggctccacacgcgctgcgcccgccgccggccccacgcgcggcccatgtcctccgcgccgcgctcgcccaccccgcggccccgcaggatgaagaaggacgagtcgttcctgggcaagctgggcggcaccctggccaggaagcggagggcgcgcgaggtgagtgacctgcaggaagaaggcaagaatgccatcaactcaccgatgtcccccgccctggtggatgttcaccctgaagacacccagcttgaggagaacgaggagcgcacgatgattgaccccacttccaaggaagaccccaagttcaaggaactggtcaaggtcctcctcgactggattaatgacgtgctggtggaggagaggatcattgtgaagcagctggaggaagacctgtatgacggccaggtgctgcagaagctcttggaaaaactggcagggtgcaagctgaatgtggctgaggtgacacagtccgaaatagggcagaaacagaagctgcagacggtgctggaagcagtacatgacctgctgcggccccgaggctgggcgctccggtggagcgtggactcaattcacgggaagaacctggtggccatcctccacctgctggtctctctggccatgcacttcagggcccccatccgccttcctgagcatgtaacggtgcaggtggtggtcgtgcggaaacgggaaggcctgctgcattccagccacatctcggaggagctgaccacaactacagagatgatgatgggccggttcgagcgggatgccttcgacacgctgttcgaccacgccccggataagctcagcgtggtgaagaagtctctcatcacttttgtgaacaagcacctgaacaagctgaatttggaggtgacggaactggagacccagtttgcagatggcgtgtacctggttctgctcatgggccttctggaagactactttgttcctctccaccacttctacctgactccggaaagcttcgatcagaaggtccacaatgtgtccttcgcctttgagctgatgctggacggaggcctcaagaaacccaaggctcgtcctgaagacgtggttaacttggacctcaaatccaccctgagggttctttacaacctgttcaccaagtacaagaacgtggagtgacgggggagctgtggatggtggcaggagtgtcccagcaagaaaggcggcatccgtctgtgccctgtgcctttccagggagccaggcgccatgggcttctggtccaagctgtgttgactgtcatccccaccccacccctacctcacgcctgccccaccccctgcctcttttggttgttgttcttaatctcctctccatgtagttcccagtgggcaagagcctttgaaaatgcaggattctaaacactcgtgcttgcgtttgaagcctcgcgtcactcagtcgcgtgggatgatgagtccgttgttgtctgccttggccgaaagatgaaaaaaagcctgaaccccaacccccagctggttgagagcaccctgcattctgcctcatggtgcagttagcgatcacaggccttcagaagtacaacatcagctcagcaggaacgccggctccccgaggacccaggcttgacgattcaccggggatctcctgggctgggctctccttggaagtgaggccttttattaaaaataaaagggttttgcagtttgaaaaactttaaagtcccagaagcttagatgtgacatgggtgtcctccacccacattcctatcacttcttggtcactcgttttaatgtaggttttgcacaaacatccaagactcaggatggcccagctcccacagtccttgaaaggagctgtctgctggggacgtttcttaatttcttgctgtggttgaggggctgggtctggagatggctctaattgtgctgcttgagacagcttgggtcacagctttccccttcagaggccctttttgggaatgaatgcatctttggaaactttaaaatgaggggggtgcattggttcactggcactgtgtagtaaagtgccacaggggagtggctcagacatcagagaattacatcctcaggcctttcgccttggcttgtagatgccggcttctccccgtgtcttcacatggtctcccctctgtgtgtctgtgtcctcaccgcctcttttattttattttttatttttgtttttattttttgagacagagtctcgctctgtcaccaggctggagtgcagtggtgtgatctcagctcactgcaacctctgcctcccaggttcaagcgattctcctgcctcagcctcccaagtagctggcattacaggcaggtgccaccacacctggctaatttttgtatttttagtagagacggggtttcaccatgttggccaggatggtcttgatctcctgacctcatgatctgcctgcctcagcctcccaaagtgttgggattacaggcgtgagccactgtgcccagcctatttttttttttttttttgagacaagttctcactgtgtcacccaggagtaaagtggtgccatctcagctcactgcagccttgatctcccaggctcaattgatcctcccacctcagcctcccaagtagcggggaccacaagtgcacaccactaggcccatctaatttttgtattttttgtagagatggggtttcaccatgttgcccaggctgttctcaaacccctgggcttgagcgacccacccacctcagcctcccaaagtgctgggattataggcatgagcggacatgcccagcctgcacccctctttttagaagggctgcggtcctattggattagggcccacttatatgacctcatttaatcttgattacctccataaagaccctgtctccaaataccatcacatcagaggtgctggggttaggacttcagcatgtggatttgtggggggcataatttgccttgtaccgggaggatatgaagtgttcatgttactctccctgtagccctgagagcatctcccttagagtatcctataaaaggagtcgctgctcactcagttatgggttgttcaccccctcgctcaccccagctctgcagagaactggggatcccatcggccatgctttctgggctggcctctggtcgcagtcagtccctcgctgtggcgcccccccctcccccagctccttcccagggtgatgacccgctgaccccctggggtgcacctgctgcaaagcagcccccttccttggcatctctcagcattctccgtagtgagcctggcctttctgatcttgttagctttttgtcttcctgccgcagatcagagctttggagtaagttttgatatgaaatcgaatgccaacaccgaagttttagaaaacagtttaatattccctctcagttccggctgttgctaggctggggatgggttcagaatagccattttgatggaggtgatttcccagcaggggaaagaaataattaaaacagcattacggtgtctcttgcgggatgcagtgacattcaaaagccacactgacaaaaagcctggggctggaacgttctgtgctgcctgcatggcatgtacaggaccgcggccccctggagctggtggagtggcccagccttgccctgctcacaggtggacctggagagggcactgtgccttcccagggattgggatttgaaaagaacagagcttggccaggtgcggtggctcacgcctgtaatcccagcactttgggaggctgaggcaggtggatcacttggggtcagaagttcgagaccagcctggccaacatggtgaaaccccatgtctactaaaaatacaaaaattagccatgcatggtatgtatgcctgtaatcccagctattcgggaggctgaggcaggagaattgcatgaacccaggaggtggaagttgcagtgagctgagatcatgccactgcactccagcctgagcaacagagtgagactctgtctcaaaaaaaaaaaagaaagaaaaaagaaaaagaaaagaacagagctgtgattttcagccaaaatgagcagccctggcccattctgtgtcatcagaggggagaggacggttactgtgggagggggcttcagcttctcagggaggtcctggcggcccccatctagtaaaccagtaaacccatgcctatcctcatgcccacgtcacactcttgtgggtttcaagtcgaacagtaaaaggaatcataagatctgtggggaagctacatgggcacttgtgtttcacaacagggacccttaaaggcgatgtttccagcaaaggatgtgattttttttttttttttttttgagataagttctcactgcgttgcccaggctggagtgcagtggtcattcacagacacacacatagcagactacagactacagccttgaactcctgggctcaagtgatccacccacttctgtatcctgagtccctggaacggcaggtgcacaccaccgcacccggcttggatgtgatcttttgtccacattcttttccaattggttcaaaggtgtaggtgtgccttttgcatacctgggaagggccccattaggctcgactcctcatttttctccattcaccatcagtttgagtctgaattcatagcatggcctggacagatgcagcaaggggccagttccaaggcagaattcagggtgaactcgattcctataggcttgggatgaatggctgctgggacatgaggcttgggtgtgagatgccccgtctgctgctgctcttggttcttagttcagagaaattctgggacccttcctcctcccggcaccacgttttcagtgaatggttctttgaagaggaaccctggtccataggaactgagtgaaagcaaggccaagtatgtccacccatggggacaaacgtcccagcacaaaggggtctcaggcctgcaaggcccaagtggacgctcggacaagggcaggaaggtatttgctgattctccttctccatgtgacgtgtctctcaacccacaccagctaggggagcctcccgcagcttcagttcccctttgacgcccacacagtgttatgcaagcaccgagcccagagtcccgctgggccgtggtgtcctaattgtcttggtgacaaagagcaattttattttaaagcaactgaatcctttccccctgttttgtgtgccagtattttactgtcttcttaattgttttaagcaatgtttactttggatttctggatgttatataaaagccacgaaaaccctggccatgctgtttgtcaggcccacctggctgagtgcaggaagcaagcgcttttcaggagctcactgcaacaccgggcaaacacttcttccgccagggatgcggttaggacaatgccacgtggcgtcacagtatgctgttatttattccaataaagacctcgtgagcatgggcctgtc

SEQ ID NO: 163841 - DNA, 1591 bp, Homo sapiens
  Payload ID: 12261
  Gene Symbol: PARVB
  Gene Name: parvin, beta
  Uniprot ID: Q9HBI1
  ENST ID: ENST00000404989
  CDS Start-End: 102-1085
ctgccacgtccctatatgaacggggtgtgtgcccgcctgccctccgacgtccgccggctgtgctggtctgcagagctgccgccagctgcaccctcctcgccatgagtgacctgcaggaagaaggcaagaatgccatcaactcaccgatgtcccccgccctggtggatgttcaccctgaagacacccagcttgaggagaacgaggagcgcacgatgattgaccccacttccaaggaagaccccaagttcaaggaactggtcaaggtcctcctcgactggattaatgacgtgctggtggaggagaggatcattgtgaagcagctggaggaagacctgtatgacggccaggtgctgcagaagctcttggaaaaactggcagggtgcaagctgaatgtggctgaggtgacacagtccgaaatagggcagaaacagaagctgcagacggtgctggaagcagtacatgacctgctgcggccccgaggctgggcgctccggtggagcgtggactcaattcacgggaagaacctggtggccatcctccacctgctggtctctctggccatgcacttcagggcccccatccgccttcctgagcatgtaacggtgcaggtggtggtcgtgcggaaacgggaaggcctgctgcattccagccacatctcggaggagctgaccacaactacagagatgatgatgggccggttcgagcgggatgccttcgacacgctgttcgaccacgccccggataagctcagcgtggtgaagaagtctctcatcacttttgtgaacaagcacctgaacaagctgaatttggaggtgacggaactggagacccagtttgcagatggcgtgtacctggttctgctcatgggccttctggaagactactttgttcctctccaccacttctacctgactccggaaagcttcgatcagaaggtccacaatgtgtccttcgcctttgagctgatgctggacggaggcctcaagaaacccaaggctcgtcctgaagacgtggttaacttggacctcaaatccaccctgagggttctttacaacctgttcaccaagtacaagaacgtggagtgacgggggagctgtggatggtggcaggagtgtcccagcaagaaaggcggcatccgtctgtgccctgtgcctttccagggagccaggcgccatgggcttctggtccaagctgtgttgactgtcatccccaccccacccctacctcacgcctgccccaccccctgcctcttttggttgttgttcttaatctcctctccatgtagttcccagtgggcaagagcctttgaaaatgcaggattctaaacactcgtgcttgcgtttgaagcctcgcgtcactcagtcgcgtgggatgatgagtccgttgttgtctgccttggccgaaagatgaaaaaaagcctgaaccccaacccccagctggttgagagcaccctgcattctgcctcatggtgcagttagcgatcacaggccttcagaagtacaacatcagctcagcaggaacgccggctccccgaggacccaggcttgacgattcaccggggatctcctgggctgggctctccttggaagtg

SEQ ID NO: 163842 - DNA, 1569 bp, Homo sapiens
  Payload ID: 12261
  Gene Symbol: PARVB
  Gene Name: parvin, beta
  Uniprot ID: Q9HBI1
  ENST ID: ENST00000406477
  CDS Start-End: 131-1324
caaaggccctacactttgacgtcctccccatctccggcagctccttaaactaagaactcattttaatttctgaattctccctttttaaagaccagataaatttacctttgggacagttagatgtgcacaaatgcaccatgtgtttaaagatcaccaaagaggagagaaaaggggattccttagtccagagaacaaaaactgcaggaggctggagctgagacgtgggtgttcctgcagctggggcctgtgctcccaggcactcatggcttctctggctggttcacttctccctggctcagacagatcaggagtggaaacatctgaatatgctcaaggaggagtgagtgacctgcaggaagaaggcaagaatgccatcaactcaccgatgtcccccgccctggtggatgttcaccctgaagacacccagcttgaggagaacgaggagcgcacgatgattgaccccacttccaaggaagaccccaagttcaaggaactggtcaaggtcctcctcgactggattaatgacgtgctggtggaggagaggatcattgtgaagcagctggaggaagacctgtatgacggccaggtgctgcagaagctcttggaaaaactggcagggtgcaagctgaatgtggctgaggtgacacagtccgaaatagggcagaaacagaagctgcagacggtgctggaagcagtacatgacctgctgcggccccgaggctgggcgctccggtggagcgtggactcaattcacgggaagaacctggtggccatcctccacctgctggtctctctggccatgcacttcagggcccccatccgccttcctgagcatgtaacggtgcaggtggtggtcgtgcggaaacgggaaggcctgctgcattccagccacatctcggaggagctgaccacaactacagagatgatgatgggccggttcgagcgggatgccttcgacacgctgttcgaccacgccccggataagctcagcgtggtgaagaagtctctcatcacttttgtgaacaagcacctgaacaagctgaatttggaggtgacggaactggagacccagtttgcagatggcgtgtacctggttctgctcatgggccttctggaagactactttgttcctctccaccacttctacctgactccggaaagcttcgatcagaaggtccacaatgtgtccttcgcctttgagctgatgctggacggaggcctcaagaaacccaaggctcgtcctgaagacgtggttaacttggacctcaaatccaccctgagggttctttacaacctgttcaccaagtacaagaacgtggagtgacgggggagctgtggatggtggcaggagtgtcccagcaagaaaggcggcatccgtctgtgccctgtgcctttccagggagccaggcgccatgggcttctggtccaagctgtgttgactgtcatccccaccccacccctacctcacgcctgccccaccccctgcctcttttggttgttgttcttaatctcctctccatgtagttcccagtgggcaagagcctttgaaaatgcaggattctaaacact

SEQ ID NO: 163843 - DNA, 742 bp, Homo sapiens
  Payload ID: 12261
  Gene Symbol: PARVB
  Gene Name: parvin, beta
  ENST ID: ENST00000444029
  CDS Start-End: 160-742
attgtgtgttccgcccatgcgttctgttgtccggggcagcaaagtcgacctgcaccacgtgggtgtttttgttttcttttgttttgttttgttttcttgaaggcctactaagagctgtcggaaactctgcttctgtagaaaagatgagatctcactctgatgcccaggctgaagtgcagtggtgcagtcatagctcactgcagcctcgaactcctggcctccagtgatccttctgcctcagcctcccaaggagcgaggaccacagtgagtgacctgcaggaagaaggcaagaatgccatcaactcaccgatgtcccccgccctggtggatgttcaccctgaagacacccagcttgaggagaacgaggagcgcacgatgattgaccccacttccaaggaagaccccaagttcaaggaactggtcaaggtcctcctcgactggattaatgacgtgctggtggaggagaggatcattgtgaagcagctggaggaagacctgtatgacggccaggtgctgcagaagctcttggaaaaactggcagggtgcaagctgaatgtggctgaggtgacacagtccgaaatagggcagaaacagaagctgcagacggtgctggaagcagtacatgacctgctgcggccccgaggctgggcgctccggtggagcgtggactcaattcacgggaagaacctggtggccatcctccacctgctggtctctctggccatgcacttcagggccccca

SEQ ID NO: 163844 - DNA, 1530 bp, Homo sapiens
  Payload ID: 12261
  Gene Symbol: PARVB
  Gene Name: parvin, beta
  ENST ID: ENST00000619710
  CDS Start-End: 118-987
gctgaatagaacgggcgtggaggcaggaggaggagcaggacgccgggcactgctgatgctgctttcgctggggtgagtgacctgcaggaagaaggcaagaatgccatcaactcaccgatgtcccccgccctggtggatgttcaccctgaagacacccagcttgaggagaacgaggagcgcacgatgattgaccccacttccaaggaagaccccaagttcaaggaactggtcaaggtcctcctcgactggattaatgacgtgctggtggaggagaggatcattgtgaagcagctggaggaagacctgtatgacggccaggtgctgcagaagctcttggaaaaactggcagggtgcaagctgaatgtggctgaggtgacacagtccgaaatagggcagaaacagaagctgcagacggtgctggaagcagtacatgacctgctgcggccccgaggctgggcgctccggtggagcgtggactcaattcacgggaagaacctggtggccatcctccacctgctggtctctctggccatgcacttcagggcccccatccgccttcctgagcatgtaacggtgcaggtggtggtcgtgcggaaacgggaaggcctgctgcattccagccacatctcggaggagctgaccacaactacagagatgatgatgggccggttcgagcgggatgccttcgacacgctgttcgaccacgccccggataagctcagcgtggtgaagaagtttgcagatggcgtgtacctggttctgctcatgggccttctggaagactactttgttcctctccaccacttctacctgactccggaaagcttcgatcagaaggtccacaatgtgtccttcgcctttgagctgatgctggacggaggcctcaagaaacccaaggctcgtcctgaagacgtggttaacttggacctcaaatccaccctgagggttctttacaacctgttcaccaagtacaagaacgtggagtgacgggggagctgtggatggtggcaggagtgtcccagcaagaaaggcggcatccgtctgtgccctgtgcctttccagggagccaggcgccatgggcttctggtccaagctgtgttgactgtcatccccaccccacccctacctcacgcctgccccaccccctgcctcttttggttgttgttcttaatctcctctccatgtagttcccagtgggcaagagcctttgaaaatgcaggattctaaacactcgtgcttgcgtttgaagcctcgcgtcactcagtcgcgtgggatgatgagtccgttgttgtctgccttggccgaaagatgaaaaaaagcctgaaccccaacccccagctggttgagagcaccctgcattctgcctcatggtgcagttagcgatcacaggccttcagaagtacaacatcagctcagcaggaacgccggctccccgaggacccaggcttgacgattcaccggggatctcctgggctgggctctccttggaagtgaggccttttattaaaaataaaagggttttgcagtttg

SEQ ID NO: 163845 - DNA, 1425 bp, Homo sapiens
  Payload ID: 12262
  Gene Symbol: PARVG
  Gene Name: parvin, gamma
  Uniprot ID: Q9HBI0
  ENST ID: ENST00000356909
  CDS Start-End: 221-784
ggaaggggcctggcccggggcggggtgtggagagaggaggaagctcctgccggctgagcgggcctggaggaagtgagcagcggggctcctgcctcccggcctggtccccgaagaccccagaagaacccggaacttgcttccattcggaatccagggaccaccctttgcactcagtaggcctttgttttcctgcgtggaaagcggttgggcttgggaggcgatggagccggagttcttgtacgacctgctgcagctccccaagggggtggagcccccagcggaggaggagctctcaaaaggaggaaagaagaaatacctgccacccacttcccggaaggaccccaaatttgaagaactgcagaaggtgttgatggagtggatcaatgccactcttctccccgagcacattgtggtccgcagcctggaggaggacatgttcgacgggctcatcctacaccacctattccagaggctggcggcgctcaagctggaagcagaggacatcgccctgacagccacaagccagaagcacaagctcacagtggtgctggaggccgtgaaccggagtctgcagctggaggagtggcaggccaagtggagcgtggagagcatcttcaacaaggacctgttgtctaccctgcacctccttgtggccctggccaagcgcttccagcccgacctctccctcccaaccaacgtccaggtggaggtcatcactatcgagagcaccaaaagtggtctgaagtcagagaagttggtggaacagctcactgaatacaggtgagggaaggatgagggcccatgggacgtctttgatgaattatttaagctggctccggagaaagtgaacgcagtgaaagaggccatcgtgaactttgtcaaccagaagctggaccgcctgggcctgtctgtgcagaatctggacacccagtttgcagatggggtcatcttactcttgctgattggacaacttgaaggcttcttcctgcacttaaaggaattctacctcactcccaactctcctgcagaaatgctgcacaacgtcaccctggcgctggagctgctgaaggacgagggcctgctcagctgccctgtcagccctgaagatatcgtgaacaaggatgccaagagcacactgagggtgctctatggtctgttctgcaagcacacgcagaaggcacacagggacaggacgccccatggagccccgaattgaccctcactgcctccaaagcccagagcctgcctgtcagcccagctggagggcccgaggctgcagggtgtcctcccacagtcccgctgtttcctgtgcattcgtgacccgcttccctcccaccctgtctcctgtctccatcgttggattatctttgaacccccttgtgtggatcattttgagccgcctggccttgctcagtttattttaat

SEQ ID NO: 163846 - DNA, 3462 bp, Homo sapiens
  Payload ID: 12262
  Gene Symbol: PARVG
  Gene Name: parvin, gamma
  Uniprot ID: Q9HBI0
  ENST ID: ENST00000422871
  CDS Start-End: 425-1420
ctttgtttggctgctgttttaatctttcatgcatttagcagtcatggatggtgccagcgaaggaacaggtgccagggcgttgtgactccacccagcgctgcttcccgggaccttccaattggacaggagctgggggaagagctggttcacagccctttgtgggggatgggactttgggaaccccaaacttctgctgggaccacaaggagaagagggcagcagagtcacagctgcagagaggaggaagctcctgccggctgagcgggcctggaggaagtgagcagcggggctcctgcctcccggcctggtccccgaagaccccagaagaacccggaacttgcttccattcggaatccagggaccaccctttgcactcagtaggcctttgttttcctgcgtggaaagcggttgggcttgggaggcgatggagccggagttcttgtacgacctgctgcagctccccaagggggtggagcccccagcggaggaggagctctcaaaaggaggaaagaagaaatacctgccacccacttcccggaaggaccccaaatttgaagaactgcagaaggtgttgatggagtggatcaatgccactcttctccccgagcacattgtggtccgcagcctggaggaggacatgttcgacgggctcatcctacaccacctattccagaggctggcggcgctcaagctggaagcagaggacatcgccctgacagccacaagccagaagcacaagctcacagtggtgctggaggccgtgaaccggagtctgcagctggaggagtggcaggccaagtggagcgtggagagcatcttcaacaaggacctgttgtctaccctgcacctccttgtggccctggccaagcgcttccagcccgacctctccctcccaaccaacgtccaggtggaggtcatcactatcgagagcaccaaaagtggtctgaagtcagagaagttggtggaacagctcactgaatacagcacagacaaggacgagcctccaaaggacgtctttgatgaattatttaagctggctccggagaaagtgaacgcagtgaaagaggccatcgtgaactttgtcaaccagaagctggaccgcctgggcctgtctgtgcagaatctggacacccagtttgcagatggggtcatcttactcttgctgattggacaacttgaaggcttcttcctgcacttaaaggaattctacctcactcccaactctcctgcagaaatgctgcacaacgtcaccctggcgctggagctgctgaaggacgagggcctgctcagctgccctgtcagccctgaagatatcgtgaacaaggatgccaagagcacactgagggtgctctatggtctgttctgcaagcacacgcagaaggcacacagggacaggacgccccatggagccccgaattgaccctcactgcctccaaagcccagagcctgcctgtcagcccagctggagggcccgaggctgcagggtgtcctcccacagtcccgctgtttcctgtgcattcgtgacccgcttccctcccaccctgtctcctgtctccatcgttggattatctttgaacccccttgtgtggatcattttgagccgcctggccttgctcagtttattttaataaaagtatttctgggagggattctgggaacttgacagggtcctgaggagggcccttaaacctgcagcctccctcccatggggtgagtgtgtgtcacatcagtctctcatctctgggcccaggctagtgaccgcccagagaggtggcatcactcagggctggggactctcagggacagggcccacagccccagaccccaccttttccagcccagctccccacacccacctgcttctcactcgggaggatgggccccagagtcaccctccagggcaggagcccgaatggctccatagccatgcccccacccaccgggagaagtggattcagtgactgtcaaagcaacccgggctgtgtcctgcagctgccctcgtgagttttgcccaaaagtcacaaagaagcaatcttcgtggttgattagtgggttcaggtcatctccagtctgtcctcgggagctgtgggttcccactcgctccagtgagacttggcattttctgcacataaagaagagtcgtgtgggagaattgcacatagtcagtccagggcatccagagtggggcagagctgatggctgatgggaaccggggaggaggctggcggggaggggtgagattggtggggagggctggggctggccgggaggggtgggactgatggggaggggtgaggctggcggggaggggtgaggctggcggggaggggtgggactggtggggaggagtgaggctagtgggcgggtgaggctggcggggaggggagggtttgtggggacgggtgaggctggcggggaggggtgaggctggtggggagggctggggcctggtggggaggagtgggacttgtggggaggagtgggacttgtggggaggggtgaggctggggagaagggcaaccacagccccaggctgctgctcctccctggaccctgaagaggcctctgggtctggggttttcacagtttgacagctgaggccttggggaggggctttagatgggggttaggggctaggtcatcattgacacccactgggggcgcctaggcagatgtccttcgggggagcaagatgggagccagggacgcagtgccaggtcagccctgggagctggtgtctgggtgtgagaaggccttgaggggtcttcccttcacctagcctcccatctgcctgcccttctcagctcccaattcacagggcaaacccaagcccataagcgtgttccacgtgagcactcagatgcacccctcttcatggatacccaccctacttcccggctgcctctgggaaacgtgcatcctcccacaccaggtacctggagcccagctccttccacctgctcaggtgccccctccattgcgatgccccctccagcacctcaaatcctctcctggagcttctggggacacaggctcagcctctctcagctggcttcatcccaaaagcctgaaatccagccccacttcctggggcctttgagtcctcacttgcttgggccccatccgctgcaggctggctctgcctggctgttccacgtcctcactcttgttctatttgacagcaattaaaaaaaaagtgacttatttaattactgtagctttattgaaaaataacttcccagtttgaagtgtacaatttgatgagttttgacaaatgcatgcagtcatataaccaccaccatcgttatccagacatgggacattcccatcaccatgcaagtttctgcatctgtctgcagccagttcccttctcccagcccctggccctggggaccactgatctgttttctgtcaccatcatttagacttgtctagaatttcttataaactgtatcctatggt

SEQ ID NO: 163847 - DNA, 3523 bp, Homo sapiens
  Payload ID: 12262
  Gene Symbol: PARVG
  Gene Name: parvin, gamma
  Uniprot ID: Q9HBI0
  ENST ID: ENST00000444313
  CDS Start-End: 485-1480
aaactcaccatttcagcccggatggtgaagattccagcttgagagaccagctcgggtctgaagtgtttctctatctactgtgctgagatctctccttctcgaaccctgctatgcctttgcatacgctgttttctccacctgccacgttctcaccccttcttcttccactgcaaactcctatgcagccgtcaaggccccattctcctctggaaagccttcccgatccccttggcaacaaccaccaccaatatttattcactgagcccactttgtgccaagcattgttctagacacggagaggaggaagctcctgccggctgagcgggcctggaggaagtgagcagcggggctcctgcctcccggcctggtccccgaagaccccagaagaacccggaacttgcttccattcggaatccagggaccaccctttgcactcagtaggcctttgttttcctgcgtggaaagcggttgggcttgggaggcgatggagccggagttcttgtacgacctgctgcagctccccaagggggtggagcccccagcggaggaggagctctcaaaaggaggaaagaagaaatacctgccacccacttcccggaaggaccccaaatttgaagaactgcagaaggtgttgatggagtggatcaatgccactcttctccccgagcacattgtggtccgcagcctggaggaggacatgttcgacgggctcatcctacaccacctattccagaggctggcggcgctcaagctggaagcagaggacatcgccctgacagccacaagccagaagcacaagctcacagtggtgctggaggccgtgaaccggagtctgcagctggaggagtggcaggccaagtggagcgtggagagcatcttcaacaaggacctgttgtctaccctgcacctccttgtggccctggccaagcgcttccagcccgacctctccctcccaaccaacgtccaggtggaggtcatcactatcgagagcaccaaaagtggtctgaagtcagagaagttggtggaacagctcactgaatacagcacagacaaggacgagcctccaaaggacgtctttgatgaattatttaagctggctccggagaaagtgaacgcagtgaaagaggccatcgtgaactttgtcaaccagaagctggaccgcctgggcctgtctgtgcagaatctggacacccagtttgcagatggggtcatcttactcttgctgattggacaacttgaaggcttcttcctgcacttaaaggaattctacctcactcccaactctcctgcagaaatgctgcacaacgtcaccctggcgctggagctgctgaaggacgagggcctgctcagctgccctgtcagccctgaagatatcgtgaacaaggatgccaagagcacactgagggtgctctatggtctgttctgcaagcacacgcagaaggcacacagggacaggacgccccatggagccccgaattgaccctcactgcctccaaagcccagagcctgcctgtcagcccagctggagggcccgaggctgcagggtgtcctcccacagtcccgctgtttcctgtgcattcgtgacccgcttccctcccaccctgtctcctgtctccatcgttggattatctttgaacccccttgtgtggatcattttgagccgcctggccttgctcagtttattttaataaaagtatttctgggagggattctgggaacttgacagggtcctgaggagggcccttaaacctgcagcctccctcccatggggtgagtgtgtgtcacatcagtctctcatctctgggcccaggctagtgaccgcccagagaggtggcatcactcagggctggggactctcagggacagggcccacagccccagaccccaccttttccagcccagctccccacacccacctgcttctcactcgggaggatgggccccagagtcaccctccagggcaggagcccgaatggctccatagccatgcccccacccaccgggagaagtggattcagtgactgtcaaagcaacccgggctgtgtcctgcagctgccctcgtgagttttgcccaaaagtcacaaagaagcaatcttcgtggttgattagtgggttcaggtcatctccagtctgtcctcgggagctgtgggttcccactcgctccagtgagacttggcattttctgcacataaagaagagtcgtgtgggagaattgcacatagtcagtccagggcatccagagtggggcagagctgatggctgatgggaaccggggaggaggctggcggggaggggtgagattggtggggagggctggggctggccgggaggggtgggactgatggggaggggtgaggctggcggggaggggtgaggctggcggggaggggtgggactggtggggaggagtgaggctagtgggcgggtgaggctggcggggaggggagggtttgtggggacgggtgaggctggcggggaggggtgaggctggtggggagggctggggcctggtggggaggagtgggacttgtggggaggagtgggacttgtggggaggggtgaggctggggagaagggcaaccacagccccaggctgctgctcctccctggaccctgaagaggcctctgggtctggggttttcacagtttgacagctgaggccttggggaggggctttagatgggggttaggggctaggtcatcattgacacccactgggggcgcctaggcagatgtccttcgggggagcaagatgggagccagggacgcagtgccaggtcagccctgggagctggtgtctgggtgtgagaaggccttgaggggtcttcccttcacctagcctcccatctgcctgcccttctcagctcccaattcacagggcaaacccaagcccataagcgtgttccacgtgagcactcagatgcacccctcttcatggatacccaccctacttcccggctgcctctgggaaacgtgcatcctcccacaccaggtacctggagcccagctccttccacctgctcaggtgccccctccattgcgatgccccctccagcacctcaaatcctctcctggagcttctggggacacaggctcagcctctctcagctggcttcatcccaaaagcctgaaatccagccccacttcctggggcctttgagtcctcacttgcttgggccccatccgctgcaggctggctctgcctggctgttccacgtcctcactcttgttctatttgacagcaattaaaaaaaaagtgacttatttaattactgtagctttattgaaaaataacttcccagtttgaagtgtacaatttgatgagttttgacaaatgcatgcagtcatataaccaccaccatcgttatccagacatgggacattcccatcaccatgcaagtttctgcatctgtctgcagccagttcccttctcccagcccctggccctggggaccactgatctgttttctgtcaccatcatttagacttgtctagaatttcttataaactgtatcctatggta

SEQ ID NO: 163848 - DNA, 309 bp, Homo sapiens
  Payload ID: 12262
  Gene Symbol: PARVG
  Gene Name: parvin, gamma
  ENST ID: ENST00000416291
  CDS Start-End: 231-309
ctccacctgccacgttctcaccccttcttcttccactgcaaactcctatgcagccgtcaaggccccattctcctctggaaagccttcccgatccccttggcaacaaccaccaccaatatttattcactgagcccactttgtgccaagcattgttctagacacggggaccaccctttgcactcagtaggcctttgttttcctgcgtggaaagcggttgggcttgggaggcgatggagccggagttcttgtacgacctgctgcagctccccaagggggtggagcccccagcggaggaggagctctcaaaag

SEQ ID NO: 163849 - DNA, 622 bp, Homo sapiens
  Payload ID: 12262
  Gene Symbol: PARVG
  Gene Name: parvin, gamma
  ENST ID: ENST00000417767
  CDS Start-End: 533-622
gaggaaggggcctggcccggggcggggtgtggaggtgggaggacggcggtgcgggatggagggtggaggccaggctgacagggtgctggtggtgggttgcgggggtcgaccccaggctctggcctatgtagctgccattttggaggtgaacagcctgcggggaaactggcatggtttggggaaggcggggagagggggagaaatgaaagcattgagtttaagtggcctgcagaaccccgggggcccaggcggcacggcgggcgctggggctccgggcagagctttctggaggtttgtggcagcttcactttcacggcatccacccccctcgggccctgccgcagagaggaggaagctcctgccggctgagcgggcctggaggaagtgagcagcggggctcctgcctcccggcctggtccccgaagaccccagaagaacccggaacttgcttccattcggaatccagggaccaccctttgcactcagtaggcctttgttttcctgcgtggaaagcggttgggcttgggaggcgatggagccggagttcttgtacgacctgctgcagctccccaagggggtggagcccccagcggaggaggagctctcaaaaggtgtgtgccca

SEQ ID NO: 163850 - DNA, 999 bp, Homo sapiens
  Payload ID: 12262
  Gene Symbol: PARVG
  Gene Name: parvin, gamma
  Uniprot ID: Q9HBI0
  ENST ID: ENST00000415224
  CDS Start-End: 192-755
cagagaggaggaagctcctgccggctgagcgggcctggaggaagtgagcagcggggctcctgcctcccggcctggtccccgaagaccccagaagaacccggaacttgcttccattcggaatccagggaccaccctttgcactcagtaggcctttgttttcctgcgtggaaagcggttgggcttgggaggcgatggagccggagttcttgtacgacctgctgcagctccccaagggggtggagcccccagcggaggaggagctctcaaaaggaggaaagaagaaatacctgccacccacttcccggaaggaccccaaatttgaagaactgcagaaggtgttgatggagtggatcaatgccactcttctccccgagcacattgtggtccgcagcctggaggaggacatgttcgacgggctcatcctacaccacctattccagaggctggcggcgctcaagctggaagcagaggacatcgccctgacagccacaagccagaagcacaagctcacagtggtgctggaggccgtgaaccggagtctgcagctggaggagtggcaggccaagtggagcgtggagagcatcttcaacaaggacctgttgtctaccctgcacctccttgtggccctggccaagcgcttccagcccgacctctccctcccaaccaacgtccaggtggaggtcatcactatcgagagcaccaaaagtggtctgaagtcagagaagttggtggaacagctcactgaatacaggtgagggaaggatgagggcccatgggacgtctttgatgaattatttaagctggctccggagaaagtgaacgcagtgaaagaggccatcgtgaactttgtcaaccagaagctggaccgcctgggcctgtctgtgcagaatctggacacccagtttgcagatggggtcatcttactcttgctgattggacaacttgaaggcttcttcctgcacttaaaggaattctacctcactcccaactctcctgcag

SEQ ID NO: 163851 - DNA, 820 bp, Homo sapiens
  Payload ID: 12262
  Gene Symbol: PARVG
  Gene Name: parvin, gamma
  ENST ID: ENST00000466375
  CDS Start-End: 70-174
cagggaccaccctttgcactcagtaggcctttgttttcctgcgtggaaagcggttgggcttgggaggcgatggagccggagttcttgtacgacctgctgcagctccccaagggggtggagcccccagcggaggaggagctctcaaaagagctagaacctcttctctccagatgagagacggtgtggattacgatggtgaatactgattgctctcatcctgtgagccttctgagtgcccctactgcaccagcacctcttaccaatagcaactcatttattctcaagggcgggcatcagtgcctgctttatacagatgaggaaactgaggcacaaggggtgacgtgccacagtaacaggaaactcttagcaagtggtggacctgggttctgagcccaaggagggtggtcccagaactgaggttccacacggaccacgcagcgatgcccaccatggagtgatactttgcagggtgtggggctcctgacgtgctcccctcacacgtgtgggtccctttcaaaagtggggtgagcataggatggagcaattcaacgactataggtcgccctttcagtaaagctctgtgtcatgagccctttggggggttggcggccacagttcctgcaacctcccttctaggagatggctcaaaagaaggacatgggcaggtacccagagctgtcaccctctctgtgttctctgaaagaaacaaatgaacaacagcttgcaaggaagcagcgagatgtcccagtggggaagggctttaggtgaactcattggaatttatgtaaccacaaaaacataaatgtgctgacaaagaaaa

SEQ ID NO: 163852 - DNA, 3163 bp, Homo sapiens
  Payload ID: 12263
  Gene Symbol: PASD1
  Gene Name: PAS domain containing 1
  Uniprot ID: Q8IV76
  ENST ID: ENST00000370357
  CDS Start-End: 246-2567
acgctgcctccatgcctgcctcccctctctgccacgcccccaccacgcgctttgcactctggggcccacgcacttccctgaagagtctagaagctgctcctcatttccagactttccgggcgcccaccaggctcccgggctctcaccggagaccacagggaggagcttcaaggtaccccaagtccctgcggcctccagcagtgaagagttccacaagggagtcttcctacgtcactgaataatgaatgaagatgagaggggaaaagagaagagacaaagtcaatccaaaaagctctcaaaggaaattaaactggattccatcatttcctacctatgattacttcaaccaagtgacgctacagttattagatggctttatgattacactgagcacagatggagtgatcatttgtgtggctgaaaacatctcttctcttcttggacatttaccagctgagattgtgggcaaaaaattattaagccttctgcctgatgaagagaaagatgaagtctaccaaaagattattctcaaatttcctttactaaactcagaaacacatattgaattttgctgtcatttaaaaagaggaaatgtcgaacatggtgatagttctgcttacgaaaacgtgaaatttattgtgaatgtaagagatatttgtaatgagtttcctgtggtctttagtggcttgttttccagccacctctgtgctgactttgctgcatgtgttcctcaggaggatcggctttatcttgtgggaaatgtttgcattctcaggactcagctcctgcagcaactttacacttcaaaggcagtcagtgatgaagctgtacttacacaagattcagatgaggaaccttttgtgggagagctcagtagctctcaaggtcaaagaggacacactagcatgaaagccgtgtacgttgaacccgctgctgctgctgctgctgctgctatctcagacgaccaaattgatattgcagaggttgagcagtatggaccacaagaaaacgttcacatgtttgtagattctgattcaacttattgctccagtacagttttcctggatactatgcctgaatctccagccttatccttgcaagactttcgaggtgagcctgaggtgaatccattgtacagggcagacccagtggacctggagttctcggtggatcaggtggactcagtggaccaggagggcccaatggaccagcaggacccagagaacccagttgccccgttggaccaggcaggcctgatggatccagtggatccagaggactcagtggacctgggggctgctggcgcaagtgctcagccattacagccatcatcaccagttgcatatgacatcattagccaggaactggaactgatgaagaagttgaaggagcagctagaagagaggacttggttgctgcatgatgccatccaaaaccagcagaatgcattggaattgatgatggatcaccttcagaagcagccaaacacattacgccacgttgtcattcctgatctccaatcttcggaggcagtgcccaagaaacaacagaaacaacacgctgggcaagtgaagcggcctctcccacatcccaaggacgtcaagtgtttctgtggtttatctttatccaactctctcaaaaacactggggagcttcaggagccttgtgttgccttcaaccagcagcaactggtgcagcaagaacaacacctgaaggagcagcagcggcagctgcgggagcagctgcaacagctgagagagcaaaggaaggtgcagaagcagaagaagatgcaggagaagaagaagctgcaggagcagaaaatgcaggagaagaagaagctgcaggagcagaggcggcaaaagaagaagaagctacaggagcggaagaagtggcaggggcagatgctacagaaagagccagaggaggagcagcagaagcagcagctgcaagagcagccactgaagcataatgtcatcgtggggaatgagagggtgcagatatgcctgcaaaacccacgtgacgtatctgtgcccctctgcaatcaccctgttagatttttacaggcccaacccattgttcctgtccagagagcagctgaacaacagccctctggcttctatcaagatgaaaactgtgggcaacaggaagatgagagtcaaagtttttatcctgaggcgtatcaagggccccccgtgaaccagctgccattgatagatacctcaaactctgaggcaatttcttcttccagcattcctcagtttcccataacttcagactcaaccataagcaccctggagaccccacaggattacatccggctttggcaagagttgtctgattcactcggtcctgttgtccaagtgaacacttggtcttgcgatgagcagggcaccctgcacggccaacccacctaccatcaggtgcaagtttctgaggtaggagtcgagggacctcctgatccacaggctttccaaggccctgctgcataccagccagaccagatgagatctgcggagcagaccagattgatgcctgcagagcaacgtgactcaaataagccgtgctaacagtactttcatgaccagtgatgaggggaaatggggggagggggcaggccaatgaggtctgcatggccaggggaccttcaaggtgcgtaaagtcccttggggtagggtttagtgggtagagacttatttgtttcctgataggttatgtttgtaattgtttgttaagcacagcctgtttcttggaagttatgctgtagaggcagcctgtgatccgtagtatgctagggtgtgacagcagccagccacagctggatctgatgtcttgtctgccccgcccagctttgcatatccatgttctaccacaggaaggtggcctgccaagagtctgctcaaagttttcaacataaagaataaagaaaaaaaaatgccaaagtgcttttcaatctagtaaatctagagggttgttttgtcttagccacaagaattccgaggtcttgaccctgatgatcaacctgcctcccctccatagtcttgttggagaagcccagagagaatgggactccaactaagggaacctgaaatcaactcaatggaggcacttcagagctaaaataattatggcttccttgcttaataaacattttcgttcactgcaa

SEQ ID NO: 163853 - DNA, 4572 bp, Homo sapiens
  Payload ID: 12264
  Gene Symbol: PASK
  Gene Name: PAS domain containing serine/threonine kinase
  Uniprot ID: Q96RG2
  ENST ID: ENST00000234040
  CDS Start-End: 134-4105
gtcgctgtgcgattggtcggtgggataaaagcgcggaagggctcctttccgtggtgtgtagccggcttggcgtgaccctcgcctgatccagttgttagagttggaagcttggcagttggcctcccttcttcccatggaggacgggggcttaacagcctttgaagaggaccagagatgcctttcccagagcctccccttgccagtgtcagcagagggcccagctgcacagaccactgctgagcccagcaggtcgttttcctcagcccacagacacctgagcagaaggaatgggctttccagactctgccagagcaggacagcgctctctgaagacagatggagctcctattgtctatcatcactggctgcccagaatatttgtacaagtaaactgcactgccctgctgcccctgagcacacggacccgtccgaaccgcggggcagtgtgtcctgctgctccctgctgcggggactgtcctcagggtggtcctcacctctgcttccggcccctgtgtgcaaccctaacaaggccatcttcacggtggatgccaagaccacagagatcctggttgctaacgacaaagcttgcgggctcctggggtacagcagccaggacctgattggccagaagctcacgcagttctttctgaggtcagattctgatgtggtggaggccctcagcgaggagcacatggaggccgacggccacgctgcggtggtgtttggcacggtggtggacatcatcagccgtagtggggagaagattccagtgtctgtgtggatgaagaggatgcggcaggagcgccgcctatgctgcgtggtggtcctggagcccgtggagagggtctcgacctgggtcgctttccagagcgatggcaccgtcacgtcatgtgacagtctctttgctcatcttcacgggtacgtgtctggggaggacgtggctgggcagcatatcacagacctgatcccttctgtgcagctccctccttctggccagcacatcccaaagaatctcaagattcagaggtctgttggaagagccagggacggtaccaccttccctctgagcttaaagctgaaatcccaacccagcagcgaggaggcgaccaccggtgaggcggcccctgtgagcggctaccgggcatctgtctgggtgttctgcaccatcagtggcctcatcaccctcctgccggatgggaccatccacggcatcaaccacagcttcgcgctgacactgtttggttacggaaagacggagctcctgggcaagaatatcactttcctgattcctggtttctacagctacatggaccttgcgtacaacagctcattacagctcccagacctggccagctgcctggacgtcggcaatgagagtgggtgtggggagagaaccttggacccgtggcagggccaggacccagctgaggggggccaggatccaaggattaatgtcgtgcttgctggtggccacgttgtgccccgagatgagatccggaagctgatggaaagccaagacatcttcaccgggactcagactgagctgattgctggaggccagctcctttcctgcctctcacctcagcctgctccaggggtggacaatgtcccagaaggaagcctgccagtgcacggtgaacaggcgctgcccaaggaccagcaaatcactgccttggggagagaggaacctgtggcaatagagagccccggacaggatcttctgggagaaagcaggtctgaaccagtggatgtgaagccatttgcttcctgcgaagattctgaagctccagtcccagctgaggatgggggcagtgatgctggcatgtgtggcctgtgtcagaaggcccagctagagcggatgggagtcagtggtcccagcggttcagacctttgggctggggctgccgtggccaagccccaggccaagggtcagctggcggggggcagcctcctgatgcactgcccttgctatgggagtgaatggggcttgtggtggcgaagccaggacttggcccccagcccctctgggatggcaggcctctcgtttgggacacctactctagatgagccgtggctgggagtggaaaacgaccgagaagagctgcagacctgcttgattaaggagcagctgtcccagttgagccttgcaggagccctggatgtcccccacgccgaactcgttccgacagagtgccaggctgtcaccgctcctgtgtcgtcctgcgatctgggaggcagagacctgtgcggtggctgcacgggcagctcctcagcctgctatgccttggccacggacctccctgggggcctggaagcagtggaggcccaggaggttgatgtgaattcgttttcctggaacctcaaggaactctttttcagtgaccagacagaccaaacgtcatcaaattgttcctgtgctacgtctgaactcagagagacaccctcttccttggcagtgggctccgatccagatgtaggcagtctccaggaacaggggtcgtgtgtcctggatgacagggagctgttactactgaccggcacctgtgttgaccttggccaaggccgacggttccgggagagctgtgtgggacatgatccaacagaaccgcttgaggtttgtttggtgtcctctgagcattatgcagcaagcgacagagaaagcccaggacacgttccttccacgttggatgctggccctgaggacacgtgcccatcagcagaggagccaaggctgaacgtccaggtcacctccacgcccgtgatcgtgatgcgcggggctgctggcctgcagcgggagatccaggagggtgcctactccgggagctgctaccatcgagatggcttacggctgagtatacagtttgaggtgaggcgggtggagctccagggccccacacctctgttctgctgctggctggtgaaagacctcctccacagccaacgcgactcagccgccaggacccgcctgttccttgccagcctgcccggctccacccactctaccgctgctgagctcaccggacccagcctggtggaagtgctcagagccagaccctggtttgaggagccccccaaggctgtggaactggaggggttggcggcctgtgagggcgagtactcccaaaagtacagtaccatgagcccgctgggcagtggggccttcggcttcgtgtggactgctgtggacaaggaaaaaaacaaggaggtggtggtgaagtttattaagaaggagaaggtcttggaggattgttggattgaggatcccaaacttgggaaagttactttagagatcgcaattctatccagggtggagcacgccaatatcatcaaggtattggatatatttgaaaaccaagggttcttccagcttgtgatggagaagcacggctccggcctagacctcttcgctttcatcgaccgccaccccaggctggatgagcccctggcgagctacatcttccgacaactagtgtcagcagtgggatacctgcgcttgaaggacatcatccaccgtgacatcaaggatgagaacatcgtgatcgccgaggacttcacaatcaagctgatagactttggctcggccgcctacttggaaaggggaaaattattttatactttttgtgggaccatcgagtactgtgcaccggaagttctcatggggaatccctacagagggccggagctggagatgtggtctctgggagtcactctgtacacgctggtctttgaggagaaccccttctgtgagctggaggagaccgtggaggctgccatacacccgccatacctggtgtccaaagaactcatgagccttgtgtctgggctgctgcagccagtccctgagagacgcaccaccttggagaagctggtgacagacccgtgggtaacacagcctgtgaatcttgctgactatacatgggaagaggtgtttcgagtaaacaagccagaaagtggagttctgtccgctgcgagcctggagatggggaacaggagcctgagtgatgtggcccaggctcaggagctttgtgggggccccgttccaggcgaggctcctaatggccaaggctgtttgcatcccggggatccccgtctgctgaccagctaaacaccaatttcttcctgcttttctccacttggtttggaaaatcacacagttttcaggctccatctgtttggagaaaatacattctgaagcatccccaattcaccttctaaaaactcatgtgcaggtttgataaacaccagaacagaagacagtgatgctgtattattttagatttattacatagatttggaattcacttttttcatgacctagaaaaaaacattccagtgttcaactgttttatattattaaagggcttttaatttgtgaacttctgaaggcatgagtgttttctctttctacttttgtatatgtgcatgttttgtttcctctgacttggtatatgctcatctgagtgacggatatgtgaaatttgtagaactggttagtcaaatggccagactatttcattaatttatttcctcaaatgcttttcaaattaaagcacctttgttagtaaacagtta

SEQ ID NO: 163854 - DNA, 4326 bp, Homo sapiens
  Payload ID: 12264
  Gene Symbol: PASK
  Gene Name: PAS domain containing serine/threonine kinase
  Uniprot ID: Q96RG2
  ENST ID: ENST00000358649
  CDS Start-End: 65-4057
gcgtgaccctcgcctgatccagttgttagagttggaagcttggcagttggcctcccttcttcccatggaggacgggggcttaacagcctttgaagaggaccagagatgcctttcccagagcctccccttgccagtgtcagcagagggcccagctgcacagaccactgctgagcccagcaggtcgttttcctcagcccacagacacctgagcagaaggaatgggctttccagactctgccagagcaggacagcgctctctgaagacagatggagctcctattgtctatcatcactggctgcccagaatatttgtacaagtaaactgcactgccctgctgcccctgagcacacggacccgtccgaaccgcggggcagtgtgtcctgctgctccctgctgcggggactgtcctcagggtggtcctcacctctgcttccggcccctgtgtgcaaccctaacaaggccatcttcacggtggatgccaagaccacagagatcctggttgctaacgacaaagcttgcgggctcctggggtacagcagccaggacctgattggccagaagctcacgcagttctttctgaggtcagattctgatgtggtggaggccctcagcgaggagcacatggaggccgacggccacgctgcggtggtgtttggcacggtggtggacatcatcagccgtagtggggagaagattccagtgtctgtgtggatgaagaggatgcggcaggagcgccgcctatgctgcgtggtggtcctggagcccgtggagagggtctcgacctgggtcgctttccagagcgatggcaccgtcacgtcatgtgacagtctctttgctcatcttcacgggtacgtgtctggggaggacgtggctgggcagcatatcacagacctgatcccttctgtgcagctccctccttctggccagcacatcccaaagaatctcaagattcagaggtctgttggaagagccagggacggtaccaccttccctctgagcttaaagctgaaatcccaacccagcagcgaggaggcgaccaccggtgaggcggcccctgtgagcggctaccgggcatctgtctgggtgttctgcaccatcagtggcctcatcaccctcctgccggatgggaccatccacggcatcaaccacagcttcgcgctgacactgtttggttacggaaagacggagctcctgggcaagaatatcactttcctgattcctggtttctacagctacatggaccttgcgtacaacagctcattacagctcccagacctggccagctgcctggacgtcggcaatgagagtgggtgtggggagagaaccttggacccgtggcagggccaggacccagctgaggggggccaggatccaaggattaatgtcgtgcttgctggtggccacgttgtgccccgagatgagatccggaagctgatggaaagccaagacatcttcaccgggactcagactgagctgattgctggaggccagctcctttcctgcctctcacctcagcctgctccaggggtggacaatgtcccagaaggaagcctgccagtgcacggtgaacaggcgctgcccaaggaccagcaaatcactgccttggggagagaggaacctgtggcaatagagagccccggacaggatcttctgggagaaagcaggtctgaaccagtggatgtgaagccatttgcttcctgcgaagattctgaagctccagtcccagctgaggatgggggcagtgatgctggcatgtgtggcctgtgtcagaaggcccagctagagcggatgggagtcagtggtcccagcggttcagacctttgggctggggctgccgtggccaagccccaggccaagggtcagctggcggggggcagcctcctgatgcactgcccttgctatgggagtgaatggggcttgtggtggcgaagccaggacttggcccccagcccctctgggatggcaggcctctcgtttgggacacctactctagatgagccgtggctgggagtggaaaacgaccgagaagagctgcagacctgcttgattaaggagcagctgtcccagttgagccttgcaggagccctggatgtcccccacgccgaactcgttccgacagagtgccaggctgtcaccgctcctgtgtcgtcctgcgatctgggaggcagagacctgtgcggtggctgcacgggcagctcctcagcctgctatgccttggccacggacctccctgggggcctggaagcagtggaggcccaggaggttgatgtgaattcgttttcctggaacctcaaggaactctttttcagtgaccagacagaccaaacgtcatcaaattgttcctgtgctacgtctgaactcagagagacaccctcttccttggcagtgggctccgatccagatgtaggcagtctccaggaacaggggtcgtgtgtcctggatgacagggagctgttactactgaccggcacctgtgttgaccttggccaaggccgacggttccgggagagctgtgtgggacatgatccaacagaaccgcttgaggtttgtttggtgtcctctgagcattatgcagcaagcgacagagaaagcccaggacacgttccttccacgttggatgctggccctgaggacacgtgcccatcagcagaggagccaaggctgaacgtccaggtcacctccacgcccgtgatcgtgatgcgcggggctgctggcctgcagcgggagatccaggagggtgcctactccgggagctgctaccatcgagatggcttacggctgagtatacagtttgaggtgaggcgggtggagctccagggccccacacctctgttctgctgctggctggtgaaagacctcctccacagccaacgcgactcagccgccaggacccgcctgttccttgccagcctgcccggctccacccactctaccgctgctgagctcaccggacccagcctggtggaagtgctcagagccagaccctggtttgaggagccccccaaggctgtggaactggaggggttggcggcctgtgagggcgagtactcccaaaagtacagtaccatgagcccgctgggcagtggggccttcggcttcgtgtggactgctgtggacaaggaaaaaaacaaggaggtggtggtgaagtttattaagaaggagaaggtcttggaggattgttggattgaggatcccaaacttgggaaagttactttagagatcgcaattctatccagggtggagcacgccaatatcatcaaggtattggatatatttgaaaaccaagggttcttccagcttgtgatggagaagcacggctccggcctagacctcttcgctttcatcgaccgccaccccaggctggatgagcccctggcgagctacatcttccgacaagtgagagcaggccagagccgtctagtgtcagcagtgggatacctgcgcttgaaggacatcatccaccgtgacatcaaggatgagaacatcgtgatcgccgaggacttcacaatcaagctgatagactttggctcggccgcctacttggaaaggggaaaattattttatactttttgtgggaccatcgagtactgtgcaccggaagttctcatggggaatccctacagagggccggagctggagatgtggtctctgggagtcactctgtacacgctggtctttgaggagaaccccttctgtgagctggaggagaccgtggaggctgccatacacccgccatacctggtgtccaaagaactcatgagccttgtgtctgggctgctgcagccagtccctgagagacgcaccaccttggagaagctggtgacagacccgtgggtaacacagcctgtgaatcttgctgactatacatgggaagaggtgtttcgagtaaacaagccagaaagtggagttctgtccgctgcgagcctggagatggggaacaggagcctgagtgatgtggcccaggctcaggagctttgtgggggccccgttccaggcgaggctcctaatggccaaggctgtttgcatcccggggatccccgtctgctgaccagctaaacaccaatttcttcctgcttttctccacttggtttggaaaatcacacagttttcaggctccatctgtttggagaaaatacattctgaagcatccccaattcaccttctaaaaactcatgtgcaggtttgataaacaccagaacagaagacagtgatgctgtattattttagatttattacatagatttggaattcacttttttcatgacctagaaaaaaacattccagtgttcaactgttttatattattaaagggcttttaatttgtg

SEQ ID NO: 163855 - DNA, 4942 bp, Homo sapiens
  Payload ID: 12264
  Gene Symbol: PASK
  Gene Name: PAS domain containing serine/threonine kinase
  Uniprot ID: Q96RG2
  ENST ID: ENST00000405260
  CDS Start-End: 700-4671
gagaagctgggaaggaaagcagagggagtcgaagcgggacgcacagagccgtagctgcaggcagacggagtggacgtctaggcagagtggagagacgccctgggcttgagagttgacttatgtcactgtctcgacctcggaggcgtggaggggccgcgggccaggcggatctttccgtggctgcaaggtgcgggccagtcctacgtgcatccctgacctctgcgagcctcgctggctgcgtctgtacaatgggccgaacggcaagagcaacaacattctcccggcgtccccgcgcggattttacccatgcgaaatgccgccttctcttgacgctcggagcaggcgggcaggtgcggggcacttgcgctggtggggccgctagccagctggctggctccggggcgccagctgggctccccttgcaagtcgttcccagcccagtgcggacgctgcagccttcgtctaccctgcggagccacccggcccatgaacgagccgccccgcgtcctccgccttcagaaagaggcctccaagaggcgagctctgcgctactcacccattttgatcgcgagtcgggaggaaaccgcatctgcccggcccgggggcggaggcgcccattattcctttggctcctccgaagcgccgtaggggtgtttgttgttagagttggaagcttggcagttggcctcccttcttcccatggaggacgggggcttaacagcctttgaagaggaccagagatgcctttcccagagcctccccttgccagtgtcagcagagggcccagctgcacagaccactgctgagcccagcaggtcgttttcctcagcccacagacacctgagcagaaggaatgggctttccagactctgccagagcaggacagcgctctctgaagacagatggagctcctattgtctatcatcactggctgcccagaatatttgtacaagtaaactgcactgccctgctgcccctgagcacacggacccgtccgaaccgcggggcagtgtgtcctgctgctccctgctgcggggactgtcctcagggtggtcctcacctctgcttccggcccctgtgtgcaaccctaacaaggccatcttcacggtggatgccaagaccacagagatcctggttgctaacgacaaagcttgcgggctcctggggtacagcagccaggacctgattggccagaagctcacgcagttctttctgaggtcagattctgatgtggtggaggccctcagcgaggagcacatggaggccgacggccacgctgcggtggtgtttggcacggtggtggacatcatcagccgtagtggggagaagattccagtgtctgtgtggatgaagaggatgcggcaggagcgccgcctatgctgcgtggtggtcctggagcccgtggagagggtctcgacctgggtcgctttccagagcgatggcaccgtcacgtcatgtgacagtctctttgctcatcttcacgggtacgtgtctggggaggacgtggctgggcagcatatcacagacctgatcccttctgtgcagctccctccttctggccagcacatcccaaagaatctcaagattcagaggtctgttggaagagccagggacggtaccaccttccctctgagcttaaagctgaaatcccaacccagcagcgaggaggcgaccaccggtgaggcggcccctgtgagcggctaccgggcatctgtctgggtgttctgcaccatcagtggcctcatcaccctcctgccggatgggaccatccacggcatcaaccacagcttcgcgctgacactgtttggttacggaaagacggagctcctgggcaagaatatcactttcctgattcctggtttctacagctacatggaccttgcgtacaacagctcattacagctcccagacctggccagctgcctggacgtcggcaatgagagtgggtgtggggagagaaccttggacccgtggcagggccaggacccagctgaggggggccaggatccaaggattaatgtcgtgcttgctggtggccacgttgtgccccgagatgagatccggaagctgatggaaagccaagacatcttcaccgggactcagactgagctgattgctggaggccagctcctttcctgcctctcacctcagcctgctccaggggtggacaatgtcccagaaggaagcctgccagtgcacggtgaacaggcgctgcccaaggaccagcaaatcactgccttggggagagaggaacctgtggcaatagagagccccggacaggatcttctgggagaaagcaggtctgaaccagtggatgtgaagccatttgcttcctgcgaagattctgaagctccagtcccagctgaggatgggggcagtgatgctggcatgtgtggcctgtgtcagaaggcccagctagagcggatgggagtcagtggtcccagcggttcagacctttgggctggggctgccgtggccaagccccaggccaagggtcagctggcggggggcagcctcctgatgcactgcccttgctatgggagtgaatggggcttgtggtggcgaagccaggacttggcccccagcccctctgggatggcaggcctctcgtttgggacacctactctagatgagccgtggctgggagtggaaaacgaccgagaagagctgcagacctgcttgattaaggagcagctgtcccagttgagccttgcaggagccctggatgtcccccacgccgaactcgttccgacagagtgccaggctgtcaccgctcctgtgtcgtcctgcgatctgggaggcagagacctgtgcggtggctgcacgggcagctcctcagcctgctatgccttggccacggacctccctgggggcctggaagcagtggaggcccaggaggttgatgtgaattcgttttcctggaacctcaaggaactctttttcagtgaccagacagaccaaacgtcatcaaattgttcctgtgctacgtctgaactcagagagacaccctcttccttggcagtgggctccgatccagatgtaggcagtctccaggaacaggggtcgtgtgtcctggatgacagggagctgttactactgaccggcacctgtgttgaccttggccaaggccgacggttccgggagagctgtgtgggacatgatccaacagaaccgcttgaggtttgtttggtgtcctctgagcattatgcagcaagcgacagagaaagcccaggacacgttccttccacgttggatgctggccctgaggacacgtgcccatcagcagaggagccaaggctgaacgtccaggtcacctccacgcccgtgatcgtgatgcgcggggctgctggcctgcagcgggagatccaggagggtgcctactccgggagctgctaccatcgagatggcttacggctgagtatacagtttgaggtgaggcgggtggagctccagggccccacacctctgttctgctgctggctggtgaaagacctcctccacagccaacgcgactcagccgccaggacccgcctgttccttgccagcctgcccggctccacccactctaccgctgctgagctcaccggacccagcctggtggaagtgctcagagccagaccctggtttgaggagccccccaaggctgtggaactggaggggttggcggcctgtgagggcgagtactcccaaaagtacagtaccatgagcccgctgggcagtggggccttcggcttcgtgtggactgctgtggacaaggaaaaaaacaaggaggtggtggtgaagtttattaagaaggagaaggtcttggaggattgttggattgaggatcccaaacttgggaaagttactttagagatcgcaattctatccagggtggagcacgccaatatcatcaaggtattggatatatttgaaaaccaagggttcttccagcttgtgatggagaagcacggctccggcctagacctcttcgctttcatcgaccgccaccccaggctggatgagcccctggcgagctacatcttccgacaactagtgtcagcagtgggatacctgcgcttgaaggacatcatccaccgtgacatcaaggatgagaacatcgtgatcgccgaggacttcacaatcaagctgatagactttggctcggccgcctacttggaaaggggaaaattattttatactttttgtgggaccatcgagtactgtgcaccggaagttctcatggggaatccctacagagggccggagctggagatgtggtctctgggagtcactctgtacacgctggtctttgaggagaaccccttctgtgagctggaggagaccgtggaggctgccatacacccgccatacctggtgtccaaagaactcatgagccttgtgtctgggctgctgcagccagtccctgagagacgcaccaccttggagaagctggtgacagacccgtgggtaacacagcctgtgaatcttgctgactatacatgggaagaggtgtttcgagtaaacaagccagaaagtggagttctgtccgctgcgagcctggagatggggaacaggagcctgagtgatgtggcccaggctcaggagctttgtgggggccccgttccaggcgaggctcctaatggccaaggctgtttgcatcccggggatccccgtctgctgaccagctaaacaccaatttcttcctgcttttctccacttggtttggaaaatcacacagttttcaggctccatctgtttggagaaaatacattctgaagcatccccaattcaccttctaaaaactcatgtgcaggtttgataaacaccagaacagaagacagtgatgctgtattattttagatttattacatagatttggaattcacttttttcatgacctagaaaaaaacattccagtgttcaactgttttatattattaaagggcttttaatttgtgaa

SEQ ID NO: 163856 - DNA, 5161 bp, Homo sapiens
  Payload ID: 12264
  Gene Symbol: PASK
  Gene Name: PAS domain containing serine/threonine kinase
  Uniprot ID: Q96RG2
  ENST ID: ENST00000403638
  CDS Start-End: 93-3524
ctcctttccgtggtgtgtagccggcttggcgtgaccctcgcctgatccagttgttagagttggaagcttggcagttggcctcccttcttcccatggaggacgggggcttaacagcctttgaagaggaccagagatgcctttcccagagcctccccttgccagtgtcagcagagggcccagctgcacagaccactgctgagcccagcaggtcgttttcctcagcccacagacacctgagcagaaggaatgggctttccagactctgccagagcaggacagcgctctctgaagacagatggagctcctattgtctatcatcactggctgcccagaatatttgtacaagtaaactgcactgccctgctgcccctgagcacacggacccgtccgaaccgcggggcagtgtgtcctgctgctccctgctgcggggactgtcctcagggtggtcctcacctctgcttccggcccctgtgtgcaaccctaacaaggccatcttcacggtggatgccaagaccacagagatcctggttgctaacgacaaagcttgcgggctcctggggtacagcagccaggacctgattggccagaagctcacgcagttctttctgaggtcagattctgatgtggtggaggccctcagcgaggagcacatggaggccgacggccacgctgcggtggtgtttggcacggtggtggacatcatcagccgtagtggggagaagattccagtgtctgtgtggatgaagaggatgcggcaggagcgccgcctatgctgcgtggtggtcctggagcccgtggagagggtctcgacctgggtcgctttccagagcgatggcaccgtcacgtcatgtgacagtctctttgctcatcttcacgggtacgtgtctggggaggacgtggctgggcagcatatcacagacctgatcccttctgtgcagctccctccttctggccagcacatcccaaagaatctcaagattcagaggtctgttggaagagccagggacggtaccaccttccctctgagcttaaagctgaaatcccaacccagcagcgaggaggcgaccaccggtgaggcggcccctgtgagcggctaccgggcatctgtctgggtgttctgcaccatcagtggcctcatcaccctcctgccggatgggaccatccacggcatcaaccacagcttcgcgctgacactgtttggttacggaaagacggagctcctgggcaagaatatcactttcctgattcctggtttctacagctacatggaccttgcgtacaacagctcattacagctcccagacctggccagctgcctggacgtcggcaatgagagtgggtgtggggagagaaccttggacccgtggcagggccaggacccagctgaggggggccaggatccaaggattaatgtcgtgcttgctggtggccacgttgtgccccgagatgagatccggaagctgatggaaagccaagacatcttcaccgggactcagactgagctgattgctggaggccagctcctttcctgcctctcacctcagcctgctccaggggtggacaatgtcccagaaggaagcctgccagtgcacggtgaacaggcgctgcccaaggaccagcaaatcactgccttggggagagaggaacctgtggcaatagagagccccggacaggatcttctgggagaaagcaggtctgaaccagtggatgtgaagccatttgcttcctgcgaagattctgaagctccagtcccagctgaggatgggggcagtgatgctggcatgtgtggcctgtgtcagaaggcccagctagagcggatgggagtcagtggtcccagcggttcagacctttgggctggggctgccgtggccaagccccaggccaagggtcagctggcggggggcagcctcctgatgcactgcccttgctatgggagtgaatggggcttgtggtggcgaagccaggacttggcccccagcccctctgggatggcaggcctctcgtttgggacacctactctagatgagccgtggctgggagtggaaaacgaccgagaagagctgcagacctgcttgattaaggagcagctgtcccagttgagccttgcaggagccctggatgtcccccacgccgaactcgttccgacagagtgccaggctgtcaccgctcctgtgtcgtcctgcgatctgggaggcagagacctgtgcggtggctgcacgggcagctcctcagcctgctatgccttggccacggacctccctgggggcctggaagcagtggaggcccaggaggttgatgtgaattcgttttcctggaacctcaaggaactctttttcagtgaccagacagaccaaacgtcatcaaattgttcctgtgctacgtctgaactcagagagacaccctcttccttggcagtgggctccgatccagatgtaggcagtctccaggaacaggggtcgtgtgtcctggatgacagggagctgttactactgaccggcacctgtgttgaccttggccaaggccgacggttccgggagagctgtgtgggacatgatccaacagaaccgcttgaggtttgtttggtgtcctctgagcattatgcagcaagcgacagagaaagcccaggacacgttccttccacgttggatgctggccctgaggacacgtgcccatcagcagaggagccaaggctgaacgtccaggtcacctccacgcccgtgatcgtgatgcgcggggctgctggcctgcagcgggagatccaggagggtgcctactccgggagctgctaccatcgagatggcttacggctgagtatacagtttgaggtgaggcgggtggagctccagggccccacacctctgttctgctgctggctggtgaaagacctcctccacagccaacgcgactcagccgccaggacccgcctgttccttgccagcctgcccggctccacccactctaccgctgctgagctcaccggacccagcctggtggaagtgctcagagccagaccctggtttgaggagccccccaaggctgtggaactggaggggttggcggcctgtgagggcgagtactcccaaaagtacagtaccatgagcccgctgggcagtggggccttcggcttcgtgtggactgctgtggacaaggaaaaaaacaaggaggtggtggtgaagtttattaagaaggagaaggtcttggaggattgttggattgaggatcccaaacttgggaaagttactttagagatcgcaattctatccagggtggagcacgccaatatcatcaaggtattggatatatttgaaaaccaagggttcttccagcttgtgatggagaagcacggctccggcctagacctcttcgctttcatcgaccgccaccccaggctggatgagcccctggcgagctacatcttccgacaagtgagagcaggccagagccgtgttagtgtgaacgcaggcctgggtgcctgggtccggtggctgcaaagatcagtgatccatactcggttctctctctgagctggatctagccttctgtgtggggatttcatggagtaggatatatattttgagaagaaaattctatgattgaagtagagaaagtgaggttgggaaggaaggatgaggccagatacagtcctggaatgactgagaaagtatgtttaatggttaaggtttatttacatacataaaatatccacaacaatcataaaaattaaccagtaagggttaggatgcagccagagagcgtctcaaaggcatgtgtgcggcacagcggcctgcaggttgtaagtgcccactaaatggtggctgttgaggtaattaaccagcaaaactgagatcctgacattctcacttttcagtaagtatttgtcttgatctgtttcgtgtctaattacatattgaacttcggccattattttattggaatgggagagtgatgatccaaataggaaggcaccctagcagagggacagggggaagaaacggtaactcgtgttgggttttaaggagagggtggcggttccatcctgtactgctcccagctcccccagaagaactggagaaataccagcaaagggctgtgtagacaactcacatttgctcttggattgtttgctggggacaactcgatttctaatgacagcttccgtgaatcaacatttcttccttaaagctacacactctcgggttgttgggtttccgaagtttagtttctcaggctcctacttgtaagtttcagatattatggttctgcaaaaaagggtcacctctctccctcttcctgtgttggaaggtgacgtcctccctttagtttgtggccaacacttgtttctgaaactttttacagcaaacagagtatctgtatgaggttatgttgagggtcgcttgttaaaagctgctgcctgacagctgttaattctggggctagtgagacacataattatggtgtttatactctaaaatttttgccaaaagaatctctaccccttttgtaaatatatagacataaatgttattctatgtaaatacagatgcacaattttataaagtatatgatcgcacatcaatgtatgtaggaatcatgctggttctcagggcattgcctgtcagctccagattcatcaggacctgctcagcagcggggtcggggagctgggcctgggaacagccctggcttggttcaggccgctccagggcagcatggccagtccagggcacagaagcatctgcaggaagagcagctttcttcaagtcgctctttagccctttgtggttaatctctcagtactagttaataaatcttaatgaaactttccatgttcaagttcatgtgtgatttctgtctcctgattggatcctgactgatttgtatatatctacatatatatgtaagtatgtatgcatgcatgcttgtatatgtgtatttatgtgtgtacctatgtacaagtatatgttatgtgtataggtatgcacacgtgtgtatgcaggtgtgtatatatgtgcacatgtatgtatctaaatgtatgtataaatatgcaggtatgtatatataaatatgcaggtatgtatatataaatatgcaggtatgtatatgtttgtatatatgtgtataaatatgcgtatatttattaaatgtaagttaatcgggctta

SEQ ID NO: 163857 - DNA, 578 bp, Homo sapiens
  Payload ID: 12264
  Gene Symbol: PASK
  Gene Name: PAS domain containing serine/threonine kinase
  ENST ID: ENST00000433589
  CDS Start-End: 1-578
taatgttttgcagtcctgccgggcagcacatcagatgctcaagagtggacatcatcagccgtagtggggagaagattccagtgtctgtgtggatgaagaggatgcggcaggagcgccgcctatgctgcgtggtggtcctggagcccgtggagagggtctcgacctgggtcgctttccagagcgatggcaccgtcacgtcatgtgacagtctctttgctcatcttcacgggtacgtgtctggggaggacgtggctgggcagcatatcacagacctgatcccttctgtgcagctccctccttctggccagcacatcccaaagaatctcaagattcagaggtctgttggaagagccagggacggtaccaccttccctctgagcttaaagctgaaatcccaacccagcagcgaggaggcgaccaccggtgaggcggcccctgtgagcggctaccgggcatctgtctgggtgttctgcaccatcagtggcctcatcaccctcctgccggatgggaccatccacggcatcaaccacagcttcgcgctgacactgtttggttacggaaagacggagctcctgggc

SEQ ID NO: 163858 - DNA, 565 bp, Homo sapiens
  Payload ID: 12264
  Gene Symbol: PASK
  Gene Name: PAS domain containing serine/threonine kinase
  ENST ID: ENST00000452907
  CDS Start-End: 190-565
gtgtagccggcttggcgtgaccctcgcctgatccaggttgtgtcgccaggctggagggcagtggtgtcatctcggctcattacaacctccacctcccaggttcaagcgattctcctgcctctgcctccagagtagctgggaatacagttgttagagttggaagcttggcagttggcctcccttcttcccatggaggacgggggcttaacagcctttgaagaggaccagagatgcctttcccagagcctccccttgccagtgtcagcagagggcccagctgcacagaccactgctgagcccagcaggtcgttttcctcagcccacagacacctgagcagaaggaatgggctttccagactctgccagagcaggacagcgctctctgaagacagatggagctcctattgtctatcatcactggctgcccagaatatttgtacaagtaaactgcactgccctgctgcccctgagcacacggacccgtccgaaccgcggggcagtgtgtcctgctgctccctgctgcggggactgtcctcagggtggtcctcacctctgcttccggccc

SEQ ID NO: 163859 - DNA, 538 bp, Homo sapiens
  Payload ID: 12264
  Gene Symbol: PASK
  Gene Name: PAS domain containing serine/threonine kinase
  ENST ID: ENST00000415234
  CDS Start-End: 117-538
gataaaagcgcggaagggctcctttccgtggtgtgtagccggcttggcgtgaccctcgcctgatccaggtggacatcatcagccgtagtggggagaagattccagtgtctgtgtggatgaagaggatgcggcaggagcgccgcctatgctgcgtggtggtcctggagcccgtggagagggtctcgacctgggtcgctttccagagcgatggcaccgtcacgtcatgtgacagtctctttgctcatcttcacgggtacgtgtctggggaggacgtggctgggcagcatatcacagacctgatcccttctgtgcagctccctccttctggccagcacatcccaaagaatctcaagattcagaggtctgttggaagagccagggacggtaccaccttccctctgagcttaaagctgaaatcccaacccagcagcgaggaggcgaccaccggtgaggcggcccctgtgagcggctaccgggcatctgtctgggtgttctgcaccatcagtggcctcatcaccctcctgccggatgggaccat

SEQ ID NO: 163860 - DNA, 1009 bp, Homo sapiens
  Payload ID: 12264
  Gene Symbol: PASK
  Gene Name: PAS domain containing serine/threonine kinase
  ENST ID: ENST00000437780
  CDS Start-End: 113-328
gggataaaagcgcggaagggctcctttccgtggtgtgtagccggcttggcgtgaccctcgcctgatccagttgttagagttggaagcttggcagttggcctcccttcttcccatggaggacgggggcttaacagcctttgaagaggaccagagatgcctttcccagagcctccccttgccagtgtcagcagagggcccagctgcacagaccactgctgagcccagcaggtcgttttcctcagcccacagacacctgagcagaaggaatgggctttccagactctgccagagcaggacagcgctctctggtggacatcatcagccgtagtggggagaagattccagtgtctgtgtggatgaagaggatgcggcaggagcgccgcctatgctgcgtggtggtcctggagcccgtggagagggtctcgacctgggtcgctttccagagcgatggcaccgtcacgtcatgtgacagtctctttgctcatcttcacgggtacgtgtctggggaggacgtggctgggcagcatatcacagacctgatcccttctgtgcagctccctccttctggccagcacatcccaaagaatctcaagattcagaggtctgttggaagagccagggacggtaccaccttccctctgagcttaaagctgaaatcccaacccagcagcgaggaggcgaccaccggtgaggcggcccctgtgagcggctaccgggcatctgtctgggtgttctgcaccatcagtggcctcatcaccctcctgccggatgggaccatccacggcatcaaccacagcttcgcgctgacactgtttggttacggaaagacggagctcctgggcaagaatatcactttcctgattcctggtttctacagctacatggaccttgcgtacaacagctcattacagctcccagacctggccagctgcctggacgtcggcaatgagagtgggtgtggggagagaaccttggacccgtggcagggccaggacccagctgagggggg

SEQ ID NO: 163861 - DNA, 4724 bp, Homo sapiens
  Payload ID: 12264
  Gene Symbol: PASK
  Gene Name: PAS domain containing serine/threonine kinase
  Uniprot ID: Q96RG2
  ENST ID: ENST00000544142
  CDS Start-End: 287-4258
gtccccgcgcggattttacccatcccagtgcggacgctgcagccttcgtctaccctgcggagccacccggcccatgaacgagccgccccgcgtcctccgccttcagaaagaggcctccaagaggcgagctctgcgctactcacccattttgatcgcgagtcgggaggaaaccgcatctgcccggcccgggggcggaggcgcccattattcctttggctcctccgaagcgccgtaggggtgtttgttgttagagttggaagcttggcagttggcctcccttcttcccatggaggacgggggcttaacagcctttgaagaggaccagagatgcctttcccagagcctccccttgccagtgtcagcagagggcccagctgcacagaccactgctgagcccagcaggtcgttttcctcagcccacagacacctgagcagaaggaatgggctttccagactctgccagagcaggacagcgctctctgaagacagatggagctcctattgtctatcatcactggctgcccagaatatttgtacaagtaaactgcactgccctgctgcccctgagcacacggacccgtccgaaccgcggggcagtgtgtcctgctgctccctgctgcggggactgtcctcagggtggtcctcacctctgcttccggcccctgtgtgcaaccctaacaaggccatcttcacggtggatgccaagaccacagagatcctggttgctaacgacaaagcttgcgggctcctggggtacagcagccaggacctgattggccagaagctcacgcagttctttctgaggtcagattctgatgtggtggaggccctcagcgaggagcacatggaggccgacggccacgctgcggtggtgtttggcacggtggtggacatcatcagccgtagtggggagaagattccagtgtctgtgtggatgaagaggatgcggcaggagcgccgcctatgctgcgtggtggtcctggagcccgtggagagggtctcgacctgggtcgctttccagagcgatggcaccgtcacgtcatgtgacagtctctttgctcatcttcacgggtacgtgtctggggaggacgtggctgggcagcatatcacagacctgatcccttctgtgcagctccctccttctggccagcacatcccaaagaatctcaagattcagaggtctgttggaagagccagggacggtaccaccttccctctgagcttaaagctgaaatcccaacccagcagcgaggaggcgaccaccggtgaggcggcccctgtgagcggctaccgggcatctgtctgggtgttctgcaccatcagtggcctcatcaccctcctgccggatgggaccatccacggcatcaaccacagcttcgcgctgacactgtttggttacggaaagacggagctcctgggcaagaatatcactttcctgattcctggtttctacagctacatggaccttgcgtacaacagctcattacagctcccagacctggccagctgcctggacgtcggcaatgagagtgggtgtggggagagaaccttggacccgtggcagggccaggacccagctgaggggggccaggatccaaggattaatgtcgtgcttgctggtggccacgttgtgccccgagatgagatccggaagctgatggaaagccaagacatcttcaccgggactcagactgagctgattgctggaggccagctcctttcctgcctctcacctcagcctgctccaggggtggacaatgtcccagaaggaagcctgccagtgcacggtgaacaggcgctgcccaaggaccagcaaatcactgccttggggagagaggaacctgtggcaatagagagccccggacaggatcttctgggagaaagcaggtctgaaccagtggatgtgaagccatttgcttcctgcgaagattctgaagctccagtcccagctgaggatgggggcagtgatgctggcatgtgtggcctgtgtcagaaggcccagctagagcggatgggagtcagtggtcccagcggttcagacctttgggctggggctgccgtggccaagccccaggccaagggtcagctggcggggggcagcctcctgatgcactgcccttgctatgggagtgaatggggcttgtggtggcgaagccaggacttggcccccagcccctctgggatggcaggcctctcgtttgggacacctactctagatgagccgtggctgggagtggaaaacgaccgagaagagctgcagacctgcttgattaaggagcagctgtcccagttgagccttgcaggagccctggatgtcccccacgccgaactcgttccgacagagtgccaggctgtcaccgctcctgtgtcgtcctgcgatctgggaggcagagacctgtgcggtggctgcacgggcagctcctcagcctgctatgccttggccacggacctccctgggggcctggaagcagtggaggcccaggaggttgatgtgaattcgttttcctggaacctcaaggaactctttttcagtgaccagacagaccaaacgtcatcaaattgttcctgtgctacgtctgaactcagagagacaccctcttccttggcagtgggctccgatccagatgtaggcagtctccaggaacaggggtcgtgtgtcctggatgacagggagctgttactactgaccggcacctgtgttgaccttggccaaggccgacggttccgggagagctgtgtgggacatgatccaacagaaccgcttgaggtttgtttggtgtcctctgagcattatgcagcaagcgacagagaaagcccaggacacgttccttccacgttggatgctggccctgaggacacgtgcccatcagcagaggagccaaggctgaacgtccaggtcacctccacgcccgtgatcgtgatgcgcggggctgctggcctgcagcgggagatccaggagggtgcctactccgggagctgctaccatcgagatggcttacggctgagtatacagtttgaggtgaggcgggtggagctccagggccccacacctctgttctgctgctggctggtgaaagacctcctccacagccaacgcgactcagccgccaggacccgcctgttccttgccagcctgcccggctccacccactctaccgctgctgagctcaccggacccagcctggtggaagtgctcagagccagaccctggtttgaggagccccccaaggctgtggaactggaggggttggcggcctgtgagggcgagtactcccaaaagtacagtaccatgagcccgctgggcagtggggccttcggcttcgtgtggactgctgtggacaaggaaaaaaacaaggaggtggtggtgaagtttattaagaaggagaaggtcttggaggattgttggattgaggatcccaaacttgggaaagttactttagagatcgcaattctatccagggtggagcacgccaatatcatcaaggtattggatatatttgaaaaccaagggttcttccagcttgtgatggagaagcacggctccggcctagacctcttcgctttcatcgaccgccaccccaggctggatgagcccctggcgagctacatcttccgacaactagtgtcagcagtgggatacctgcgcttgaaggacatcatccaccgtgacatcaaggatgagaacatcgtgatcgccgaggacttcacaatcaagctgatagactttggctcggccgcctacttggaaaggggaaaattattttatactttttgtgggaccatcgagtactgtgcaccggaagttctcatggggaatccctacagagggccggagctggagatgtggtctctgggagtcactctgtacacgctggtctttgaggagaaccccttctgtgagctggaggagaccgtggaggctgccatacacccgccatacctggtgtccaaagaactcatgagccttgtgtctgggctgctgcagccagtccctgagagacgcaccaccttggagaagctggtgacagacccgtgggtaacacagcctgtgaatcttgctgactatacatgggaagaggtgtttcgagtaaacaagccagaaagtggagttctgtccgctgcgagcctggagatggggaacaggagcctgagtgatgtggcccaggctcaggagctttgtgggggccccgttccaggcgaggctcctaatggccaaggctgtttgcatcccggggatccccgtctgctgaccagctaaacaccaatttcttcctgcttttctccacttggtttggaaaatcacacagttttcaggctccatctgtttggagaaaatacattctgaagcatccccaattcaccttctaaaaactcatgtgcaggtttgataaacaccagaacagaagacagtgatgctgtattattttagatttattacatagatttggaattcacttttttcatgacctagaaaaaaacattccagtgttcaactgttttatattattaaagggcttttaatttgtgaacttctgaaggcatgagtgttttctctttctacttttgtatatgtgcatgttttgtttcctctgacttggtatatgctcatctgagtgacggatatgtgaaatttgtagaactggttagtcaaatggccagactatttcattaatttatttcctcaaatgcttttcaaattaaagcacctttgttagtaaacagtt

SEQ ID NO: 163862 - DNA, 216 bp, Homo sapiens
  Payload ID: 12264
  Gene Symbol: PASK
  Gene Name: PAS domain containing serine/threonine kinase
  ENST ID: ENST00000629419
  CDS Start-End: 1-216
atggaggacgggggcttaacagcctttgaagaggaccagagatgcctttcccagagcctccccttgccagtgtcagcagagggcccagctgcacagaccactgctgagcccagcaggtcgttttcctcagcccacagacacctgagcagaaggaatgggctttccagactctgccagagcaggacagcgctctctggtggacatcatcagccgtag

SEQ ID NO: 163863 - DNA, 1518 bp, Homo sapiens
  Payload ID: 12265
  Gene Symbol: PNPLA1
  Gene Name: patatin-like phospholipase domain containing 1
  Uniprot ID: Q8N8W4
  ENST ID: ENST00000312917
  CDS Start-End: 140-1480
gggcagtccacaatggaaggcttcttggaggaggagatgattgagctgcttctactaagatgagtatctcagagtcctcaacgtgggtgtggccgaggtgaagaaatccttcctggggcccttgtccccgtcctgtaagatggtgcagatgatgaggcagtttctgtaccgggtcctgcccgaggactcctacaaggtcaccacggggaagctccatgtgagcctcacccgcttaacggacggggagaatgtggtggtttcagagttcacgtccaaggaggagctcattgaggccctatactgcagctgcttcgtcccggtgtactgtggcctcatccccccgacttaccgcggtgtgtgggcatttctcactctgcccccacagaggtacatcgatgggggcttcacgggcatgcagccctgtgccttctggaccgacgccatcaccatctccaccttcagtgggcagcaggacatctgtccccgggactgcccggccatcttccacgacttccgcatgttcaactgctccttccagttctccctggagaacatcgccaggatgacccacgcattgttccccccggacctggtgatcctgcacgattactactaccgagggtacgaggatgcagttttgtacttgaggcggctgaatgctgtttatcttaattcttcctccaagagagtgattttcccccgggtggaagtgtactgccagatagaactcgcccttggcaatgagtgccctgaacgcagtcaaccaagccttcgagcacggcaggccagtctggaaggagccacacaacctcacaaggagtgggttcccaaaggggatggaaggggcagccatggtccgcctgtgtcccaacctgtgcagacacttgaattcacatgcgagtcacctgtttcagcaccagtctctccacttgagcagccacctgcacagccactggcctcttcaactccactttctctaagtggcatgccacctgtatcattcccagctgtgcacaagccacccagctccacacctggttcatcactgcccaccccaccacctggactgtcacctctgtcacctcagcagcaggtacaaccgtctggatcaccagccagatccctacactctcaggcacccacttcacccaggccatccctggggccttcaactgtgggggcacctcaaacactgccccgaagttctctttcagccttccctgctcagccacctgtggaggaactaggccaagaacagccccaagctgtagctcttcttgtctcttcaaaaccaaaaagcgccgtgcctctggttcatgtgaaggaaaccgtcagcaagccttatgtaacggagagccctgctgaagactcaaactgggtgaataaggtcttcaagaagaacaagcaaaagacaagtggcaccagaaaaggcttcccaagacattcgggatccaaaaaaccaagcagcaaagtgcagtgagcatgtctaatgttccttaaatcccacggagaggagca

SEQ ID NO: 163864 - DNA, 2332 bp, Homo sapiens
  Payload ID: 12265
  Gene Symbol: PNPLA1
  Gene Name: patatin-like phospholipase domain containing 1
  Uniprot ID: Q8N8W4
  ENST ID: ENST00000388715
  CDS Start-End: 140-1453
gggcagtccacaatggaaggcttcttggaggaggagatgattgagctgcttctactaagatgagtatctcagagtcctcaacgtgggtgtggccgaggtgaagaaatccttcctggggcccttgtccccgtcctgtaagatggtgcagatgatgaggcagtttctgtaccgggtcctgcccgaggactcctacaaggtcaccacggggaagctccatgtgagcctcacccgcttaacggacggggagaatgtggtggtttcagagttcacgtccaaggaggagctcattgaggccctatactgcagctgcttcgtcccggtgtactgtggcctcatccccccgacttaccgcggtgtgaggtacatcgatgggggcttcacgggcatgcagccctgtgccttctggaccgacgccatcaccatctccaccttcagtgggcagcaggacatctgtccccgggactgcccggccatcttccacgacttccgcatgttcaactgctccttccagttctccctggagaacatcgccaggatgacccacgcattgttccccccggacctggtgatcctgcacgattactactaccgagggtacgaggatgcagttttgtacttgaggcggctgaatgctgtttatcttaattcttcctccaagagagtgattttcccccgggtggaagtgtactgccagatagaactcgcccttggcaatgagtgccctgaacgcagtcaaccaagccttcgagcacggcaggccagtctggaaggagccacacaacctcacaaggagtgggttcccaaaggggatggaaggggcagccatggtccgcctgtgtcccaacctgtgcagacacttgaattcacatgcgagtcacctgtttcagcaccagtctctccacttgagcagccacctgcacagccactggcctcttcaactccactttctctaagtggcatgccacctgtatcattcccagctgtgcacaagccacccagctccacacctggttcatcactgcccaccccaccacctggactgtcacctctgtcacctcagcagcaggtacaaccgtctggatcaccagccagatccctacactctcaggcacccacttcacccaggccatccctggggccttcaactgtgggggcacctcaaacactgccccgaagttctctttcagccttccctgctcagccacctgtggaggaactaggccaagaacagccccaagctgtagctcttcttgtctcttcaaaaccaaaaagcgccgtgcctctggttcatgtgaaggaaaccgtcagcaagccttatgtaacggagagccctgctgaagactcaaactgggtgaataaggtcttcaagaagaacaagcaaaagacaagtggcaccagaaaaggcttcccaagacattcgggatccaaaaaaccaagcagcaaagtgcagtgagcatgtctaatgttccttaaatcccacggagaggagcagctttgggaactgtgttcagagagattccgaggaatagaggagagtgtaagggagtagggggtgcagtgggagattgggctttggaacagacacatccgacataaaattcctgctctgccacagctccactcagggatcatggttgggacacttgctctccctgagcctccatttcctgtaaaatggggatgataccacttcataaagttgtgagagttaaatgtgatcgatgatgtaaattgcttcatagaatgcagaatgtgtaatagctcacaataagtaggtattatgtttacatattatgtttgtatttatgctacttaaatacaaaactggacaggccaggcatggtggctcatgcctgtaatcccagcactttgggaggctgaggtaggtggaaaacctgaggtcaggagttcaagaacagcctgaccaacatggtgaaactccatctctactaaaaatacaaaaattaaccaggcttgatggtgtgcacctgtaatctcagctactcgggaggctgaggcaagagaatcgcttgaacccaggaggcagaggttgcagtgcaccaagactgcgccattgcactccagcccgggcaacaagagcgaaaccccatctcgaaaaaaaacaaaacaaaactagacaagtgagtgcctacgtgacactcaaatgttgccagcatacagttaagggccctagtcaatgtaggcctgcttcttatagctttttgactatattatgctgtctttgacttagtcagtcaacacttattgagcacctactaagtgccaaacactctcctggactctggcaaaataaaaaatgaattaaaactct

SEQ ID NO: 163865 - DNA, 1599 bp, Homo sapiens
  Payload ID: 12265
  Gene Symbol: PNPLA1
  Gene Name: patatin-like phospholipase domain containing 1
  Uniprot ID: Q8N8W4
  ENST ID: ENST00000394571
  CDS Start-End: 1-1599
atggaagaacaggtgttcaagggggacccggacacccctcactccatctccttctcgggcagtggattcctctccttctaccaggcgggggctgtggacgccctgcgggacctggccccccggatgctggaaacagcccaccgctttgcggggacatcggcaggtgctgtgatcgccgccctggccatctgcgggattgaaatggatgagtatctcagagtcctcaacgtgggtgtggccgaggtgaagaaatccttcctggggcccttgtccccgtcctgtaagatggtgcagatgatgaggcagtttctgtaccgggtcctgcccgaggactcctacaaggtcaccacggggaagctccatgtgagcctcacccgcttaacggacggggagaatgtggtggtttcagagttcacgtccaaggaggagctcattgaggccctatactgcagctgcttcgtcccggtgtactgtggcctcatccccccgacttaccgcggtgtgaggtacatcgatgggggcttcacgggcatgcagccctgtgccttctggaccgacgccatcaccatctccaccttcagtgggcagcaggacatctgtccccgggactgcccggccatcttccacgacttccgcatgttcaactgctccttccagttctccctggagaacatcgccaggatgacccacgcattgttccccccggacctggtgatcctgcacgattactactaccgagggtacgaggatgcagttttgtacttgaggcggctgaatgctgtttatcttaattcttcctccaagagagtgattttcccccgggtggaagtgtactgccagatagaactcgcccttggcaatgagtgccctgaacgcagtcaaccaagccttcgagcacggcaggccagtctggaaggagccacacaacctcacaaggagtgggttcccaaaggggatggaaggggcagccatggtccgcctgtgtcccaacctgtgcagacacttgaattcacatgcgagtcacctgtttcagcaccagtctctccacttgagcagccacctgcacagccactggcctcttcaactccactttctctaagtggcatgccacctgtatcattcccagctgtgcacaagccacccagctccacacctggttcatcactgcccaccccaccacctggactgtcacctctgtcacctcagcagcaggtacaaccgtctggatcaccagccagatccctacactctcaggcacccacttcacccaggccatccctggggccttcaactgtgggggcacctcaaacactgccccgaagttctctttcagccttccctgctcagccacctgtggaggaactaggccaagaacagccccaagctgtagctcttcttgtctcttcaaaaccaaaaagcgccgtgcctctggttcatgtgaaggaaaccgtcagcaagccttatgtaacggagagccctgctgaagactcaaactgggtgaataaggtcttcaagaagaacaagcaaaagacaagtggcaccagaaaaggcttcccaagacattcgggatccaaaaaaccaagcagcaaagtgcagtga

SEQ ID NO: 163866 - DNA, 1602 bp, Homo sapiens
  Payload ID: 12265
  Gene Symbol: PNPLA1
  Gene Name: patatin-like phospholipase domain containing 1
  ENST ID: ENST00000457797
  CDS Start-End: 1-1602
atggaagaacaggtgttcaagggggacccggacacccctcactccatctccttctcgggcagtggattcctctccttctaccaggcgggggctgtggacgccctgcgggacctggccccccggatgctggaaacagcccaccgctttgcggggacatcggcaggtgctgtgatcgccgccctggccatctgcgggattgaaatggatgagtatctcagagtcctcaacgtgggtgtggccgaggtgaagaaatccttcctggggcccttgtccccgtcctgtaagatggtgcagatgatgaggcagtttctgtaccgggtcctgcccgaggactcctacaaggtcaccacggggaagctccatgtgagcctcacccgcttaacggacggggagaatgtggtggtttcagagttcacgtccaaggaggagctcattgaggcagccctatactgcagctgcttcgtcccggtgtactgtggcctcatccccccgacttaccgcggtgtgaggtacatcgatgggggcttcacgggcatgcagccctgtgccttctggaccgacgccatcaccatctccaccttcagtgggcagcaggacatctgtccccgggactgcccggccatcttccacgacttccgcatgttcaactgctccttccagttctccctggagaacatcgccaggatgacccacgcattgttccccccggacctggtgatcctgcacgattactactaccgagggtacgaggatgcagttttgtacttgaggcggctgaatgctgtttatcttaattcttcctccaagagagtgattttcccccgggtggaagtgtactgccagatagaactcgcccttggcaatgagtgccctgaacgcagtcaaccaagccttcgagcacggcaggccagtctggaaggagccacacaacctcacaaggagtgggttcccaaaggggatggaaggggcagccatggtccgcctgtgtcccaacctgtgcagacacttgaattcacatgcgagtcacctgtttcagcaccagtctctccacttgagcagccacctgcacagccactggcctcttcaactccactttctctaagtggcatgccacctgtatcattcccagctgtgcacaagccacccagctccacacctggttcatcactgcccaccccaccacctggactgtcacctctgtcacctcagcagcaggtacaaccgtctggatcaccagccagatccctacactctcaggcacccacttcacccaggccatccctggggccttcaactgtgggggcacctcaaacactgccccgaagttctctttcagccttccctgctcagccacctgtggaggaactaggccaagaacagccccaagctgtagctcttcttgtctcttcaaaaccaaaaagcgccgtgcctctggttcatgtgaaggaaaccgtcagcaagccttatgtaacggagagccctgctgaagactcaaactgggtgaataaggtcttcaagaagaacaagcaaaagacaagtggcaccagaaaaggcttcccaagacattcgggatccaaaaaaccaagcagcaaagtgcagtga

SEQ ID NO: 163867 - DNA, 2428 bp, Homo sapiens
  Payload ID: 12266
  Gene Symbol: PNPLA2
  Gene Name: patatin-like phospholipase domain containing 2
  Uniprot ID: Q96AD5
  ENST ID: ENST00000336615
  CDS Start-End: 203-1717
gcggccccagtcagacgcaggcagccccaaagcctgaacaggcagggccagacccagcttcttcgcctccgccagcggggaccccgagctagagccgcagcgggacctgcccggcccccggctccagcgagcgagcggcgagcaggcggctcacagaggcctggccgcccacggaacccggggcccggcggccgccgccgcgatgtttccccgcgagaagacgtggaacatctcgttcgcgggctgcggcttcctcggcgtctactacgtcggcgtggcctcctgcctccgcgagcacgcgcccttcctggtggccaacgccacgcacatctacggcgcctcggccggggcgctcacggccacggcgctggtcaccggggtctgcctgggtgaggctggtgccaagttcattgaggtatctaaagaggcccggaagcggttcctgggccccctgcacccctccttcaacctggtaaagatcatccgcagtttcctgctgaaggtcctgcctgctgatagccatgagcatgccagtgggcgcctgggcatctccctgacccgcgtgtcagacggcgagaatgtcattatatcccacttcaactccaaggacgagctcatccaggccaatgtctgcagcggtttcatccccgtgtactgtgggctcatccctccctccctccagggggtgcgctacgtggatggtggcatttcagacaacctgccactctatgagcttaagaacaccatcacagtgtcccccttctcgggcgagagtgacatctgtccgcaggacagctccaccaacatccacgagctgcgggtcaccaacaccagcatccagttcaacctgcgcaacctctaccgcctctccaaggccctcttcccgccggagcccctggtgctgcgagagatgtgcaagcagggataccgggatggcctgcgctttctgcagcggaacggcctcctgaaccggcccaaccccttgctggcgttgccccccgcccgcccccacggcccagaggacaaggaccaggcagtggagagcgcccaagcggaggattactcgcagctgcccggagaagatcacatcctggagcacctgcccgcccggctcaatgaggccctgctggaggcctgcgtggagcccacggacctgctgaccaccctctccaacatgctgcctgtgcgtctggccacggccatgatggtgccctacacgctgccgctggagagcgctctgtccttcaccatccgcttgctggagtggctgcccgacgttcccgaggacatccggtggatgaaggagcagacgggcagcatctgccagtacctggtgatgcgcgccaagaggaagctgggcaggcacctgccctccaggctgccggagcaggtggagctgcgccgcgtccagtcgctgccgtccgtgccgctgtcctgcgccgcctacagagaggcactgcccggctggatgcgcaacaacctctcgctgggggacgcgctggccaagtgggaggagtgccagcgccagctgctgctcggcctcttctgcaccaacgtggccttcccgcccgaagctctgcgcatgcgcgcacccgccgacccggctcccgcccccgcggacccagcatccccgcagcaccagctggccgggcctgcccccttgctgagcacccctgctcccgaggcccggcccgtgatcggggccctggggctgtgagaccccgaccctctcgaggaaccctgcctgagacgcctccattaccactgcgcagtgagatgaggggactcacagttgccaagaggggtctttgccgtgggccccctcgccagccactcaccagctgcatgcactgagaggggaggtttccacacccctcccctgggccgctgaggccccgcgcacctgtgccttaatcttccctcccctgtgctgcccgagcacctcccccgcccctttactcctgagaactttgcagctgcccttccctccccgtttttcatggcctgctgaaatatgtgtgtgaagaattatttattttcgccaaagcacatgtaataaatgctgcagcccagcctctgcccactttgtgtgtatgtgaccgcctgcttacttgcagtgagagcctggtggccagggtctggccctaccttggctgaccagcctctccacagctgcaggccaggtctcccagcgtcgcactcctgggcctggcatttggaacctgccaggctggcctgggaacacccccctacaggcacatatgaacgtactgcattcctgccgacccccctgtctaggatgcatccacaccccccccaattttgcccagcagcctcctggctgacccttggccacagccttctgagggccaatggaaatatttgggaccaagattcttggtaaataaaaacgaaaatgtttgcaaaa

SEQ ID NO: 163868 - DNA, 2724 bp, Homo sapiens
  Payload ID: 12266
  Gene Symbol: PNPLA2
  Gene Name: patatin-like phospholipase domain containing 2
  ENST ID: ENST00000617551
  CDS Start-End: 1857-2504
gcctcagtcggccccctggcttcaagatacatcaaggtccctgctacccgagccaaggacacctctcccacagtgcttccccaccctgctcccaacaagactccttctcacgggtggtcttgcacagctggagcccatagtgcagcaggtgctggctgaagagcccctggctccacactgccccactcctgaccagggtgatgcactggaggagggcttggacctcagctcctccctcagtgctcccgaccacttccagggactatccccaagctggccagcactcctgcgccccaagaggagtgtttggggtgcttcctcttggctgcagtgggacacaggtgtgccttcctaggaactgggccctgactacttccagcccaacactcccgggcctgtgaactgtgacctgtgtgccgggatgggttttgtgggtctgccccatccccgcactgctggatctggccaagtgggtgaaggctaaggccggtcagagttgagtttctgccttgtcccctctcctgggctagatgccacaccaggcccagtgactcatagggcaggcagttgggaaataccaggcagagggcaggtcctggtctcagctggccagcctctgctgtctgccatcccaggggaggtggccaaagtcccaactgtgagccaggccccacattcactgggcctcctccagggtctgtatgccatggaaccctggacatggggctatgaaggaaggtgggtgttgctaagcccaggagcatgggcccctaaccttggccctgtgccccaggtgaggctggtgccaagttcattgaggtatctaaagaggcccggaagcggttcctgggccccctgcacccctccttcaacctggtaaagatcatccgcagtttcctgctgaaggtcctgcctgctgatagccatgagcatgccagtgggcgcctgggcatctccctgacccgcgtgtcagacggcgagaatgtcattatatcccacttcaactccaaggacgagctcatccaggccaatgtctgcagcggtttcatccccgtgtactgtgggctcatccctccctccctccagggggtgcgctacgtggatggtggcatttcagacaacctgccactctatgagcttaagaacaccatcacagtgtcccccttctcgggcgagagtgacatctgtccgcaggacagctccaccaacatccacgagctgcgggtcaccaacaccagcatccagttcaacctgcgcaacctctaccgcctctccaaggccctcttcccgccggagcccctggtgctgcgagagatgtgcaagcagggataccgggatggcctgcgctttctgcagcggaacggtgcgcggacccgggcgggagagggcggggtgggctcggctctgctaccccctgcgggccgcggccgcgctgatgaactgagaatcccttctctccccaaccccaggcctcctgaaccggcccaaccccttgctggcgttgccccccgcccgcccccacggcccagaggacaaggaccaggcagtggagagcgcccaagcggaggattactcgcagctgcccggagaagatcacatcctggagcacctgcccgcccggctcaatgagggtgcgcacctgggggacgggaggggaggaggggaggcaggagggaaagagagagaggagaggacggtgagcaggggagggaagccgagcgggtcctgggccccgctgcctccactggccgccgacctcccgcccacccgcagccctgctggaggcctgcgtggagcccacggacctgctgaccaccctctccaacatgctgcctgtgcgtctggccacggccatgatggtgccctacacgctgccgctggagagcgctctgtccttcaccatccgcttgctggagtggctgcccgacgttcccgaggacatccggtggatgaaggagcagacgggcagcatctgccagtacctggtgatgcgcgccaagaggaagctgggcaggcacctgccctccaggctgccggagcaggtggagctgcgccgcgtccagtcgctgccgtccgtgccgctgtcctgcgccgcctacagagaggcactgcccggctggatgcgcaacaacctctcgctgggggacgcgctggccaagtgggaggagtgccagcgccagctgctgctcggcctcttctgcaccaacgtggccttcccgcccgaagctctgcgcatgcgcgcacccgccgacccggctcccgcccccgcggacccagcatccccgcagcaccagctggccgggcctgcccccttgctgagcacccctgctcccgaggcccggcccgtgatcgggcccggggctgtgagaccccgaccctctcgaggaaccctgcctgagacgcctccattaccactgcgcagtgagatgaggggactcacagttgccaagaggggtctttgccgtgggccccctcgccagccactcaccagctgcatgcactgagaggggaggtttccacacccctcccctgggccgctgaggccccgcgcacctgtgccttaatcttccctcccctgtgctgcccgagcacctcccccgcccctttactcctgagaactttgcagctgcccttccctccccgtttttcatggcctgctgaaatatgtgtgtgaagaattatttattttcgccaaagcacatgtaataaatgctgcagcccagc

SEQ ID NO: 163869 - DNA, 2805 bp, Homo sapiens
  Payload ID: 12267
  Gene Symbol: PNPLA3
  Gene Name: patatin-like phospholipase domain containing 3
  Uniprot ID: Q9NST1
  ENST ID: ENST00000216180
  CDS Start-End: 174-1619
atggtccgaggggggcggggctgacgtcgcgctgggaatgccctggccgagacactgaggcagggtagagagcgcttgcgggcgccgggcggagctgctgcggatcaggacccgagccgattcccgatcccgacccagatcctaacccgcgcccccgccccgccgccgccgccatgtacgacgcagagcgcggctggagcttgtccttcgcgggctgcggcttcctgggcttctaccacgtcggggcgacccgctgcctgagcgagcacgccccgcacctcctccgcgacgcgcgcatgttgttcggcgcttcggccggggcgttgcactgcgtcggcgtcctctccggtatcccgctggagcagactctgcaggtcctctcagatcttgtgcggaaggccaggagtcggaacattggcatcttccatccatccttcaacttaagcaagttcctccgacagggtctctgcaaatgcctcccggccaatgtccaccagctcatctccggcaaaataggcatctctcttaccagagtgtctgatggggaaaacgttctggtgtctgactttcggtccaaagacgaagtcgtggatgccttggtatgttcctgcttcatccccttctacagtggccttatccctccttccttcagaggcgtgcgatatgtggatggaggagtgagtgacaacgtacccttcattgatgccaaaacaaccatcaccgtgtcccccttctatggggagtacgacatctgccctaaagtcaagtccacgaactttcttcatgtggacatcaccaagctcagtctacgcctctgcacagggaacctctaccttctctcgagagcttttgtccccccggatctcaaggtgctgggagagatatgccttcgaggatatttggatgcattcaggttcttggaagagaagggcatctgcaacaggccccagccaggcctgaagtcatcctcagaagggatggatcctgaggtcgccatgcccagctgggcaaacatgagtctggattcttccccggagtcggctgccttggctgtgaggctggagggagatgagctgctagaccacctgcgtctcagcatcctgccctgggatgagagcatcctggacaccctctcgcccaggctcgctacagcactgagtgaagaaatgaaagacaaaggtggatacatgagcaagatttgcaacttgctacccattaggataatgtcttatgtaatgctgccctgtaccctgcctgtggaatctgccattgcgattgtccagagactggtgacatggcttccagatatgcccgacgatgtcctgtggttgcagtgggtgacctcacaggtgttcactcgagtgctgatgtgtctgctccccgcctccaggtcccaaatgccagtgagcagccaacaggcctccccatgcacacctgagcaggactggccctgctggactccctgctcccccaagggctgtccagcagagaccaaagcagaggccaccccgcggtccatcctcaggtccagcctgaacttcttcttgggcaataaagtacctgctggtgctgaggggctctccacctttcccagtttttcactagagaagagtctgtgagtcacttgaggaggcgagtctagcagattctttcagaggtgctaaagtttcccatctttgtgcagctacctccgcattgctgtgtagtgacccctgcctgtgacgtggaggatcccagcctctgagctgagttggttttatgaaaagctaggaagcaacctttcgcctgtgcagcggtccagcacttaactctaatacatcagcatgcgttaattcagctggttgggaaatgacaccaggaagcccagtgcagagggtcccttactgactgtttcgtggccctattaatggtcagactgttccagcatgaggttcttagaatgacaggtgtttggatgggtgggggccttgtgatggggggtaggctggcccatgtgtgatcttgtggggtggagggaagagaatagcatgatcccacttccccatgctgtgggaaggggtgcagttcgtccccaagaacgacactgcctgtcaggtggtctgcaaagatgataaccttgactactaaaaacgtctccatggcgggggtaacaagatgataatctacttaattttagaacacctttttcacctaactaaaataatgtttaaagagttttgtataaaaatgtaaggaagcgttgttacctgttgaattttgtattatgtgaatcagtgagatgttagtagaataagccttaaaaaaaaaaaaatcggttgggtgcagtggcacacggctgtaatcccagcactttgggaggccaaggttggcagatcacctgaggtcaggagttcaagaccagtctggccaacatagcaaaaccctgtctctactaaaaatacaaaaattatctgggcatggtggtgcatgcctgtaatcccagctattcggaaggctgaggcaggagaatcacttgaacccaggaggcggaggttgcggtgagctgagattgcaccatttcattccagcctgggcaacatgagtgaaagtctgactcaaaaaaaaaaaatttaaaaaacaaaataatctagtgtgcagggcattcacctcagccccccaggcaggagccaagcacagcaggagcttccgcctcctctccactggagcacacaacttgaacctggcttattttctgcagggaccagccccacatggtcagtgagtttctccccatgtgtggcgatgagagagtgtagaaataaagac

SEQ ID NO: 163870 - DNA, 1480 bp, Homo sapiens
  Payload ID: 12267
  Gene Symbol: PNPLA3
  Gene Name: patatin-like phospholipase domain containing 3
  ENST ID: ENST00000406117
  CDS Start-End: 121-483
actgaggcagggtagagagcgcttgcgggcgccgggcggagctgctgcggatcaggacccgagccgattcccgatcccgacccagatcctaacccgcgcccccgccccgccgccgccgccatgtacgacgcagagcgcggctggagcttgtccttcgcgggctgcggcttcctgggcttctaccacgtcggggcgacccgctgcctgagcgagcacgccccgcacctcctccgcgacgcgcgcatgttgttcggcgcttcggccggggcgttgcactgcgtcggcgtcctctccggtatcccgctggactctgcaggtcctctcagatcttgtgcggaaggccaggagtcggaacattggcatcttccatccatccttcaacttaagcaagttcctccgacagggtctctgcaaatgcctcccggccaatgtccaccagctcatctccggcaaaataggcatctctcttaccagagtgtctgatggggaaaacgttctggtgtctgactttcggtccaaagacgaagtcgtggatgccttggtatgttcctgcttcatccccttctacagtggccttatccctccttccttcagaggcgtgcgatatgtggatggaggagtgagtgacaacgtacccttcattgatgccaaaacaaccatcaccgtgtcccccttctatggggagtacgacatctgccctaaagtcaagtccacgaactttcttcatgtggacatcaccaagctcagtctacgcctctgcacagggaacctctaccttctctcgagagcttttgtccccccggatctcaaggtgctgggagagatatgccttcgaggatatttggatgcattcaggttcttggaagagaagggcatctgcaacaggccccagccaggcctgaagtcatcctcagaagggatggatcctgaggtcgccatgcccagctgggcaaacatgagtctggattcttccccggagtcggctgccttggctgtgaggctggagggagatgagctgctagaccacctgcgtctcagcatcctgccctgggatgagagcatcctggacaccctctcgcccaggctcgctacagcactgagtgaagaaatgaaagacaaaggtggatacatgagcaagatttgcaacttgctacccattaggataatgtcttatgtaatgctgccctgtaccctgcctgtggaatctgccattgcgattgtccagagactggtgacatggcttccagatatgcccgacgatgtcctgtggttgcagtgggtgacctcacaggtgttcactcgagtgctgatgtgtctgctccccgcctccagagtttggagcctcttccatcaagtggacctgattttggaggattaggagaagaagctgaatttgttgaagttgagcctgaagctaaacaggaaattcttgaaaacaaagatgtggttgttcaacatgttcattttgatggacttggaa

SEQ ID NO: 163871 - DNA, 2222 bp, Homo sapiens
  Payload ID: 12267
  Gene Symbol: PNPLA3
  Gene Name: patatin-like phospholipase domain containing 3
  Uniprot ID: Q9NST1
  ENST ID: ENST00000423180
  CDS Start-End: 110-1543
gtagagagcgcttgcgggcgccgggcggagctgctgcggatcaggacccgagccgattcccgatcccgacccagatcctaacccgcgcccccgccccgccgccgccgccatgtacgacgcagagcgcggctggagcttgtccttcgcgggctgcggcttcctgggcttctaccacgtcggggcgacccgctgcctgagcgagcacgccccgcacctcctccgcgacgcgcgcatgttgttcggcgcttcggccggggcgttgcactgcgtcggcgtcctctccgagcagactctgcaggtcctctcagatcttgtgcggaaggccaggagtcggaacattggcatcttccatccatccttcaacttaagcaagttcctccgacagggtctctgcaaatgcctcccggccaatgtccaccagctcatctccggcaaaataggcatctctcttaccagagtgtctgatggggaaaacgttctggtgtctgactttcggtccaaagacgaagtcgtggatgccttggtatgttcctgcttcatccccttctacagtggccttatccctccttccttcagaggcgtgcgatatgtggatggaggagtgagtgacaacgtacccttcattgatgccaaaacaaccatcaccgtgtcccccttctatggggagtacgacatctgccctaaagtcaagtccacgaactttcttcatgtggacatcaccaagctcagtctacgcctctgcacagggaacctctaccttctctcgagagcttttgtccccccggatctcaaggtgctgggagagatatgccttcgaggatatttggatgcattcaggttcttggaagagaagggcatctgcaacaggccccagccaggcctgaagtcatcctcagaagggatggatcctgaggtcgccatgcccagctgggcaaacatgagtctggattcttccccggagtcggctgccttggctgtgaggctggagggagatgagctgctagaccacctgcgtctcagcatcctgccctgggatgagagcatcctggacaccctctcgcccaggctcgctacagcactgagtgaagaaatgaaagacaaaggtggatacatgagcaagatttgcaacttgctacccattaggataatgtcttatgtaatgctgccctgtaccctgcctgtggaatctgccattgcgattgtccagagactggtgacatggcttccagatatgcccgacgatgtcctgtggttgcagtgggtgacctcacaggtgttcactcgagtgctgatgtgtctgctccccgcctccaggtcccaaatgccagtgagcagccaacaggcctccccatgcacacctgagcaggactggccctgctggactccctgctcccccaagggctgtccagcagagaccaaagcagaggccaccccgcggtccatcctcaggtccagcctgaacttcttcttgggcaataaagtacctgctggtgctgaggggctctccacctttcccagtttttcactagagaagagtctgtgagtcacttgaggaggcgagtctagcagattctttcagaggtgctaaagtttcccatctttgtgcagctacctccgcattgctgtgtagtgacccctgcctgtgacgtggaggatcccagcctctgagctgagttggttttatgaaaagctaggaagcaacctttcgcctgtgcagcggtccagcacttaactctaatacatcagcatgcgttaattcagctggttgggaaatgacaccaggaagcccagtgcagagggtcccttactgactgtttcgtggccctattaatggtcagactgttccagcatgaggttcttagaatgacaggtgtttggatgggtgggggccttgtgatggggggtaggctggcccatgtgtgatcttgtggggtggagggaagagaatagcatgatcccacttccccatgctgtgggaaggggtgcagttcgtccccaagaacgacactgcctgtcaggtggtctgcaaagatgataaccttgactactaaaaacgtctccatggcgggggtaacaagatgataatctacttaattttagaacacctttttcacctaactaaaataatgtttaaagagttttgtataaaaatgtaaggaagcgttgttacctgttgaattttgtattatgtgaatcagtgagatgttagtagaataagcctt

SEQ ID NO: 163872 - DNA, 3372 bp, Homo sapiens
  Payload ID: 12268
  Gene Symbol: PNPLA4
  Gene Name: patatin-like phospholipase domain containing 4
  Uniprot ID: P41247
  ENST ID: ENST00000381042
  CDS Start-End: 172-933
gcgggaggcggtaccaacccctgccgcaggactttcctgggccggctcgcggagagcgtagcgcggccttggtggcggaatggcgttgagtgacggcccggccccgccatctggttaaagggactcgttcaacacggaagtgtcccggggctgcattgtgctacagctagaatgaagcacatcaacctatcatttgcagcgtgtggatttctgggcatttaccacttgggggcagcatctgcactttgcagacatggcaaaaaacttgtgaaggatgtcaaagccttcgctggggcgtctgcgggatcgttggttgcttctgttctgctaacagcaccagaaaaaatagaggaatgtaaccaatttacctacaagtttgccgaagaaatcagaaggcagtctttcggggcagtaacgcccggttatgacttcatggcccgactaagaagtgggatggagtcgattcttcctcccagcgctcacgagctggcccagaaccgactgcacgtatccatcaccaacgccaaaaccagagaaaatcacttagtctccactttttcctccagggaggacctcattaaggtcctcctagccagcagttttgtgcccatttatgcaggactgaagctagtggaatacaaagggcagaagtgggtggacggaggcctcaccaacgctcttcccatcctgcccgtcggccggacagtaaccatctcccccttcagtggacgactggacatctccccgcaggacaaagggcagctagatctgtatgttaatatcgccaagcaggatatcatgttgtccctggcaaacctggtgagactcaaccaagccctttttcccccaagcaagaggaaaatggaatctttgtatcagtgtggttttgatgacactgttaagtttttacttaaagaaaattggtttgaataaaatgcataaaagtttataatgcaaaacacgttttagatagtttttgatggaagtttctaatcaaatcctttttagaaaatctatcatgactcaattgtattactccttgtaatatttgtgtttatttttaatatttgaattattacttagcacatggatataagaggcactttattagaatttgacaacgtcattaagaaggatacacttaggtgataaggaatcatttttggtgaactgttgtgtcctttaaaaaatggaggaggataggttctttgggtaaattgaggaacatggaaaatggagggccaccacttaggttccatggagaatatgtggcatgatcttgacgtgaagcatgggtgtttccgtgacttagctgtgtccctgtagctctggaactgaaggaactaggtaggagaggaaggatttgagaaataggcaactcatggttaaagacctttgatcaggactggaggaacaaaggtttgtgtattagtccattttcacactgctgagaaagacatacccaagactgggcaatttacaaaagaaaggtttaatgggctcacagttccacatgactgaggaggcctcacaattgtggtggaaggtgaaaggcatgtctcacatggcagcagacaagagaagaaaacttgtgcagggaaactcccctttataaaaccatcggatctcttgagactcgttcactatcatgagaatagcatgggaaagacctgcctccatgattcagttacctcccactgggtccctcccacaacgtgtggcaattgtgggagctacatacacttcaagatgagatttgggtggggacacagccaaaccataacagtttgctttccacaggtgtgtgcagttgctcccagtgcagttaggggcagatatccagaagcctaggagattttgaagaggcttatcccctctcatcttcctcccctaaaccccaccccagtttaggagattatcaagctggttgtcattcattctctctctctctctctctctctctctctctctctctctctctctctctctctcgccatacctctctgagtatttagctattgttctatatactggatacatctattatgggaacttaaatagataaaatactactaaacacaaagaaccaagtagcctagtaaataagaattaaatccagaataatcattcacttctcatttttaaatcacgttgtactgatcccaggttttttactttctgagtagttgtccatcactttgaggacttgtgtatgggcttgtaccaatttactgacactgtcttaaatcctaaatctgtttttatgaggttttgccaagcaagaactcttgattactaagaggcagttagagacaaaccaatttaattccatgtcttcaattgtcacgcatttcttcttttactctttgaaactattctttgagtcaattttatggttctcagaagccaaaatacacaacttttagcacataaacaccaacgatggcctctttttgaggagttatgcatagacccactctagagtaatgatggtccctgtggtatatactttctcctactctagcaaacatgtagtttaatcttaatgtgttgtttccataagtgacatgaagtggatagattctcaattgttatgtccacttattcactaggtaaattttcagttttaatacttttctccttaccccttcctttgatcatttcatgtgaatattctatttgtatgatacactgtatttcaataaattccttgttgatgtacccttaaattgaagaaatttaagctgcaaaaccaaatctcattgtataagacttttttgaagtatcttgtatcgactacatatgtatttgaccctgtgggaggatggtacttttctttttaacttttattttaagttcaggggtacgtgtacaggtttgttataggtaaacttgtgtcacgggggtttgttgtaaagattaatttatcacccaggtgttggtacttttctttaaaaatactgtaagatcattgacgtatcagtctgcagcaactttcctacatgaggggaatacagcggtgtaatgaaacacatacttggtgcacactaggcgctctccggggctggtgcaccaaattctcctgtgagcatgctaccaagcatgctctgcttacctttgctggagtgtgtgctcatgcagccatactaattgaaaacaggcattcacaacaggatctgcctcacttgtgggatcaaaattttgaggcattgtagaactggcatatagaaaatctgaaaggagtttctgacccagatactgatatgtttgcagggtaattactgtgattggcagcttgataaattcccaattccctgtgggggcaatttccttatatatttgaatctgtcattaaaaatgtcattagtcttc

SEQ ID NO: 163873 - DNA, 652 bp, Homo sapiens
  Payload ID: 12268
  Gene Symbol: PNPLA4
  Gene Name: patatin-like phospholipase domain containing 4
  ENST ID: ENST00000442940
  CDS Start-End: 83-652
agacgcgaagagggtaaggcacttccggggcacagaaaatgaggattattaaaggtcagttgctcgcagtgctacagctagaatgaagcacatcaacctatcatttgcagcgtgtggatttctgggcatttaccacttgggggcagcatctgcactttgcagacatggcaaaaaacttgtgaaggatgtcaaagccttcgctggggcgtctgcgggatcgttggttgcttctgttctgctaacagcaccagaaaaaatagaggaatgtaaccaatttacctacaagtttgccgaagaaatcagaaggcagtctttcggggcagtaacgcccggttatgacttcatggcccgactaagaagtgggatggagtcgattcttcctcccagcgctcacgagctggcccagaaccgactgcacgtatccatcaccaacgccaaaaccagagaaaatcacttagtctccactttttcctccagggaggacctcattaaggtcctcctagccagcagttttgtgcccatttatgcaggactgaagctagtggaatacaaagggcagaagtgggtggacggaggcctcaccaacgctcttcccatcctgcccgtcggccggacagtaaccatctcccccttcagtggacgactggacatc

SEQ ID NO: 163874 - DNA, 2752 bp, Homo sapiens
  Payload ID: 12268
  Gene Symbol: PNPLA4
  Gene Name: patatin-like phospholipase domain containing 4
  Uniprot ID: P41247
  ENST ID: ENST00000444736
  CDS Start-End: 68-829
agacgcgaagagggtaaggcacttccggggcacagaaaatgaggattattaaagtgctacagctagaatgaagcacatcaacctatcatttgcagcgtgtggatttctgggcatttaccacttgggggcagcatctgcactttgcagacatggcaaaaaacttgtgaaggatgtcaaagccttcgctggggcgtctgcgggatcgttggttgcttctgttctgctaacagcaccagaaaaaatagaggaatgtaaccaatttacctacaagtttgccgaagaaatcagaaggcagtctttcggggcagtaacgcccggttatgacttcatggcccgactaagaagtgggatggagtcgattcttcctcccagcgctcacgagctggcccagaaccgactgcacgtatccatcaccaacgccaaaaccagagaaaatcacttagtctccactttttcctccagggaggacctcattaaggtcctcctagccagcagttttgtgcccatttatgcaggactgaagctagtggaatacaaagggcagaagtgggtggacggaggcctcaccaacgctcttcccatcctgcccgtcggccggacagtaaccatctcccccttcagtggacgactggacatctccccgcaggacaaagggcagctagatctgtatgttaatatcgccaagcaggatatcatgttgtccctggcaaacctggtgagactcaaccaagccctttttcccccaagcaagaggaaaatggaatctttgtatcagtgtggttttgatgacactgttaagtttttacttaaagaaaattggtttgaataaaatgcataaaagtttataatgcaaaacacgttttagatagtttttgatggaagtttctaatcaaatcctttttagaaaatctatcatgactcaattgtattactccttgtaatatttgtgtttatttttaatatttgaattattacttagcacatggatataagaggcactttattagaatttgacaacgtcattaagaaggatacacttaggtgataaggaatcatttttggtgaactgttgtgtcctttaaaaaatggaggaggataggttctttgggtaaattgaggaacatggaaaatggagggccaccacttaggttccatggagaatatgtggcatgatcttgacgtgaagcatgggtgtttccgtgacttagctgtgtccctgtagctctggaactgaaggaactaggtaggagaggaaggatttgagaaataggcaactcatggttaaagacctttgatcaggactggaggaacaaaggtttgtgtattagtccattttcacactgctgagaaagacatacccaagactgggcaatttacaaaagaaaggtttaatgggctcacagttccacatgactgaggaggcctcacaattgtggtggaaggtgaaaggcatgtctcacatggcagcagacaagagaagaaaacttgtgcagggaaactcccctttataaaaccatcggatctcttgagactcgttcactatcatgagaatagcatgggaaagacctgcctccatgattcagttacctcccactgggtccctcccacaacgtgtggcaattgtgggagctacatacacttcaagatgagatttgggtggggacacagccaaaccataacagtttgctttccacaggtgtgtgcagttgctcccagtgcagttaggggcagatatccagaagcctaggagattttgaagaggcttatcccctctcatcttcctcccctaaaccccaccccagtttaggagattatcaagctggttgtcattcattctctctctctctctctctctctctctctctctctctctctctctctctctctcgccatacctctctgagtatttagctattgttctatatactggatacatctattatgggaacttaaatagataaaatactactaaacacaaagaaccaagtagcctagtaaataagaattaaatccagaataatcattcacttctcatttttaaatcacgttgtactgatcccaggttttttactttctgagtagttgtccatcactttgaggacttgtgtatgggcttgtaccaatttactgacactgtcttaaatcctaaatctgtttttatgaggttttgccaagcaagaactcttgattactaagaggcagttagagacaaaccaatttaattccatgtcttcaattgtcacgcatttcttcttttactctttgaaactattctttgagtcaattttatggttctcagaagccaaaatacacaacttttagcacataaacaccaacgatggcctctttttgaggagttatgcatagacccactctagagtaatgatggtccctgtggtatatactttctcctactctagcaaacatgtagtttaatcttaatgtgttgtttccataagtgacatgaagtggatagattctcaattgttatgtccacttattcactaggtaaattttcagttttaatacttttctccttaccccttcctttgatcatttcatgtgaatattctatttgtatgatacactgtatttcaataaattccttgttgatgtacccttaaattgaagaaatttaagctgcaaaaccaaatctcattgtataagacttttttgaagtatcttgtatcgactacatatgtatttgaccctgtgggaggatggtacttttctttttaacttttattttaag

SEQ ID NO: 163875 - DNA, 2559 bp, Homo sapiens
  Payload ID: 12268
  Gene Symbol: PNPLA4
  Gene Name: patatin-like phospholipase domain containing 4
  Uniprot ID: P41247
  ENST ID: ENST00000537427
  CDS Start-End: 136-636
agacgcgaagagggtaaggcacttccggggcacagaaaatgaggattattaaaggaatgtaaccaatttacctacaagtttgccgaagaaatcagaaggcagtctttcggggcagtaacgcccggttatgacttcatggcccgactaagaagtgggatggagtcgattcttcctcccagcgctcacgagctggcccagaaccgactgcacgtatccatcaccaacgccaaaaccagagaaaatcacttagtctccactttttcctccagggaggacctcattaaggtcctcctagccagcagttttgtgcccatttatgcaggactgaagctagtggaatacaaagggcagaagtgggtggacggaggcctcaccaacgctcttcccatcctgcccgtcggccggacagtaaccatctcccccttcagtggacgactggacatctccccgcaggacaaagggcagctagatctgtatgttaatatcgccaagcaggatatcatgttgtccctggcaaacctggtgagactcaaccaagccctttttcccccaagcaagaggaaaatggaatctttgtatcagtgtggttttgatgacactgttaagtttttacttaaagaaaattggtttgaataaaatgcataaaagtttataatgcaaaacacgttttagatagtttttgatggaagtttctaatcaaatcctttttagaaaatctatcatgactcaattgtattactccttgtaatatttgtgtttatttttaatatttgaattattacttagcacatggatataagaggcactttattagaatttgacaacgtcattaagaaggatacacttaggtgataaggaatcatttttggtgaactgttgtgtcctttaaaaaatggaggaggataggttctttgggtaaattgaggaacatggaaaatggagggccaccacttaggttccatggagaatatgtggcatgatcttgacgtgaagcatgggtgtttccgtgacttagctgtgtccctgtagctctggaactgaaggaactaggtaggagaggaaggatttgagaaataggcaactcatggttaaagacctttgatcaggactggaggaacaaaggtttgtgtattagtccattttcacactgctgagaaagacatacccaagactgggcaatttacaaaagaaaggtttaatgggctcacagttccacatgactgaggaggcctcacaattgtggtggaaggtgaaaggcatgtctcacatggcagcagacaagagaagaaaacttgtgcagggaaactcccctttataaaaccatcggatctcttgagactcgttcactatcatgagaatagcatgggaaagacctgcctccatgattcagttacctcccactgggtccctcccacaacgtgtggcaattgtgggagctacatacacttcaagatgagatttgggtggggacacagccaaaccataacagtttgctttccacaggtgtgtgcagttgctcccagtgcagttaggggcagatatccagaagcctaggagattttgaagaggcttatcccctctcatcttcctcccctaaaccccaccccagtttaggagattatcaagctggttgtcattcattctctctctctctctctctctctctctctctctctctctctctctctctctctcgccatacctctctgagtatttagctattgttctatatactggatacatctattatgggaacttaaatagataaaatactactaaacacaaagaaccaagtagcctagtaaataagaattaaatccagaataatcattcacttctcatttttaaatcacgttgtactgatcccaggttttttactttctgagtagttgtccatcactttgaggacttgtgtatgggcttgtaccaatttactgacactgtcttaaatcctaaatctgtttttatgaggttttgccaagcaagaactcttgattactaagaggcagttagagacaaaccaatttaattccatgtcttcaattgtcacgcatttcttcttttactctttgaaactattctttgagtcaattttatggttctcagaagccaaaatacacaacttttagcacataaacaccaacgatggcctctttttgaggagttatgcatagacccactctagagtaatgatggtccctgtggtatatactttctcctactctagcaaacatgtagtttaatcttaatgtgttgtttccataagtgacatgaagtggatagattctcaattgttatgtccacttattcactaggtaaattttcagttttaatacttttctccttaccccttcctttgatcatttcatgtgaatattctatttgtatgatacactgtatttcaataaattccttgttgatgtacccttaaattgaagaaatttaagctgcaaaaccaaatctcattgtataagacttttttgaagtatcttgtatcgactacatatgtatttgaccctgtgggaggatggtacttttctttttaacttttattttaag

SEQ ID NO: 163876 - DNA, 2539 bp, Homo sapiens
  Payload ID: 12269
  Gene Symbol: PNPLA5
  Gene Name: patatin-like phospholipase domain containing 5
  Uniprot ID: Q7Z6Z6
  ENST ID: ENST00000216177
  CDS Start-End: 134-1423
agcaccagccccagcccggctccctccagagcccacatttgggcccagccccgtccaaggctgcatcccggccctatcccgggtcacggagtgacccttcctcgtcccgatcaccccgcccggtccacccgccatgggcttcttagaggaggagggcagatggaacctgtccttctccggcgccggctacctgggcgcccaccacgtgggcgccaccgaatgcctgcgccagcgagccccgcgcctcctccagggcgcccgccgcatctacggttcctcgtctggggcgctcaacgcagtcagcatcgtctgcggcaagtcggtcgacttctgctgctcccacctcctgggcatggttgggcagttggagcggctgagcctaagcatcctgcacccggcctacgcgcccatcgagcacgtcaagcagcagctgcaggatgctctgccccccgacgcccacgtcctggcctcccagcggctgggcatttcgctgacccgctggcctgacggacgcaacttcttggtcactgacttcgccacctgcgatgagctcatccaggccttggtctgcaccttatactttcctttctactgcgggctgatcccccccgagttcagaggggagcgctacatcgatggggctctgagcaacaacttgccctttgcagactgcccctccaccatcacggtgtcgcccttccatgggacagtggacatctgcccccagagcacctcccccaacctgcatgagctgaacgtcttcaacttcagcttccaaatctccactgagaacttcttcctggggctcatatgtctcataccccccagcctcgaggtagtggccgacaactgcagacaaggctacctggatgccctgaggttcctggagagacgtggactcaccaaggaaccagtgctatggacgctggtgtctaaggaacccccagccccggctgacggaaactgggatgctggctgtgaccaacgctggaaggggggcctgtctctcaactggaaagtgccccatgtgcaagtcaaggatgtacccaactttgagcagctctcaccagagctggaggctgcactgaagaaagcatgtacgagggatcccagccggtgggcccgcttctggcactcggggcctggacaggtgctgacgtacctgctgctaccctgcacactgcccttcgagtacatctacttccgcagcagaaggttggtggtgtggctgcccgatgtgccggcggacttgtggtggatgcagggcctgctgaggaacatggccctcgaggttttctccaggaccaaggcccagctccttgggcccatcagccctccggccactcgcgtcctggaaacaagccccctccaaccccagatagctcctcatagagaggagctcgggcccacccaccaggcctgagggggccgagcagggccagcccagtgactggtgtcccttgattcctgctctggcctttgtcctgtgtgcccacatctgccccagcgggaagaggccctgccaatctccgtggagaccctgcagcttggagcccgttccttggggcgcagcctgtcagcatgtccccggtcactgtgtacccaggtcacctgccctccctcttgccccgtctcatcagggagagaaaggaggacagccacagagacacatgtcttactttcagaatttccacggggggactaggagggcagcattgctggggagaggggctcctgttctgccgtggagctgcccacggagcacctcacagaagattgagaaagtgcctgatgcccgcgtcagagaccagaggagccaactgagatgatggggtgggggtgctccccccagactttctcagtcctgcagcggcccttgggggtgacccccggcatctaccccactcaggaaaccttgacttctgaattcctatcaggtccagagggtggaaggccctggcaggaagcaggaggaggaggagaggggggtccaggtcttttcaggatcccagctgtgggtgcttctgttgggcccagtggcccctgctatccccacagcctcattcctgcagaaggtttgtgacgtagctgtgcctgtacctggggcagagaggatgccagggacaccaggcctctggcctctccacgagtcactgctctccccattggcagcacgggacccatgctgtgcccccggccaggccctgaggaaatgctcagcctcagtggagatggggaggttagagagatggaggcgtgagtgagaacgggaagcaaaggaatacacgtgggaactaaagagaaaaatgaccagcctgggcagcatagcaagaccctgtctctaaaaaaaataataaaaacttagctgggcatggtggtgcatgcctgtggtcctggctacttgggaggctgaggatggaggatcatttgagcccaggaggtcgaggctgcagtgaaccgtgatcacgccactgcaccccagcccaggcaacaaagtgagcccctgtctctaaataaataaagagacaataagccactc

SEQ ID NO: 163877 - DNA, 2000 bp, Homo sapiens
  Payload ID: 12269
  Gene Symbol: PNPLA5
  Gene Name: patatin-like phospholipase domain containing 5
  Uniprot ID: Q7Z6Z6
  ENST ID: ENST00000381198
  CDS Start-End: 134-1081
agcaccagccccagcccggctccctccagagcccacatttgggcccagccccgtccaaggctgcatcccggccctatcccgggtcacggagtgacccttcctcgtcccgatcaccccgcccggtccacccgccatgggcttcttagaggaggagggcagatggaacctgtccttctccggcgccggctacctgggcgcccaccacgtgggcgccaccgaatgcctgcgccagcgagccccgcgcctcctccagggcgcccgccgcatctacggttcctcgtctggggcgctcaacgcagtcagcatcgtctgcggcaagtcggtcgactgcccctccaccatcacggtgtcgcccttccatgggacagtggacatctgcccccagagcacctcccccaacctgcatgagctgaacgtcttcaacttcagcttccaaatctccactgagaacttcttcctggggctcatatgtctcataccccccagcctcgaggtagtggccgacaactgcagacaaggctacctggatgccctgaggttcctggagagacgtggactcaccaaggaaccagtgctatggacgctggtgtctaaggaacccccagccccggctgacggaaactgggatgctggctgtgaccaacgctggaaggggggcctgtctctcaactggaaagtgccccatgtgcaagtcaaggatgtacccaactttgagcagctctcaccagagctggaggctgcactgaagaaagcatgtacgagggatcccagccggtgggcccgcttctggcactcggggcctggacaggtgctgacgtacctgctgctaccctgcacactgcccttcgagtacatctacttccgcagcagaaggttggtggtgtggctgcccgatgtgccggcggacttgtggtggatgcagggcctgctgaggaacatggccctcgaggttttctccaggaccaaggcccagctccttgggcccatcagccctccggccactcgcgtcctggaaacaagccccctccaaccccagatagctcctcatagagaggagctcgggcccacccaccaggcctgagggggccgagcagggccagcccagtgactggtgtcccttgattcctgctctggcctttgtcctgtgtgcccacatctgccccagcgggaagaggccctgccaatctccgtggagaccctgcagcttggagcccgttccttggggcgcagcctgtcagcatgtccccggtcactgtgtacccaggtcacctgccctccctcttgccccgtctcatcagggagagaaaggaggacagccacagagacacatgtcttactttcagaatttccacggggggactaggagggcagcattgctggggagaggggctcctgttctgccgtggagctgcccacggagcacctcacagaagattgagaaagtgcctgatgcccgcgtcagagaccagaggagccaactgagatgatggggtgggggtgctccccccagactttctcagtcctgcagcggcccttgggggtgacccccggcatctaccccactcaggaaaccttgacttctgaattcctatcaggtccagagggtggaaggccctggcaggaagcaggaggaggaggagaggggggtccaggtcttttcaggatcccagctgtgggtgcttctgttgggcccagtggcccctgctatccccacagcctcattcctgcagaaggtttgtgacgtagctgtgcctgtacctggggcagagaggatgccagggacaccaggcctctggcctctccacgagtcactgctctccccattggcagcacgggacccatgctgtgcccccggccaggccctgaggaaatgctcagcctcagtggagatggggaggttagagagatggaggcgtgagtgagaacgggaagcaaaggaatacacgtgggaactaaagagaaaaatgaccagcctgggcagcatagcaagaccctgtctc

SEQ ID NO: 163878 - DNA, 921 bp, Homo sapiens
  Payload ID: 12269
  Gene Symbol: PNPLA5
  Gene Name: patatin-like phospholipase domain containing 5
  ENST ID: ENST00000438734
  CDS Start-End: 116-921
gctccctccagagcccacatttgggcccagccccgtccaaggctgcatcccggccctatcccgggtcacggagtgacccttcctcgtcccgatcaccccgcccggtccacccgccatgggcttcttagaggaggagggcagatggaacctgtccttctccggcgccggctacctgggcgcccaccacgtgggcgccaccgaatgcctgcgccagcgagccccgcgcctcctccagggcgcccgccgcatctacggttcctcgtctggggcgctcaacgcagtcagcatcgtctgcggcaagtcggtcgacttctgctgctcccacctcctgggcatggttgggcagttggagcggctgagcctaagcatcctgcacccggcctacgcgcccatcgagcacgtcaagcagcagctgcaggatgctctgccccccgacgcccacgtcctggcctcccagcggctgggcatttcgctgacccgctggcctgacggacgcaacttcttggtcactgacttcgccacctgcgatgagctcatccaggtagtggccgacaactgcagacaaggctacctggatgccctgaggttcctggagagacgtggactcaccaaggaaccagtgctatggacgctggtgtctaaggaacccccagccccggctgacggaaactgggatgctggctgtgaccaacgctggaaggggggcctgtctctcaactggaaagtgccccatgtgcaagtcaaggatgtacccaactttgagcagctctcaccagagctggaggctgcactgaagaaagcatgtacgagggatcccagccggtgggcccgcttctggcactcggggcctggacaggtgctgacgtacctgctgctaccctgcacactgcccttcgagtacatctacttccgcagcagaag

SEQ ID NO: 163879 - DNA, 2537 bp, Homo sapiens
  Payload ID: 12269
  Gene Symbol: PNPLA5
  Gene Name: patatin-like phospholipase domain containing 5
  Uniprot ID: Q7Z6Z6
  ENST ID: ENST00000597664
  CDS Start-End: 131-1420
accagccccagcccggctccctccagagcccacatttgggcccagccccgtccaaggctgcatcccggccctatcccgggtcacggagtgacccttcctcgtcccgatcaccccgcccggtccacccgccatgggcttcttagaggaggagggcagatggaacctgtccttctccggcgccggctacctgggcgcccaccacgtgggcgccaccgaatgcctgcgccagcgagccccgcgcctcctccagggcgcccgccgcatctacggttcctcgtctggggcgctcaacgcagtcagcatcgtctgcggcaagtcggtcgacttctgctgctcccacctcctgggcatggttgggcagttggagcggctgagcctaagcatcctgcacccggcctacgcgcccatcgagcacgtcaagcagcagctgcaggatgctctgccccccgacgcccacgtcctggcctcccagcggctgggcatttcgctgacccgctggcctgacggacgcaacttcttggtcactgacttcgccacctgcgatgagctcatccaggccttggtctgcaccttatactttcctttctactgcgggctgatcccccccgagttcagaggggagcgctacatcgatggggctctgagcaacaacttgccctttgcagactgcccctccaccatcacggtgtcgcccttccatgggacagtggacatctgcccccagagcacctcccccaacctgcatgagctgaacgtcttcaacttcagcttccaaatctccactgagaacttcttcctggggctcatatgtctcataccccccagcctcgaggtagtggccgacaactgcagacaaggctacctggatgccctgaggttcctggagagacgtggactcaccaaggaaccagtgctatggacgctggtgtctaaggaacccccagccccggctgacggaaactgggatgctggctgtgaccaacgctggaaggggggcctgtctctcaactggaaagtgccccatgtgcaagtcaaggatgtacccaactttgagcagctctcaccagagctggaggctgcactgaagaaagcatgtacgagggatcccagccggtgggcccgcttctggcactcggggcctggacaggtgctgacgtacctgctgctaccctgcacactgcccttcgagtacatctacttccgcagcagaaggttggtggtgtggctgcccgatgtgccggcggacttgtggtggatgcagggcctgctgaggaacatggccctcgaggttttctccaggaccaaggcccagctccttgggcccatcagccctccggccactcgcgtcctggaaacaagccccctccaaccccagatagctcctcatagagaggagctcgggcccacccaccaggcctgagggggccgagcagggccagcccagtgactggtgtcccttgattcctgctctggcctttgtcctgtgtgcccacatctgccccagcgggaagaggccctgccaatctccgtggagaccctgcagcttggagcccgttccttggggcgcagcctgtcagcatgtccccggtcactgtgtacccaggtcacctgccctccctcttgccccgtctcatcagggagagaaaggaggacagccacagagacacatgtcttactttcagaatttccacggggggactaggagggcagcattgctggggagaggggctcctgttctgccgtggagctgcccacggagcacctcacagaagattgagaaagtgcctgatgcccgcgtcagagaccagaggagccaactgagatgatggggtgggggtgctccccccagactttctcagtcctgcagcggcccttgggggtgacccccggcatctaccccactcaggaaaccttgacttctgaattcctatcaggtccagagggtggaaggccctggcaggaagcaggaggaggaggagaggggggtccaggtcttttcaggatcccagctgtgggtgcttctgttgggcccagtggcccctgctatccccacagcctcattcctgcagaaggtttgtgacgtagctgtgcctgtacctggggcagagaggatgccagggacaccaggcctctggcctctccacgagtcactgctctccccattggcagcacgggacccatgctgtgcccccggccaggccctgaggaaatgctcagcctcagtggagatggggaggttagagagatggaggcgtgagtgagaacgggaagcaaaggaatacacgtgggaactaaagagaaaaatgaccagcctgggcagcatagcaagaccctgtctctaaaaaaaataataaaaacttagctgggcatggtggtgcatgcctgtggtcctggctacttgggaggctgaggatggaggatcatttgagcccaggaggtcgaggctgcagtgaaccgtgatcacgccactgcaccccagcccaggcaacaaagtgagcccctgtctctaaataaataaagagacaataagccactca

SEQ ID NO: 163880 - DNA, 2197 bp, Homo sapiens
  Payload ID: 12269
  Gene Symbol: PNPLA5
  Gene Name: patatin-like phospholipase domain containing 5
  Uniprot ID: Q7Z6Z6
  ENST ID: ENST00000593866
  CDS Start-End: 134-1081
agcaccagccccagcccggctccctccagagcccacatttgggcccagccccgtccaaggctgcatcccggccctatcccgggtcacggagtgacccttcctcgtcccgatcaccccgcccggtccacccgccatgggcttcttagaggaggagggcagatggaacctgtccttctccggcgccggctacctgggcgcccaccacgtgggcgccaccgaatgcctgcgccagcgagccccgcgcctcctccagggcgcccgccgcatctacggttcctcgtctggggcgctcaacgcagtcagcatcgtctgcggcaagtcggtcgactgcccctccaccatcacggtgtcgcccttccatgggacagtggacatctgcccccagagcacctcccccaacctgcatgagctgaacgtcttcaacttcagcttccaaatctccactgagaacttcttcctggggctcatatgtctcataccccccagcctcgaggtagtggccgacaactgcagacaaggctacctggatgccctgaggttcctggagagacgtggactcaccaaggaaccagtgctatggacgctggtgtctaaggaacccccagccccggctgacggaaactgggatgctggctgtgaccaacgctggaaggggggcctgtctctcaactggaaagtgccccatgtgcaagtcaaggatgtacccaactttgagcagctctcaccagagctggaggctgcactgaagaaagcatgtacgagggatcccagccggtgggcccgcttctggcactcggggcctggacaggtgctgacgtacctgctgctaccctgcacactgcccttcgagtacatctacttccgcagcagaaggttggtggtgtggctgcccgatgtgccggcggacttgtggtggatgcagggcctgctgaggaacatggccctcgaggttttctccaggaccaaggcccagctccttgggcccatcagccctccggccactcgcgtcctggaaacaagccccctccaaccccagatagctcctcatagagaggagctcgggcccacccaccaggcctgagggggccgagcagggccagcccagtgactggtgtcccttgattcctgctctggcctttgtcctgtgtgcccacatctgccccagcgggaagaggccctgccaatctccgtggagaccctgcagcttggagcccgttccttggggcgcagcctgtcagcatgtccccggtcactgtgtacccaggtcacctgccctccctcttgccccgtctcatcagggagagaaaggaggacagccacagagacacatgtcttactttcagaatttccacggggggactaggagggcagcattgctggggagaggggctcctgttctgccgtggagctgcccacggagcacctcacagaagattgagaaagtgcctgatgcccgcgtcagagaccagaggagccaactgagatgatggggtgggggtgctccccccagactttctcagtcctgcagcggcccttgggggtgacccccggcatctaccccactcaggaaaccttgacttctgaattcctatcaggtccagagggtggaaggccctggcaggaagcaggaggaggaggagaggggggtccaggtcttttcaggatcccagctgtgggtgcttctgttgggcccagtggcccctgctatccccacagcctcattcctgcagaaggtttgtgacgtagctgtgcctgtacctggggcagagaggatgccagggacaccaggcctctggcctctccacgagtcactgctctccccattggcagcacgggacccatgctgtgcccccggccaggccctgaggaaatgctcagcctcagtggagatggggaggttagagagatggaggcgtgagtgagaacgggaagcaaaggaatacacgtgggaactaaagagaaaaatgaccagcctgggcagcatagcaagaccctgtctctaaaaaaaataataaaaacttagctgggcatggtggtgcatgcctgtggtcctggctacttgggaggctgaggatggaggatcatttgagcccaggaggtcgaggctgcagtgaaccgtgatcacgccactgcaccccagcccaggcaacaaagtgagcccctgtctctaaataaataaagagacaataagccactc

SEQ ID NO: 163881 - DNA, 4617 bp, Homo sapiens
  Payload ID: 12270
  Gene Symbol: PNPLA6
  Gene Name: patatin-like phospholipase domain containing 6
  Uniprot ID: Q8IY17
  ENST ID: ENST00000221249
  CDS Start-End: 432-4415
tttttagcgggaggagcagtccttgcgttaagcggtgtgaggccctttaaggcgcggccacactcagcatggcggcctcagtcggccttccaagcatggcgcggggaggaggggtgggagggtcgggagggactgcggtgcgactaggagtgaataatttaaaggggccgtgcctgcggagccgggcggaacgctagcggtgttggcgcggagtggaccccggctgcggcccctggcaatggcgccaccatcggtcccggagtcccagtgatgctctgtgccatagagcccccataacttcactactacgtgatagtaaatccccggcaaaaaccagcagcgccttgcaagcccacgccaccccaagcatcccaggactcttctgaaacgactccgggctaccagatcggccgtccagctggaatcaaccgatggaggctccgctgcaaactggaatggtgcttggcgtgatgatcggggccggagtggcggtggtggtcacggccgtgctcatcctcctggtggtgcggaggctgcgagtgccaaaaaccccagccccggatggcccccggtatcggttccggaagagggacaaagtgctcttctatggccggaagattatgcggaaggtgtcacaatccacctcctccctcgtggatacctctgtctccgccacctcccggccacgcatgaggaagaaactgaagatgctcaacattgccaagaagatcctgcgcatccagaaagagacgcccacgctgcagcggaaggagcccccgcccgcagtgctagaagctgacctgaccgagggcgacctggctaactcccatctgccctctgaagtgctttatatgctcaagaacgtccgggtgctgggccacttcgagaagccactcttcctggagctctgccgccacatggtcttccagcggctgggccagggtgactacgtcttccggccgggccagccagatgccagcatctacgtggtgcaggacgggctgctggagctctgtctgccagggcctgacgggaaggagtgtgtggtgaaggaagtggttcctggggacagcgtcaacagccttctcagcatcctggatgtcatcaccggtcaccagcatccccagcggaccgtgtctgcccgggcggcccgggactccacggtgctgcgcctgccggtggaagcattctccgcggtcttcaccaagtacccggagagcttggtgcgggtcgtgcagatcatcatggtgcggctgcagcgagtcaccttcctggcactgcacaactacctgggtctgaccaatgagctcttcagccacgagatccagcccctgcgtctgttccccagccccggcctcccaactcgcaccagccctgtgcggggctccaagagaatggtcagcacctcagctacagacgagcccagggagaccccagggcggccacccgatcccaccggggccccgctgcctggacctacaggggaccctgtgaagcccacatccctggaaaccccctcggcccctctgctgagccgctgcgtctccatgccaggggacatctcaggcttgcagggtggcccccgctccgacttcgacatggcctatgagcgtggccggatctccgtgtccctgcaggaagaggcctccggggggtccctggcagcccccgctcggacccccactcaggagcctcgtgagcagccggcaggcgcctgtgaatacagctactgtgaggatgagtcggccactggtggctgccctttcgggccctaccagggccgccagaccagcagcatcttcgaggcagcaaagcaggagctggccaagctgatgcggattgaggacccctccctcctgaacagcagagtcttgctgcaccacgccaaagctggcaccatcattgcccgccagggagaccaggacgtgagcctgcacttcgtgctctggggctgcctgcacgtgtaccagcgcatgatcgacaaggcggaggacgtgtgcctgttcgtagcgcagcccggggaactggtggggcagctggcggtgctcactggcgaacctctcatcttcacactgcgagcccaacgcgactgcaccttcctgcggatctccaagtccgacttctatgagatcatgcgcgcacagcccagtgtggtgctgagtgcggcgcacacggtggcagccaggatgtcgcccttcgtgcgccagatggacttcgccatcgactggactgcagtggaggcgggacgcgcgctgtacaggcagggcgaccgctccgactgcacttacatcgtgctcaatgggcggctgcgtagcgtgatccagcgaggcagtggcaagaaggagctggtgggcgagtacggccgcggcgacctcatcggcgtggtggaggcactgacccggcagccgcgagccacgacggtgcacgcggtgcgcgacacggagctggccaagcttcccgagggcaccttgggtcacatcaaacgccggtacccgcaggtcgtgacccgccttatccacctactgagccagaaaattctagggaatttgcagcagctgcaaggacccttcccagcaggctctgggttgggtgtgcccccacactcggaactcaccaacccagccagcaacctggcaactgtggcaatcctgcctgtgtgtgctgaggtccccatggtggccttcacgctggagctgcagcacgccctgcaggccatcggtccgacgctactccttaacagtgacatcatccgggcacgcctgggggcctccgcactggatagcatccaagagttccggctgtcagggtggctggcccagcaggaggatgcacaccgtatcgtactctaccagacggacgcctcgctgacgccctggaccgtgcgctgcctgcgacaggccgactgcatcctcattgtgggcctgggggaccaggagcctaccctcggccagctggagcagatgctggagaacacggctgtgcgcgcccttaagcagctagtcctgctccaccgagaggagggcgcgggccccacgcgcaccgtggagtggctaaatatgcgcagctggtgctcggggcacctgcacctgcgctgtccgcgccgcctcttttcgcgccgcagccctgccaagctgcatgagctctacgagaaggttttctccaggcgcgcggaccggcacagcgacttctcccgcttggcgagggtgctcacggggaacaccattgcccttgtgctaggcgggggcggggccaggggctgctcgcacatcggagtactaaaggcattagaggaggcgggggtccccgtggacctggtgggcggcacgtccattggctctttcatcggagcgttgtacgcggaggagcgcagcgccagccgcacgaagcagcgggcccgggagtgggccaagagcatgacttcggtgctggaacctgtgttggacctcacgtacccagtcacctccatgttcactgggtctgcctttaaccgcagcatccatcgggtcttccaggataagcagattgaggacctgtggctgccttacttcaacgtgaccacagatatcaccgcctcagccatgcgagtccacaaagatggctccctgtggcggtacgtgcgcgccagcatgacgctgtcgggctacctgcccccgctgtgcgaccccaaggacgggcacctactcatggatggcggctacatcaacaatctgccagcggacatcgcccgcagcatgggtgccaaaacggtcatcgccattgacgtggggagccaggatgagacggacctcagcacctacggggacagcctgtccggctggtggctgctgtggaagcggctgaatccctgggctgacaaggtaaaggttccagacatggctgaaatccagtcccgcctggcctacgtgtcctgtgtgcggcagctagaggttgtcaagtccagctcctactgcgagtacctgcgcccgcccatcgactgcttcaagaccatggactttgggaagttcgaccagatctatgatgtgggctaccagtacgggaaggcggtgtttggaggctggagccgtggcaacgtcattgagaaaatgctcacagaccggcggtctacagaccttaatgagagccgccgtgcagacgtgcttgccttcccaagctctggcttcactgacttggcagagattgtgtcccggattgagccccccacgagctatgtctctgatggctgtgctgacggagaggagtcagattgtctgacagagtatgaggaggacgccggacccgactgctcgagggatgaaggggggtcccccgagggcgcaagccccagcactgcctccgagatggaggaggagaagtcgattctccggcaacgacgctgtctgccccaggagccgcccggctcagccacagatgcctgaggacctcgacaggggtcaccccctccctcccacccctggactgggctgggggtggccccgtgggggtagctcactccccctcctgctgctatgcctgtgacccccgcggcccacacactggactgacctgccctgagcggggatgcagtgttgcactgatgacttgaccagcccctcccccaataaactcgcctcttggaaa

SEQ ID NO: 163882 - DNA, 4457 bp, Homo sapiens
  Payload ID: 12270
  Gene Symbol: PNPLA6
  Gene Name: patatin-like phospholipase domain containing 6
  Uniprot ID: Q8IY17
  ENST ID: ENST00000450331
  CDS Start-End: 272-4255
caatggcgccaccatcggtcccggagtcccagtgatgctctgtgccatagagcccccataacttcactactacgtgatagtaaatccccggcaaaaaccagcagcgccttgcaagcccacgccaccccaagcatcccaggactcttctgaaacagggcagtgacccgggaggaagtcaccaggtgcagaggaccgtgccctgtggggacctgcctgcaggctgctgacagactccgggctaccagatcggccgtccagctggaatcaaccgatggaggctccgctgcaaactggaatggtgcttggcgtgatgatcggggccggagtggcggtggtggtcacggccgtgctcatcctcctggtggtgcggaggctgcgagtgccaaaaaccccagccccggatggcccccggtatcggttccggaagagggacaaagtgctcttctatggccggaagattatgcggaaggtgtcacaatccacctcctccctcgtggatacctctgtctccgccacctcccggccacgcatgaggaagaaactgaagatgctcaacattgccaagaagatcctgcgcatccagaaagagacgcccacgctgcagcggaaggagcccccgcccgcagtgctagaagctgacctgaccgagggcgacctggctaactcccatctgccctctgaagtgctttatatgctcaagaacgtccgggtgctgggccacttcgagaagccactcttcctggagctctgccgccacatggtcttccagcggctgggccagggtgactacgtcttccggccgggccagccagatgccagcatctacgtggtgcaggacgggctgctggagctctgtctgccagggcctgacgggaaggagtgtgtggtgaaggaagtggttcctggggacagcgtcaacagccttctcagcatcctggatgtcatcaccggtcaccagcatccccagcggaccgtgtctgcccgggcggcccgggactccacggtgctgcgcctgccggtggaagcattctccgcggtcttcaccaagtacccggagagcttggtgcgggtcgtgcagatcatcatggtgcggctgcagcgagtcaccttcctggcactgcacaactacctgggtctgaccaatgagctcttcagccacgagatccagcccctgcgtctgttccccagccccggcctcccaactcgcaccagccctgtgcggggctccaagagaatggtcagcacctcagctacagacgagcccagggagaccccagggcggccacccgatcccaccggggccccgctgcctggacctacaggggaccctgtgaagcccacatccctggaaaccccctcggcccctctgctgagccgctgcgtctccatgccaggggacatctcaggcttgcagggtggcccccgctccgacttcgacatggcctatgagcgtggccggatctccgtgtccctgcaggaagaggcctccggggggtccctggcagcccccgctcggacccccactcaggagcctcgtgagcagccggcaggcgcctgtgaatacagctactgtgaggatgagtcggccactggtggctgccctttcgggccctaccagggccgccagaccagcagcatcttcgaggcagcaaagcaggagctggccaagctgatgcggattgaggacccctccctcctgaacagcagagtcttgctgcaccacgccaaagctggcaccatcattgcccgccagggagaccaggacgtgagcctgcacttcgtgctctggggctgcctgcacgtgtaccagcgcatgatcgacaaggcggaggacgtgtgcctgttcgtagcgcagcccggggaactggtggggcagctggcggtgctcactggcgaacctctcatcttcacactgcgagcccaacgcgactgcaccttcctgcggatctccaagtccgacttctatgagatcatgcgcgcacagcccagtgtggtgctgagtgcggcgcacacggtggcagccaggatgtcgcccttcgtgcgccagatggacttcgccatcgactggactgcagtggaggcgggacgcgcgctgtacaggcagggcgaccgctccgactgcacttacatcgtgctcaatgggcggctgcgtagcgtgatccagcgaggcagtggcaagaaggagctggtgggcgagtacggccgcggcgacctcatcggcgtggtggaggcactgacccggcagccgcgagccacgacggtgcacgcggtgcgcgacacggagctggccaagcttcccgagggcaccttgggtcacatcaaacgccggtacccgcaggtcgtgacccgccttatccacctactgagccagaaaattctagggaatttgcagcagctgcaaggacccttcccagcaggctctgggttgggtgtgcccccacactcggaactcaccaacccagccagcaacctggcaactgtggcaatcctgcctgtgtgtgctgaggtccccatggtggccttcacgctggagctgcagcacgccctgcaggccatcggtccgacgctactccttaacagtgacatcatccgggcacgcctgggggcctccgcactggatagcatccaagagttccggctgtcagggtggctggcccagcaggaggatgcacaccgtatcgtactctaccagacggacgcctcgctgacgccctggaccgtgcgctgcctgcgacaggccgactgcatcctcattgtgggcctgggggaccaggagcctaccctcggccagctggagcagatgctggagaacacggctgtgcgcgcccttaagcagctagtcctgctccaccgagaggagggcgcgggccccacgcgcaccgtggagtggctaaatatgcgcagctggtgctcggggcacctgcacctgcgctgtccgcgccgcctcttttcgcgccgcagccctgccaagctgcatgagctctacgagaaggttttctccaggcgcgcggaccggcacagcgacttctcccgcttggcgagggtgctcacggggaacaccattgcccttgtgctaggcgggggcggggccaggggctgctcgcacatcggagtactaaaggcattagaggaggcgggggtccccgtggacctggtgggcggcacgtccattggctctttcatcggagcgttgtacgcggaggagcgcagcgccagccgcacgaagcagcgggcccgggagtgggccaagagcatgacttcggtgctggaacctgtgttggacctcacgtacccagtcacctccatgttcactgggtctgcctttaaccgcagcatccatcgggtcttccaggataagcagattgaggacctgtggctgccttacttcaacgtgaccacagatatcaccgcctcagccatgcgagtccacaaagatggctccctgtggcggtacgtgcgcgccagcatgacgctgtcgggctacctgcccccgctgtgcgaccccaaggacgggcacctactcatggatggcggctacatcaacaatctgccagcggacatcgcccgcagcatgggtgccaaaacggtcatcgccattgacgtggggagccaggatgagacggacctcagcacctacggggacagcctgtccggctggtggctgctgtggaagcggctgaatccctgggctgacaaggtaaaggttccagacatggctgaaatccagtcccgcctggcctacgtgtcctgtgtgcggcagctagaggttgtcaagtccagctcctactgcgagtacctgcgcccgcccatcgactgcttcaagaccatggactttgggaagttcgaccagatctatgatgtgggctaccagtacgggaaggcggtgtttggaggctggagccgtggcaacgtcattgagaaaatgctcacagaccggcggtctacagaccttaatgagagccgccgtgcagacgtgcttgccttcccaagctctggcttcactgacttggcagagattgtgtcccggattgagccccccacgagctatgtctctgatggctgtgctgacggagaggagtcagattgtctgacagagtatgaggaggacgccggacccgactgctcgagggatgaaggggggtcccccgagggcgcaagccccagcactgcctccgagatggaggaggagaagtcgattctccggcaacgacgctgtctgccccaggagccgcccggctcagccacagatgcctgaggacctcgacaggggtcaccccctccctcccacccctggactgggctgggggtggccccgtgggggtagctcactccccctcctgctgctatgcctgtgacccccgcggcccacacactggactgacctgccctgagcggggatgcagtgttgcactgatgacttgaccagcccctcccccaataaactcgcctcttggaaa

SEQ ID NO: 163883 - DNA, 4522 bp, Homo sapiens
  Payload ID: 12270
  Gene Symbol: PNPLA6
  Gene Name: patatin-like phospholipase domain containing 6
  Uniprot ID: Q8IY17
  ENST ID: ENST00000414982
  CDS Start-End: 196-4323
caatggcgccaccatcggtcccggagtcccagtgatgctctgtgccatagagcccccataacttcactactacgtgatagtaaatccccggcaaaaaccagcagcgccttgcaagcccacgccaccccaagcatcccaggactcttctgaaacgactccgggctaccagatcggccgtccagctggaatcaaccgatggaggctccgctgcaaactggaatgatggggacatcgagtcacgggctggctacgaactcctcgggggcgaaggtggcggagagggatgggttccaggacgtcctggcgcccggggaaggctcggcgggacggatttgcggtgcgcagccagtgccgttcgtccctcaggtgcttggcgtgatgatcggggccggagtggcggtggtggtcacggccgtgctcatcctcctggtggtgcggaggctgcgagtgccaaaaaccccagccccggatggcccccggtatcggttccggaagagggacaaagtgctcttctatggccggaagattatgcggaaggtgtcacaatccacctcctccctcgtggatacctctgtctccgccacctcccggccacgcatgaggaagaaactgaagatgctcaacattgccaagaagatcctgcgcatccagaaagagacgcccacgctgcagcggaaggagcccccgcccgcagtgctagaagctgacctgaccgagggcgacctggctaactcccatctgccctctgaagtgctttatatgctcaagaacgtccgggtgctgggccacttcgagaagccactcttcctggagctctgccgccacatggtcttccagcggctgggccagggtgactacgtcttccggccgggccagccagatgccagcatctacgtggtgcaggacgggctgctggagctctgtctgccagggcctgacgggaaggagtgtgtggtgaaggaagtggttcctggggacagcgtcaacagccttctcagcatcctggatgtcatcaccggtcaccagcatccccagcggaccgtgtctgcccgggcggcccgggactccacggtgctgcgcctgccggtggaagcattctccgcggtcttcaccaagtacccggagagcttggtgcgggtcgtgcagatcatcatggtgcggctgcagcgagtcaccttcctggcactgcacaactacctgggtctgaccaatgagctcttcagccacgagatccagcccctgcgtctgttccccagccccggcctcccaactcgcaccagccctgtgcggggctccaagagaatggtcagcacctcagctacagacgagcccagggagaccccagggcggccacccgatcccaccggggccccgctgcctggacctacaggggaccctgtgaagcccacatccctggaaaccccctcggcccctctgctgagccgctgcgtctccatgccaggggacatctcaggcttgcagggtggcccccgctccgacttcgacatggcctatgagcgtggccggatctccgtgtccctgcaggaagaggcctccggggggtccctggcagcccccgctcggacccccactcaggagcctcgtgagcagccggcaggcgcctgtgaatacagctactgtgaggatgagtcggccactggtggctgccctttcgggccctaccagggccgccagaccagcagcatcttcgaggcagcaaagcaggagctggccaagctgatgcggattgaggacccctccctcctgaacagcagagtcttgctgcaccacgccaaagctggcaccatcattgcccgccagggagaccaggacgtgagcctgcacttcgtgctctggggctgcctgcacgtgtaccagcgcatgatcgacaaggcggaggacgtgtgcctgttcgtagcgcagcccggggaactggtggggcagctggcggtgctcactggcgaacctctcatcttcacactgcgagcccaacgcgactgcaccttcctgcggatctccaagtccgacttctatgagatcatgcgcgcacagcccagtgtggtgctgagtgcggcgcacacggtggcagccaggatgtcgcccttcgtgcgccagatggacttcgccatcgactggactgcagtggaggcgggacgcgcgctgtacaggcagggcgaccgctccgactgcacttacatcgtgctcaatgggcggctgcgtagcgtgatccagcgaggcagtggcaagaaggagctggtgggcgagtacggccgcggcgacctcatcggcgtggtggaggcactgacccggcagccgcgagccacgacggtgcacgcggtgcgcgacacggagctggccaagcttcccgagggcaccttgggtcacatcaaacgccggtacccgcaggtcgtgacccgccttatccacctactgagccagaaaattctagggaatttgcagcagctgcaaggacccttcccagcaggctctgggttgggtgtgcccccacactcggaactcaccaacccagccagcaacctggcaactgtggcaatcctgcctgtgtgtgctgaggtccccatggtggccttcacgctggagctgcagcacgccctgcaggccatcggtccgacgctactccttaacagtgacatcatccgggcacgcctgggggcctccgcactggatagcatccaagagttccggctgtcagggtggctggcccagcaggaggatgcacaccgtatcgtactctaccagacggacgcctcgctgacgccctggaccgtgcgctgcctgcgacaggccgactgcatcctcattgtgggcctgggggaccaggagcctaccctcggccagctggagcagatgctggagaacacggctgtgcgcgcccttaagcagctagtcctgctccaccgagaggagggcgcgggccccacgcgcaccgtggagtggctaaatatgcgcagctggtgctcggggcacctgcacctgcgctgtccgcgccgcctcttttcgcgccgcagccctgccaagctgcatgagctctacgagaaggttttctccaggcgcgcggaccggcacagcgacttctcccgcttggcgagggtgctcacggggaacaccattgcccttgtgctaggcgggggcggggccaggggctgctcgcacatcggagtactaaaggcattagaggaggcgggggtccccgtggacctggtgggcggcacgtccattggctctttcatcggagcgttgtacgcggaggagcgcagcgccagccgcacgaagcagcgggcccgggagtgggccaagagcatgacttcggtgctggaacctgtgttggacctcacgtacccagtcacctccatgttcactgggtctgcctttaaccgcagcatccatcgggtcttccaggataagcagattgaggacctgtggctgccttacttcaacgtgaccacagatatcaccgcctcagccatgcgagtccacaaagatggctccctgtggcggtacgtgcgcgccagcatgacgctgtcgggctacctgcccccgctgtgcgaccccaaggacgggcacctactcatggatggcggctacatcaacaatctgccagcggacatcgcccgcagcatgggtgccaaaacggtcatcgccattgacgtggggagccaggatgagacggacctcagcacctacggggacagcctgtccggctggtggctgctgtggaagcggctgaatccctgggctgacaaggtaaaggttccagacatggctgaaatccagtcccgcctggcctacgtgtcctgtgtgcggcagctagaggttgtcaagtccagctcctactgcgagtacctgcgcccgcccatcgactgcttcaagaccatggactttgggaagttcgaccagatctatgatgtgggctaccagtacgggaaggcggtgtttggaggctggagccgtggcaacgtcattgagaaaatgctcacagaccggcggtctacagaccttaatgagagccgccgtgcagacgtgcttgccttcccaagctctggcttcactgacttggcagagattgtgtcccggattgagccccccacgagctatgtctctgatggctgtgctgacggagaggagtcagattgtctgacagagtatgaggaggacgccggacccgactgctcgagggatgaaggggggtcccccgagggcgcaagccccagcactgcctccgagatggaggaggagaagtcgattctccggcaacgacgctgtctgccccaggagccgcccggctcagccacagatgcctgaggacctcgacaggggtcaccccctccctcccacccctggactgggctgggggtggccccgtgggggtagctcactccccctcctgctgctatgcctgtgacccccgcggcccacacactggactgacctgccctgagcggggatgcagtgttgcactgatgacttgaccagcccctcccccaataaactcgcctcttgg

SEQ ID NO: 163884 - DNA, 4502 bp, Homo sapiens
  Payload ID: 12270
  Gene Symbol: PNPLA6
  Gene Name: patatin-like phospholipase domain containing 6
  Uniprot ID: Q8IY17
  ENST ID: ENST00000545201
  CDS Start-End: 401-4303
gagtctgggtttccgttagcctcgcaggggtgtcccttcgagggtcgttagcgagcctccgctttcccacgatctgtcctccgattcctgttaactctagactttctgatgttcccataccccccacgtctcggcaggtgtttccacaccggtagccagctgtgccctgaggtggaagaggaccggccacccaggaattttccaacaatggcgccaccatcggtcccggagtcccagtgatgctctgtgccatagagcccccataacttcactactacgtgatagtaaatccccggcaaaaaccagcagcgccttgcaagcccacgccaccccaagcatcccaggactcttctgaaacgactccgggctaccagatcggccgtccagctggaatcaaccgatggaggctccgctgcaaactggaatggtgcttggcgtgatgatcggggccggagtggcggtggtggtcacggccgtgctcatcctcctggtggtgcggaggctgcgagtgccaaaaaccccagccccggatggcccccggtatcggttccggaagagggacaaagtgctcttctatggccggaagattatgcggaaggtgtcacaatccacctcctccctcgtggatacctctgtctccgccacctcccggccacgcatgaggaagaaactgaagatgctcaacattgccaagaagatcctgcgcatccagaaagagacgcccacgctgcagcggaaggagcccccgcccgcagtgctagaagctgacctgaccgagggcgacctggctaactcccatctgccctctgaagtgctttatatgctcaagaacgtccgggtgctgggccacttcgagaagccactcttcctggagctctgccgccacatggtcttccagcggctgggccagggtgactacgtcttccggccgggccagccagatgccagcatctacgtggtgcaggacgggctgctggagctctgtctgccagggcctgacgggaaggagtgtgtggtgaaggaagtggttcctggggacagcgtcaacagccttctcagcatcctggatgtcatcaccggtcaccagcatccccagcggaccgtgtctgcccgggcggcccgggactccacggtgctgcgcctgccggtggaagcattctccgcggtcttcaccaagtacccggagagcttggtgcgggtcgtgcagatcatcatggtgcggctgcagcgagtcaccttcctggcactgcacaactacctgggtctgaccaatgagctcttcagccacgagatccagcccctgcgtctgttccccagccccggcctcccaactcgcaccagccctgtgcggggctccaagagaatggtcagcacctcagctacagacgagcccagggagaccccagggcggccacccgatcccaccggggccccgctgcctggacctacaggggaccctgtgaagcccacatccctggaaaccccctcggcccctctgctgagccgctgcgtctccatgccaggggacatctcaggcttgcagggtggcccccgctccgacttcgacatggcctatgagcgtggccggatctccgtgtccctgcaggaagaggcctccggggggtccctggcagcccccgctcggacccccactcaggagcctcgtgagcagccggcaggcgcctgtgaatacagctactgtgaggatgagtcggccactggtggctgccctttcgggccctaccagggccgccagaccagcagcatcttcgaggcagcaaagcaggagctggccaagctgatgcggattgaggacgtgagcctgcacttcgtgctctggggctgcctgcacgtgtaccagcgcatgatcgacaaggcggaggacgtgtgcctgttcgtagcgcagcccggggaactggtggggcagctggcggtgctcactggcgaacctctcatcttcacactgcgagcccaacgcgactgcaccttcctgcggatctccaagtccgacttctatgagatcatgcgcgcacagcccagtgtggtgctgagtgcggcgcacacggtggcagccaggatgtcgcccttcgtgcgccagatggacttcgccatcgactggactgcagtggaggcgggacgcgcgctgtacaggcagggcgaccgctccgactgcacttacatcgtgctcaatgggcggctgcgtagcgtgatccagcgaggcagtggcaagaaggagctggtgggcgagtacggccgcggcgacctcatcggcgtggtggaggcactgacccggcagccgcgagccacgacggtgcacgcggtgcgcgacacggagctggccaagcttcccgagggcaccttgggtcacatcaaacgccggtacccgcaggtcgtgacccgccttatccacctactgagccagaaaattctagggaatttgcagcagctgcaaggacccttcccaggctctgggttgggtgtgcccccacactcggaactcaccaacccagccagcaacctggcaactgtggcaatcctgcctgtgtgtgctgaggtccccatggtggccttcacgctggagctgcagcacgccctgcaggccatcggtccgacgctactccttaacagtgacatcatccgggcacgcctgggggcctccgcactggatagcatccaagagttccggctgtcagggtggctggcccagcaggaggatgcacaccgtatcgtactctaccagacggacgcctcgctgacgccctggaccgtgcgctgcctgcgacaggccgactgcatcctcattgtgggcctgggggaccaggagcctaccctcggccagctggagcagatgctggagaacacggctgtgcgcgcccttaagcagctagtcctgctccaccgagaggagggcgcgggccccacgcgcaccgtggagtggctaaatatgcgcagctggtgctcggggcacctgcacctgcgctgtccgcgccgcctcttttcgcgccgcagccctgccaagctgcatgagctctacgagaaggttttctccaggcgcgcggaccggcacagcgacttctcccgcttggcgagggtgctcacggggaacaccattgcccttgtgctaggcgggggcggggccaggggctgctcgcacatcggagtactaaaggcattagaggaggcgggggtccccgtggacctggtgggcggcacgtccattggctctttcatcggagcgttgtacgcggaggagcgcagcgccagccgcacgaagcagcgggcccgggagtgggccaagagcatgacttcggtgctggaacctgtgttggacctcacgtacccagtcacctccatgttcactgggtctgcctttaaccgcagcatccatcgggtcttccaggataagcagattgaggacctgtggctgccttacttcaacgtgaccacagatatcaccgcctcagccatgcgagtccacaaagatggctccctgtggcggtacgtgcgcgccagcatgacgctgtcgggctacctgcccccgctgtgcgaccccaaggacgggcacctactcatggatggcggctacatcaacaatctgccagcggacatcgcccgcagcatgggtgccaaaacggtcatcgccattgacgtggggagccaggatgagacggacctcagcacctacggggacagcctgtccggctggtggctgctgtggaagcggctgaatccctgggctgacaaggtaaaggttccagacatggctgaaatccagtcccgcctggcctacgtgtcctgtgtgcggcagctagaggttgtcaagtccagctcctactgcgagtacctgcgcccgcccatcgactgcttcaagaccatggactttgggaagttcgaccagatctatgatgtgggctaccagtacgggaaggcggtgtttggaggctggagccgtggcaacgtcattgagaaaatgctcacagaccggcggtctacagaccttaatgagagccgccgtgcagacgtgcttgccttcccaagctctggcttcactgacttggcagagattgtgtcccggattgagccccccacgagctatgtctctgatggctgtgctgacggagaggagtcagattgtctgacagagtatgaggaggacgccggacccgactgctcgagggatgaaggggggtcccccgagggcgcaagccccagcactgcctccgagatggaggaggagaagtcgattctccggcaacgacgctgtctgccccaggagccgcccggctcagccacagatgcctgaggacctcgacaggggtcaccccctccctcccacccctggactgggctgggggtggccccgtgggggtagctcactccccctcctgctgctatgcctgtgacccccgcggcccacacactggactgacctgccctgagcggggatgcagtgttgcactgatgacttgaccagcccctcccccaataaactcgcctcttgg

SEQ ID NO: 163885 - DNA, 669 bp, Homo sapiens
  Payload ID: 12270
  Gene Symbol: PNPLA6
  Gene Name: patatin-like phospholipase domain containing 6
  ENST ID: ENST00000599947
  CDS Start-End: 1-467
agcggctgaatccctgggctgacaaggtaaaggttccagacatggctgaaatccagtcccgcctggcctacgtgtcctgtgtgcggcagctagaggttgtcaagtccagctcctactgcgagtacctgcgcccgcccatcgactgcttcaagaccatggactttgggaagttcgaccagatctatgtgcttgccttcccaagctctggcttcactgacttggcagagattgtgtcccggattgagccccccacgagctatgtctctgatggctgtgctgacggagaggagtcagattgtctgacagagtatgaggaggacgccggacccgactgctcgagggatgaaggggggtcccccgagggcgcaagccccagcactgcctccgagatggaggaggagaagtcgattctccggcaacgacgctgtctgccccaggagccgcccggctcagccacagatgcctgaggacctcgacaggggtcaccccctccctcccacccctggactgggctgggggtggccccgtgggggtagctcactccccctcctgctgctatgcctgtgacccccgcggcccacacactggactgacctgccctgagcggggatgcagtgttgcactgatgacttgaccagcccctcccccaataaactcgcctcttggaaa

SEQ ID NO: 163886 - DNA, 584 bp, Homo sapiens
  Payload ID: 12270
  Gene Symbol: PNPLA6
  Gene Name: patatin-like phospholipase domain containing 6
  ENST ID: ENST00000593924
  CDS Start-End: 232-584
acggtttgcgggcccgttttcctggggtggggcattcagtcttcgacggagtagggggtgcggcctggggggtggggtggtcaggcttgatcaaccctgcagagggcagtgacccgggaggaagtcaccaggtgcagaggaccgtgccctgtggggacctgcctgcaggctgctgacagtgggtaccaggactccgggctaccagatcggccgtccagctggaatcaaccgatggaggctccgctgcaaactggaatggtgcttggcgtgatgatcggggccggagtggcggtggtggtcacggccgtgctcatcctcctggtggtgcggaggctgcgagtgccaaaaaccccagccccggatggcccccggtatcggttccggaagagggacaaagtgctcttctatggccggaagattatgcggaaggtgtcacaatccacctcctccctcgtggatacctctgtctccgccacctcccggccacgcatgaggaagaaactgaagatgctcaacattgccaagaagatcctgcgcatccagaaagagacgcccacgctgcagcggaaggagcccccgcccgc

SEQ ID NO: 163887 - DNA, 574 bp, Homo sapiens
  Payload ID: 12270
  Gene Symbol: PNPLA6
  Gene Name: patatin-like phospholipase domain containing 6
  ENST ID: ENST00000594551
  CDS Start-End: 1-574
ttatatgctcaagaacgtccgggtgctgggccacttcgagaagccactcttcctggagctctgccgccacatggtcttccagcggctgggccagggtgactacgtcttccggccgggccagccagatgccagcatctacgtggtgcaggacgggctgctggagctctgtctgccagggcctgacgggaaggagtgtgtggtgaaggaagtggttcctggggacagcgtcaacagccttctcagcatcctggatgtcatcacccatccccagcggaccgtgtctgcccgggcggcccgggactccacggtgctgcgcctgccggtggaagcattctccgcggtcttcaccaagtacccggagagcttggtgcgggtcgtgcagatcatcatggtgcggctgcagcgagtcaccttcctggcactgcacaactacctgggtctgaccaatgagctcttcagccacgagatccagcccctgcgtctgttccccagccccggcctcccaactcgcaccagccctgtgcggggctccaagagaatggtcagcacctcagctacagacgagcccagggag

SEQ ID NO: 163888 - DNA, 543 bp, Homo sapiens
  Payload ID: 12270
  Gene Symbol: PNPLA6
  Gene Name: patatin-like phospholipase domain containing 6
  ENST ID: ENST00000596515
  CDS Start-End: 429-543
agaaacatcctcagcttcccagaaaaatcccagtaatattccagcatctctcagtatcttccaaggagcccggacgccctccccaggcccgctctcataagcaccccaggaatgtgcccacccacctcctggttttcccagcagtagtattgtaatcctcagaatctcagtaactttccagtgaccccgcatccccacccactaatcccagcgtctctggttacgcctcccagcaatggcgccaccatcggtcccggagtcccagtgatgctctgtgccatagagcccccataacttcactactacgtgatagtaaatccccggcaaaaaccagcagcgccttgcaagcccacgccaccccaagcatcccaggactcttctgaaacgactccgggctaccagatcggccgtccagctggaatcaaccgatggaggctccgctgcaaactggaatggtgcttggcgtgatgatcggggccggagtggcggtggtggtcacggccgtgctcatcctcctggtggtgcggaggctgcgagtgccaa

SEQ ID NO: 163889 - DNA, 753 bp, Homo sapiens
  Payload ID: 12270
  Gene Symbol: PNPLA6
  Gene Name: patatin-like phospholipase domain containing 6
  ENST ID: ENST00000601668
  CDS Start-End: 351-753
gtgaataatttaaaggggccgtgcctgcggagccgggcggaacgctagcggtgttggcgcggagtggaccccggctgcggcccctgggtgtttccacaccggtagccagctgtgccctgaggtggaagaggaccggccacccaggaattttccaacaatggcgccaccatcggtcccggagtcccagtgatgctctgtgccatagagcccccataacttcactactacgtgatagtaaatccccggcaaaaaccagcagcgccttgcaagcccacgccaccccaagcatcccaggactcttctgaaacgactccgggctaccagatcggccgtccagctggaatcaaccgatggaggctccgctgcaaactggaatggtgcttggcgtgatgatcggggccggagtggcggtggtggtcacggccgtgctcatcctcctggtggtgcggaggctgcgagtgccaaaaaccccagccccggatggcccccggtatcggttccggaagagggacaaagtgctcttctatggccggaagattatgcggaaggtgtcacaatccacctcctccctcgtggatacctctgtctccgccacctcccggccacgcatgaggaagaaactgaagatgctcaacattgccaagaagatcctgcgcatccagaaagagacgcccacgctgcagcggaaggagcccccgcccgcagtgctagaagctgacctgaccgagggcgacctggctaactcccatctgc

SEQ ID NO: 163890 - DNA, 800 bp, Homo sapiens
  Payload ID: 12270
  Gene Symbol: PNPLA6
  Gene Name: patatin-like phospholipase domain containing 6
  ENST ID: ENST00000595264
  CDS Start-End: 1-800
aagctgacctgaccgagggcgacctggctaactcccatctgccctctgaagtgctttatatgctcaagaacgtccgggtgctgggccacttcgagaagccactcttcctggagctctgccgccacatggtcttccagcggctgggccagggtgactacgtcttccggccgggccagccagatgccagcatctacgtggtgcaggacgggctgctggagctctgtctgccagggcctgacgggaaggagtgtgtggtgaaggaagtggttcctggggacagcgtcaacagccttctcagcatcctggatgtcatcaccggtcaccagcatccccagcggaccgtgtctgcccgggcggcccgggactccacggtgctgcgcctgccggtggaagcattctccgcggtcttcaccaagtacccggagagcttggtgcgggtcgtgcagatcatcatggtgcggctgcagcgagtcaccttcctggcactgcacaactacctgggtctgaccaatgagctcttcagccacgagatccagcccctgcgtctgttccccagccccggcctcccaactcgcaccagccctgtgcggggctccaagagaatggtcagcacctcagctacagacgagcccagggagaccccagggcggccacccgatcccaccggggccccgctgcctggacctacaggcttgcagggtggcccccgctccgacttcgacatggcctatgagcgtggccggatctccgtgtccctgcaggaagaggcctccggggggtccctggcagcccccgctcgg

SEQ ID NO: 163891 - DNA, 562 bp, Homo sapiens
  Payload ID: 12270
  Gene Symbol: PNPLA6
  Gene Name: patatin-like phospholipase domain containing 6
  ENST ID: ENST00000600942
  CDS Start-End: 102-562
tgcctcccagctcctgggtcttccccggggcaggcttgcgtcgggagccgagtatctaggactccgggctaccagatcggccgtccagctggaatcaaccgatggaggctccgctgcaaactggaatggtgcttggcgtgatgatcggggccggagtggcggtggtggtcacggccgtgctcatcctcctggtggtgcggaggctgcgagtgccaaaaaccccagccccggatggcccccggtatcggttccggaagagggacaaagtgctcttctatggccggaagattatgcggaaggtgtcacaatccacctcctccctcgtggatacctctgtctccgccacctcccggccacgcatgaggaagaaactgaagatgctcaacattgccaagaagatcctgcgcatccagaaagagacgcccacgctgcagcggaaggagcccccgcccgcagtgctagaagctgacctgaccgagggcgacctggctaactcccatctgccctctgaagtgctttatatgctcaagaacgtccgggtgctgggccacttcgagaagcc

SEQ ID NO: 163892 - DNA, 866 bp, Homo sapiens
  Payload ID: 12270
  Gene Symbol: PNPLA6
  Gene Name: patatin-like phospholipase domain containing 6
  ENST ID: ENST00000601001
  CDS Start-End: 324-866
agcggtgttggcgcggagtggaccccggctgcggcccctggcaatggcgccaccatcggtcccggagtcccagtgatgctctgtgccatagagcccccataacttcactactacgtgatagtaaatccccggcaaaaaccagcagcgccttgcaagcccacgccaccccaagcatcccaggactcttctgaaacagggcagtgacccgggaggaagtcaccaggtgcagaggaccgtgccctgtggggacctgcctgcaggctgctgacagtgggtaccaggactccgggctaccagatcggccgtccagctggaatcaaccgatggaggctccgctgcaaactggaatggtgcttggcgtgatgatcggggccggagtggcggtggtggtcacggccgtgctcatcctcctggtggtgcggaggctgcgagtgccaaaaaccccagccccggatggcccccggtatcggttccggaagagggacaaagtgctcttctatggccggaagattatgcggaaggtgtcacaatccacctcctccctcgtggatacctctgtctccgccacctcccggccacgcatgaggaagaaactgaagatgctcaacattgccaagaagatcctgcgcatccagaaagagacgcccacgctgcagcggaaggagcccccgcccgcagtgctagaagctgacctgaccgagggcgacctggctaactcccatctgccctctgaagtgctttatatgctcaagaacgtccgggtgctgggccacttcgagaagccactcttcctggagctctgccgccacatggtcttccagcggctgggccagggtgactacgtcttccggccgggccagccagat

SEQ ID NO: 163893 - DNA, 4195 bp, Homo sapiens
  Payload ID: 12270
  Gene Symbol: PNPLA6
  Gene Name: patatin-like phospholipase domain containing 6
  Uniprot ID: Q8IY17
  ENST ID: ENST00000600737
  CDS Start-End: 84-4181
tttcccggcatgcactgcgggccgccgggcctcagggaagagtcgcgcccccggggagggagcagcactggcccattctgcagatggggacatcgagtcacgggctggctacgaactcctcgggggcgaaggtggcggagagggatgggttccaggacgtcctggcgcccggggaaggctcggcgggacggatttgcggtgcgcagccagtgccgttcgtccctcaggtgcttggcgtgatgatcggggccggagtggcggtggtggtcacggccgtgctcatcctcctggtggtgcggaggctgcgagtgccaaaaaccccagccccggatggcccccggtatcggttccggaagagggacaaagtgctcttctatggccggaagattatgcggaaggtgtcacaatccacctcctccctcgtggatacctctgtctccgccacctcccggccacgcatgaggaagaaactgaagatgctcaacattgccaagaagatcctgcgcatccagaaagagacgcccacgctgcagcggaaggagcccccgcccgcagtgctagaagctgacctgaccgagggcgacctggctaactcccatctgccctctgaagtgctttatatgctcaagaacgtccgggtgctgggccacttcgagaagccactcttcctggagctctgccgccacatggtcttccagcggctgggccagggtgactacgtcttccggccgggccagccagatgccagcatctacgtggtgcaggacgggctgctggagctctgtctgccagggcctgacgggaaggagtgtgtggtgaaggaagtggttcctggggacagcgtcaacagccttctcagcatcctggatgtcatcaccggtcaccagcatccccagcggaccgtgtctgcccgggcggcccgggactccacggtgctgcgcctgccggtggaagcattctccgcggtcttcaccaagtacccggagagcttggtgcgggtcgtgcagatcatcatggtgcggctgcagcgagtcaccttcctggcactgcacaactacctgggtctgaccaatgagctcttcagccacgagatccagcccctgcgtctgttccccagccccggcctcccaactcgcaccagccctgtgcggggctccaagagaatggtcagcacctcagctacagacgagcccagggagaccccagggcggccacccgatcccaccggggccccgctgcctggacctacaggggaccctgtgaagcccacatccctggaaaccccctcggcccctctgctgagccgctgcgtctccatgccaggggacatctcaggcttgcagggtggcccccgctccgacttcgacatggcctatgagcgtggccggatctccgtgtccctgcaggaagaggcctccggggggtccctggcagcccccgctcggacccccactcaggagcctcgtgagcagccggcaggcgcctgtgaatacagctactgtgaggatgagtcggccactggtggctgccctttcgggccctaccagggccgccagaccagcagcatcttcgaggcagcaaagcaggagctggccaagctgatgcggattgaggacccctccctcctgaacagcagagtcttgctgcaccacgccaaagctggcaccatcattgcccgccagggagaccaggacgtgagcctgcacttcgtgctctggggctgcctgcacgtgtaccagcgcatgatcgacaaggcggaggacgtgtgcctgttcgtagcgcagcccggggaactggtggggcagctggcggtgctcactggcgaacctctcatcttcacactgcgagcccaacgcgactgcaccttcctgcggatctccaagtccgacttctatgagatcatgcgcgcacagcccagtgtggtgctgagtgcggcgcacacggtggcagccaggatgtcgcccttcgtgcgccagatggacttcgccatcgactggactgcagtggaggcgggacgcgcgctgtacaggcagggcgaccgctccgactgcacttacatcgtgctcaatgggcggctgcgtagcgtgatccagcgaggcagtggcaagaaggagctggtgggcgagtacggccgcggcgacctcatcggcgtggtggaggcactgacccggcagccgcgagccacgacggtgcacgcggtgcgcgacacggagctggccaagcttcccgagggcaccttgggtcacatcaaacgccggtacccgcaggtcgtgacccgccttatccacctactgagccagaaaattctagggaatttgcagcagctgcaaggacccttcccaggctctgggttgggtgtgcccccacactcggaactcaccaacccagccagcaacctggcaactgtggcaatcctgcctgtgtgtgctgaggtccccatggtggccttcacgctggagctgcagcacgccctgcaggccatcggtccgacgctactccttaacagtgacatcatccgggcacgcctgggggcctccgcactggatagcatccaagagttccggctgtcagggtggctggcccagcaggaggatgcacaccgtatcgtactctaccagacggacgcctcgctgacgccctggaccgtgcgctgcctgcgacaggccgactgcatcctcattgtgggcctgggggaccaggagcctaccctcggccagctggagcagatgctggagaacacggctgtgcgcgcccttaagcagctagtcctgctccaccgagaggagggcgcgggccccacgcgcaccgtggagtggctaaatatgcgcagctggtgctcggggcacctgcacctgcgctgtccgcgccgcctcttttcgcgccgcagccctgccaagctgcatgagctctacgagaaggttttctccaggcgcgcggaccggcacagcgacttctcccgcttggcgagggtgctcacggggaacaccattgcccttgtgctaggcgggggcggggccaggggctgctcgcacatcggagtactaaaggcattagaggaggcgggggtccccgtggacctggtgggcggcacgtccattggctctttcatcggagcgttgtacgcggaggagcgcagcgccagccgcacgaagcagcgggcccgggagtgggccaagagcatgacttcggtgctggaacctgtgttggacctcacgtacccagtcacctccatgttcactgggtctgcctttaaccgcagcatccatcgggtcttccaggataagcagattgaggacctgtggctgccttacttcaacgtgaccacagatatcaccgcctcagccatgcgagtccacaaagatggctccctgtggcggtacgtgcgcgccagcatgacgctgtcgggctacctgcccccgctgtgcgaccccaaggacgggcacctactcatggatggcggctacatcaacaatctgccagcggacatcgcccgcagcatgggtgccaaaacggtcatcgccattgacgtggggagccaggatgagacggacctcagcacctacggggacagcctgtccggctggtggctgctgtggaagcggctgaatccctgggctgacaaggtaaaggttccagacatggctgaaatccagtcccgcctggcctacgtgtcctgtgtgcggcagctagaggttgtcaagtccagctcctactgcgagtacctgcgcccgcccatcgactgcttcaagaccatggactttgggaagttcgaccagatctatgatgtgggctaccagtacgggaaggcggtgtttggaggctggagccgtggcaacgtcattgagaaaatgctcacagaccggcggtctacagaccttaatgagagccgccgtgcagacgtgcttgccttcccaagctctggcttcactgacttggcagagattgtgtcccggattgagccccccacgagctatgtctctgatggctgtgctgacggagaggagtcagattgtctgacagagtatgaggaggacgccggacccgactgctcgagggatgaaggggggtcccccgagggcgcaagccccagcactgcctccgagatggaggaggagaagtcgattctccggcaacgacgctgtctgccccaggagccgcccggctcagccacagatgcctgaggacctcgacaggg

SEQ ID NO: 163894 - DNA, 4581 bp, Homo sapiens
  Payload ID: 12271
  Gene Symbol: PNPLA7
  Gene Name: patatin-like phospholipase domain containing 7
  Uniprot ID: Q6ZV29
  ENST ID: ENST00000277531
  CDS Start-End: 188-4141
aaaagacagcttttcttcctggagaacagactttttcagcaggattttcctttcagtgaaacataatttgacttgaaaggaacccagggaaaagtgtccaggtgtgagcatgagcgggtagaggtgtgcccttgtttgcttcaggctgtctgcttttcgcccctgactgttttttctgtttctggccatggaggaagagaaagatgacagcccacagctgacggggattgcagttggagccctcctggccctggccttggttggtgtcctcatccttttcatgttcagaaggcttagacaatttcgacaagcacagcccactcctcagtaccggttccggaagagagacaaagtgatgttttacggccggaagatcatgaggaaggtgaccacactccccaacacccttgtggagaacactgccctgccccggcagcgggccaggaagaggaccaaggtgctgtctttggccaagaggattctgcgtttcaagaaggaatacccggccctgcagcccaaggagcccccgccctccctgctggaggccgacctcacggagtttgacgtgaagaattctcacctgccatcggaagttctgtacatgctgaaaaacgttcgggtcctgggccactttgagaagccgctgttcctggagctttgcaaacacatcgtctttgtgcagctgcaggaaggggagcacgtcttccagcccagggagccggaccccagcatctgtgtggtgcaggacgggcggctggaggtctgcatccaggacactgacggcaccgaggtggtggtgaaagaggttctggcgggagacagcgtccacagcctgctcagcatcctggacatcatcaccggccatgctgcaccttacaaaacggtctccgtccgcgcggccatcccgtccaccatcctccggcttccagctgcggcttttcatggagtttttgagaaatatccggaaactctggtgagggtggtgcagatcatcatggtgcggctgcagagggtgacctttctggctctgcacaactacctcggcctgaccacagagctcttcaacgctgagagccaggccatccctctcgtgtctgtagccagtgtggctgccgggaaggccaagaagcaggtgttctatggcgaagaagagcggcttaaaaagccaccgcggctccaggagtcctgtgactcagatcacgggggcggccgcccggcagctgctgggcccctgctgaagaggagccactccgtccccgcgccttccattcgcaaacagatcttggaggagctggagaagcccggggcaggtgaccctgacccttcggccccacaagggggcccaggcagtgccacttctgatctggggatggcatgtgaccgtgccagggtcttcctgcactcggacgagcaccccgggagctccgtggccagcaagtccaggaaaagcgtgatggttgcagagataccctccacggtctcccagcactcagagagtcacacggatgagaccctggccagcaggaagtcggatgccatcttcagagctgccaagaaggacctgctcaccctgatgaagctggaagactcatctctgttggatggccgggtggcgcttctgcacgttcctgcaggcacggtggtgtcaaggcagggagaccaggacgccagcatcctgttcgtggtctcggggctgctgcacgtgtaccagcggaagatcggcagccaggaggacacctgcttgttcctcacgcgccccggggagatggtgggccagctggccgtgctcaccggggagcctctcatcttcaccgtcaaggccaacagggactgcagcttcctgtccatctccaaggcccacttctatgaaatcatgcggaagcagccgaccgtcgtcctgggtgtggcgcacactgtggtgaagaggatgtcgtccttcgtgcggcaaatcgactttgccctggactgggtggaggtggaggccgggcgagcaatatacaggcagggggacaagtccgactgcacgtacatcatgctcagcggccggctgcgctctgtgatccggaaggatgatgggaagaagcgcctggccggggagtacggccgaggagacctcgtcggcgtggtggagacactgacccaccaggcccgggcgaccacggtgcatgccgttcgggactcagaattggccaagctgccggcaggagccctcacgtccatcaagcgcaggtacccacaggtggtgactcggctgattcatctcttgggtgagaagatcctgggcagcctccagcagggacctgtgacaggccaccagcttgggctccccacggagggcagcaagtgggacttggggaacccggctgtcaacctgtccacggtggcagtgatgcccgtgtcagaggaagtgcccctcaccgccttcgccctggagctggagcatgccctcagcgccatcggcccgaccctgctgctgactagtgacaacataaaacggcgccttggctccgctgccctggacagtgttcacgagtaccggctgtccagctggctggggcagcaggaggacacccacaggatcgtgctctaccaggcagatggcacgctcacaccctggacccagcgctgcgtgcgccaggccgactgcatcctcatcgtgggcctgggtgaccaggagcccacagtgggcgagctggagcggatgctggagagcacagctgtgcgtgcccagaagcagctgatcctgctgcacagggaggagggcccggcgccagcgcgcaccgtggagtggctcaacatgcggagctggtgctccggccacctgcacctctgctgcccgcgccgcgtcttctccaggaggagcctgcccaagctggtggagatgtacaagcatgtcttccagcggcccccggaccgacactcagacttctcccgcctggcgagggtgctgacgggcaacgccattgccctggtgcttgggggagggggagcaagaggctgtgcccaggtgggcgttctcaaggccttggcggagtgcggcatccctgtggacatggtgggaggcacgtccatcggggccttcgtgggtgccctgtactctgaggagcggaactacagccagatgcggatccgggccaagcagtgggccgagggcatgacgtccttgatgaaggccgcgctggacctcacctaccccatcacgtccatgttctccggagccggcttcaacagcagcatcttcagcgtcttcaaggaccagcagatcgaggacctgtggattccttatttcgccatcaccaccgacatcacagcctcggccatgcgggtccacaccgacggctccctgtggtggtacgtgcgtgccagcatgtccctgtccggttacatgccccctctctgtgacccgaaggacggacacctgctgatggacgggggctacatcaacaacctcccagcggatgtggcccggtccatgggggcaaaagtggtgatcgccattgacgtgggcagccgagatgagacggacctcaccaactatggggatgcgctgtctgggtggtggctgctgtggaaacgctggaaccccttggccacgaaagtcaaggtgttgaacatggcagagattcagacgcgcctggcctacgtgtgttgcgtgcggcagctggaggtggtgaagagcagtgactactgcgagtacctgcgcccccccatcgacagctacagcaccctggacttcggcaagttcaacgagatctgcgaagtgggctaccagcacgggcgcacggtgtttgacatctggggccgcagcggcgtgctggagaagatgctccgcgaccagcaggggccgagcaagaagcccgcgagtgcggtcctcacctgtcccaacgcctccttcacggaccttgccgaaattgtgtctcgcattgagcccgccaagcccgccatggtggatgacgaatctgactaccagacggagtacgaggaggagctgctggacgtccccagggatgcatacgcagacttccagagcacctcagcccagcagggctcagacttggaggacgagtcctcactgcggcatcgacaccccagtctggctttcccaaaactgtctgagggctcctctgaccaggacgggtagaggcctctgctaaagagcccggatgcagcgtcttccgtgggactgtccccaaggctgaggctcctgccaagtcctaggggcctctgtacctgccctgctggaagccctgacttccccggggccccaggctgtgttagggttctctgggcctcttctttgtaccagcagccctgcatacagggccctgtgagcccccctgcagtcctgtgaggcccctgaagctctgtgaggcccctgaagctctgtgaaccccctgcagccctgtgaggccccccgaagccctgtgaggccccccgaagccctgtgaaccacctgctgccctgtgaggcccccaaagccctgtgaactgcctgctgtcctgtgaactgcctgctgccctgtgaggtgtgggagccctgatgctgccgtgtgatgtttcaataaaggtggatctcactgtt

SEQ ID NO: 163895 - DNA, 4806 bp, Homo sapiens
  Payload ID: 12271
  Gene Symbol: PNPLA7
  Gene Name: patatin-like phospholipase domain containing 7
  Uniprot ID: Q6ZV29
  ENST ID: ENST00000406427
  CDS Start-End: 338-4366
gctgcccccatccccgccgcgctgggcctggctcctcttgacctgcttggatacgccccatctggctgctgttctgggttccgggacagccacgtgagggctgtttacagagggaaggaggtggctcctagcagatgacagacacttctcaaaagacagcttttcttcctggagaacagactttttcagcaggattttcctttcagtgaaacataatttgacttgaaaggaacccagggaaaagtgtccaggtgtgagcatgagcgggtagaggtgtgcccttgtttgcttcaggctgtctgcttttcgcccctgactgttttttctgtttctggccatggaggaagagaaagatgacagcccacaggctgacttctgcctgggcaccgccctgcactcttggggactgtggttcacggaggaaggttcaccgtccaccatgctgacggggattgcagttggagccctcctggccctggccttggttggtgtcctcatccttttcatgttcagaaggcttagacaatttcgacaagcacagcccactcctcagtaccggttccggaagagagacaaagtgatgttttacggccggaagatcatgaggaaggtgaccacactccccaacacccttgtggagaacactgccctgccccggcagcgggccaggaagaggaccaaggtgctgtctttggccaagaggattctgcgtttcaagaaggaatacccggccctgcagcccaaggagcccccgccctccctgctggaggccgacctcacggagtttgacgtgaagaattctcacctgccatcggaagttctgtacatgctgaaaaacgttcgggtcctgggccactttgagaagccgctgttcctggagctttgcaaacacatcgtctttgtgcagctgcaggaaggggagcacgtcttccagcccagggagccggaccccagcatctgtgtggtgcaggacgggcggctggaggtctgcatccaggacactgacggcaccgaggtggtggtgaaagaggttctggcgggagacagcgtccacagcctgctcagcatcctggacatcatcaccggccatgctgcaccttacaaaacggtctccgtccgcgcggccatcccgtccaccatcctccggcttccagctgcggcttttcatggagtttttgagaaatatccggaaactctggtgagggtggtgcagatcatcatggtgcggctgcagagggtgacctttctggctctgcacaactacctcggcctgaccacagagctcttcaacgctgagagccaggccatccctctcgtgtctgtagccagtgtggctgccgggaaggccaagaagcaggtgttctatggcgaagaagagcggcttaaaaagccaccgcggctccaggagtcctgtgactcagatcacgggggcggccgcccggcagctgctgggcccctgctgaagaggagccactccgtccccgcgccttccattcgcaaacagatcttggaggagctggagaagcccggggcaggtgaccctgacccttcggccccacaagggggcccaggcagtgccacttctgatctggggatggcatgtgaccgtgccagggtcttcctgcactcggacgagcaccccgggagctccgtggccagcaagtccaggaaaagcgtgatggttgcagagataccctccacggtctcccagcactcagagagtcacacggatgagaccctggccagcaggaagtcggatgccatcttcagagctgccaagaaggacctgctcaccctgatgaagctggaagactcatctctgttggatggccgggtggcgcttctgcacgttcctgcaggcacggtggtgtcaaggcagggagaccaggacgccagcatcctgttcgtggtctcggggctgctgcacgtgtaccagcggaagatcggcagccaggaggacacctgcttgttcctcacgcgccccggggagatggtgggccagctggccgtgctcaccggggagcctctcatcttcaccgtcaaggccaacagggactgcagcttcctgtccatctccaaggcccacttctatgaaatcatgcggaagcagccgaccgtcgtcctgggtgtggcgcacactgtggtgaagaggatgtcgtccttcgtgcggcaaatcgactttgccctggactgggtggaggtggaggccgggcgagcaatatacaggcagggggacaagtccgactgcacgtacatcatgctcagcggccggctgcgctctgtgatccggaaggatgatgggaagaagcgcctggccggggagtacggccgaggagacctcgtcggcgtggtggagacactgacccaccaggcccgggcgaccacggtgcatgccgttcgggactcagaattggccaagctgccggcaggagccctcacgtccatcaagcgcaggtacccacaggtggtgactcggctgattcatctcttgggtgagaagatcctgggcagcctccagcagggacctgtgacaggccaccagcttgggctccccacggagggcagcaagtgggacttggggaacccggctgtcaacctgtccacggtggcagtgatgcccgtgtcagaggaagtgcccctcaccgccttcgccctggagctggagcatgccctcagcgccatcggcccgaccctgctgctgactagtgacaacataaaacggcgccttggctccgctgccctggacagtgttcacgagtaccggctgtccagctggctggggcagcaggaggacacccacaggatcgtgctctaccaggcagatggcacgctcacaccctggacccagcgctgcgtgcgccaggccgactgcatcctcatcgtgggcctgggtgaccaggagcccacagtgggcgagctggagcggatgctggagagcacagctgtgcgtgcccagaagcagctgatcctgctgcacagggaggagggcccggcgccagcgcgcaccgtggagtggctcaacatgcggagctggtgctccggccacctgcacctctgctgcccgcgccgcgtcttctccaggaggagcctgcccaagctggtggagatgtacaagcatgtcttccagcggcccccggaccgacactcagacttctcccgcctggcgagggtgctgacgggcaacgccattgccctggtgcttgggggagggggagcaagaggctgtgcccaggtgggcgttctcaaggccttggcggagtgcggcatccctgtggacatggtgggaggcacgtccatcggggccttcgtgggtgccctgtactctgaggagcggaactacagccagatgcggatccgggccaagcagtgggccgagggcatgacgtccttgatgaaggccgcgctggacctcacctaccccatcacgtccatgttctccggagccggcttcaacagcagcatcttcagcgtcttcaaggaccagcagatcgaggacctgtggattccttatttcgccatcaccaccgacatcacagcctcggccatgcgggtccacaccgacggctccctgtggtggtacgtgcgtgccagcatgtccctgtccggttacatgccccctctctgtgacccgaaggacggacacctgctgatggacgggggctacatcaacaacctcccagcggatgtggcccggtccatgggggcaaaagtggtgatcgccattgacgtgggcagccgagatgagacggacctcaccaactatggggatgcgctgtctgggtggtggctgctgtggaaacgctggaaccccttggccacgaaagtcaaggtgttgaacatggcagagattcagacgcgcctggcctacgtgtgttgcgtgcggcagctggaggtggtgaagagcagtgactactgcgagtacctgcgcccccccatcgacagctacagcaccctggacttcggcaagttcaacgagatctgcgaagtgggctaccagcacgggcgcacggtgtttgacatctggggccgcagcggcgtgctggagaagatgctccgcgaccagcaggggccgagcaagaagcccgcgagtgcggtcctcacctgtcccaacgcctccttcacggaccttgccgaaattgtgtctcgcattgagcccgccaagcccgccatggtggatgacgaatctgactaccagacggagtacgaggaggagctgctggacgtccccagggatgcatacgcagacttccagagcacctcagcccagcagggctcagacttggaggacgagtcctcactgcggcatcgacaccccagtctggctttcccaaaactgtctgagggctcctctgaccaggacgggtagaggcctctgctaaagagcccggatgcagcgtcttccgtgggactgtccccaaggctgaggctcctgccaagtcctaggggcctctgtacctgccctgctggaagccctgacttccccggggccccaggctgtgttagggttctctgggcctcttctttgtaccagcagccctgcatacagggccctgtgagcccccctgcagtcctgtgaggcccctgaagctctgtgaggcccctgaagctctgtgaaccccctgcagccctgtgaggccccccgaagccctgtgaggccccccgaagccctgtgaaccacctgctgccctgtgaggcccccaaagccctgtgaactgcctgctgtcctgtgaactgcctgctgccctgtgaggtgtgggagccctgatgctgccgtgtgatgtttcaataaaggtggatctcactgtt

SEQ ID NO: 163896 - DNA, 874 bp, Homo sapiens
  Payload ID: 12271
  Gene Symbol: PNPLA7
  Gene Name: patatin-like phospholipase domain containing 7
  ENST ID: ENST00000491019
  CDS Start-End: 42-644
ccctcctggccctggccttggttggtgtcctcatccttttcatgttcagaaggcttagacaatttcgacaagcacagcccactcctcagtaccggttccggaagagagacaaagtgatgttttacggccggaagatcatgaggaaggtgaccacactccccaacacccttgtggagaacactgccctgccccggcagcgggccaggaagaggaccaaggtgctgtctttggccaagaggattctgcgtttcaagaaggaatacccggccctgcagcccaaggagcccccgccctccctgctggaggccgacctcacggagtttgacgtgaagaattctcacctgccatcggaagttctgtacatgctgaaaaacgttcgggtcctgggccactttgagaagccgctgttcctggagctttgcaaacacatcgtctttgtgcagctgcaggaaggggagcacgtcttccagcccagggagccggaccccagcatctgtgtggtgcaggacgggcggctggaggtctgcatccaggacactgtgcctgctgctctcatggcgcctcagaggtgcaggcccgtggccccactgccctgggctgggctgagcctccgccaggccccgcggtcgcagccccagacctgacggcacccactctgctctccaagcgcaggacggcaccgaggtggtggtgaaagaggttctggcgggagacagcgtccacagcctgctcagcatcctggacatcatcaccggccatgctgcaccttacaaaacggtctccgtccgcgcggccatcccgtccaccatcctccggcttccagctgcggcttttcatggagtttttgagaaatatccggaaactctggtgaggg

SEQ ID NO: 163897 - DNA, 3490 bp, Homo sapiens
  Payload ID: 12272
  Gene Symbol: PNPLA8
  Gene Name: patatin-like phospholipase domain containing 8
  Uniprot ID: Q9NP80
  ENST ID: ENST00000257694
  CDS Start-End: 296-2644
acttccgctgggggcggagcggggcggggctgagtgggtggcgacctagctgctgcgccagtgtttgtgttggaagctcagctgatgcaggccggttggagtggacgtcattgccgggaacgagcgagtcgccgctgcagccctagtgactgcggcctgcatcccgattgtcttctcctccaaggtctacatgattacctgaagtttaataagtaagaccatgaattatggcatttcttaaatgaagcgttcaagaagtgagagaatgtcatagaaaataaatgatttttaagttatgtctattaatctgactgtagatatatatatttacctccttagtaatgcaagaagtgtttgtgggaagcagagaagcaagcaactgtatttcttgttctcacctaagcattactggaggataagccacatcagtctacaaagaggttttcatacaaacataataagatgtaaatggaccaaaagtgaagcacattcttgcagtaagcactgttactctccaagcaaccatggtttacatattgggattttgaaacttagcacttctgctcccaagggacttacaaaagtgaacatttgtatgtcccgtattaaaagtactttgaactctgtttcaaaggctgtttttggcaatcaaaatgaaatgatttcacgtttagctcaatttaagccaagttcccaaattttaagaaaagtatcggatagtggctggttaaaacagaaaaacatcaaacaagccatcaaatctctgaaaaaatatagtgacaaatcagcagaaaagagtccttttccagaagagaaaagtcacattatagacaaagaagaagatataggtaaacgcagtctttttcattacacaagttctataaccacaaaatttggagactcattctactttttatcaaatcatattaattcatatttcaaacgtaaggaaaaaatgtctcaacaaaaggaaaatgaacatttccgggacaaatcagaacttgaagataaaaaggtagaagaggggaaattaagatctccagatcctggcatcctggcttataagccaggctcagaatctgtacatacggtggacaagcctacaagtccttctgcgatacctgatgttcttcaagtttcaactaaacaaagtattgctaactttctttctcgtcccacggaaggtgtacaagctttagtaggtggttatattggtggacttgtccccaaattaaagtatgattcaaagagtcagtcagaagaacaggaagagcctgctaaaactgatcaggctgtcagcaaagacagaaatgcagaggagaaaaagcgtttatctcttcagcgagaaaagattatcgcaagggtgagtattgataacaggacccgggcattagttcaggcattaagaagaacaactgacccaaagctctgcattactagggttgaagaactgacttttcatcttctagaatttcctgaaggaaaaggagtggctgtcaaggaaagaattattccatatttattacgactgagacaaattaaggatgaaactcttcaggctgcagttagagaaattttggccctaattggctatgtggatccagtgaaagggagaggaatccgaattctctcaattgatggtggaggaacaaggggcgtggttgctctccagaccctacgaaaattagttgaacttactcagaagccagttcatcagctctttgattacatttgtggtgtaagcacaggtgccatattagctttcatgttggggttgtttcatatgcccttggatgaatgtgaggaactttatcgaaaattaggatcagatgtattttcacaaaatgtcattgttggaacagtaaaaatgagttggagccatgcattttatgacagtcaaacatgggaaaacattcttaaggataggatgggatctgcactgatgattgaaacagcaagaaaccccacatgtcctaaggtagctgctgtaagtaccatagtaaatagagggataacacccaaagcttttgtgttcagaaactatggtcattttcctggaatcaactctcattatttgggaggctgtcagtataaaatgtggcaggccattagagcctcatctgctgctccaggctactttgcagaatatgcattgggaaatgatcttcatcaagatggaggtttgcttctgaataacccttcggcattagctatgcatgagtgtaaatgtctttggccagatgtgccgttagagtgcatagtatccctgggcactggacgttatgagagtgatgtgagaaacacggtaacatacacaagcttgaaaactaaactttctaatgttatcaacagtgctacagatacagaagaagtccatataatgcttgatggcctgttacctcctgacacctattttagattcaatcctgtaatgtgtgaaaacatacctctagatgaaagtcgaaatgaaaagctggatcagctgcagttggaagggttgaaatacatagaaagaaatgaacaaaaaatgaaaaaagttgcaaaaatattaagtcaagaaaaaacaactctgcagaaaattaatgattggataaaattaaaaactgatatgtatgaaggacttccattcttttcaaaattgtgatgagtatatgcttatgttctcataaatgaaggtctgtttagaagatcaaccacattcaataaggaattgtggggttcgacatgagttaactttgaaatacgtatgaattctggagaatcctgaaaaagacggtgcttcaaccagcttgcatagcacagagaatattcttggttacagaattcatatgggaactaggcttttaagatgttaataattagctaagctttagtaacccttactgtgctagtagattttagtagatattggtgttatattgtttgatgtttgaaaatatattaatatatgtgccgaacaagaaaccgaaagctatattgtactgtgtatttttactttagtcctcataatcatgttgaatttatgtgatcattgattttatttcatatggaaaagctaatttcttcttaaatttacattacctaatattctcactagctatgttctccaatccacactgccttttattgtaatatcatctaaatagatgcagaaaaatggaattttctctattaaagtattttacatttgacataaaaaagaaccagatacagttttctattcagatatgtttattttaacattgtttggttaaaaaaggtgaagttccagtcaaccactttttacccctgaaatttcaagataatgctatattaacttttccagatctaacactagcttattcttccctgttataaaatggtttgaacttactgaggagatattcctatcattaacaaaaataaactatttaaataatctgttgttaaaaggctaatgtcattttaaaattaatttttgttcataatgtagctcccctttagcctttga

SEQ ID NO: 163898 - DNA, 3366 bp, Homo sapiens
  Payload ID: 12272
  Gene Symbol: PNPLA8
  Gene Name: patatin-like phospholipase domain containing 8
  Uniprot ID: Q9NP80
  ENST ID: ENST00000453144
  CDS Start-End: 544-2592
atgctctattgcgcatatctcggggcgggggaggaacggagattgacaaggaggcagaggcctgagcgaggcggaaaatcctcaccccggcccgcgggtagacccaaacttctagcgcgtcacttccgctgggggcggagcggggcggggctgagtgggtggcgacctagctgctgcgccagtgtttgtgttggaagctcagctgatgcaggccggttggagtggacgtcattgccgggaacgagcgagtcgccgctgcagccctagtgactgcggcctgcatcccgtaatgcaagaagtgtttgtgggaagcagagaagcaagcaactgtatttcttgttctcacctaagcattactggaggataagccacatcagtctacaaagaggttttcatacaaacataataagatgtaaatggaccaaaagtgaagcacattcttgcagtaagcactgttactctccaagcaaccatggtttacatattgggattttgaaacttagcacttctgctcccaagggacttacaaaagtgaacatttgtatgtcccgtattaaaagtactttgaactctgtttcaaaggctgtttttggcaatcaaaatgaaatgatttcacgtttagctcaatttaagccaagttcccaaattttaagaaaagtatcggatagtggctggttaaaacagaaaaacatcaaacaagccatcaaatctctgaaaaaatatagtgacaaatcagcagaaaagagtccttttccagaagagaaaagtcacattatagacaaagaagaagatataggtaaacgcagtctttttcattacacaagttctataaccacaaaatttggagactcattctactttttatcaaatcatattaattcatatttcaaacgtaaggaaaaaatgtctcaacaaaaggaaaatgaacatttccgggacaaatcagaacttgaagataaaaaggtagaagaggggaaattaagatctccagatcctggcatcctggcttataagccaggctcagaatctgtacatacggtggacaagcctacaagtccttctgcgatacctgatgttcttcaagtttcaactaaacaaagtattgctaactttctttctcgtcccacggaaggtgtacaagctttagtaggtggttatattggtggacttgtccccaaattaaagtatgattcaaagagtcagtcagaagaacaggaagagcctgctaaaactgatcaggctgtcagcaaagacagaaatgcagaggagaaaaagcgtttatctcttcagcgagaaaagattatcgcaagggtgagtattgataacaggacccgggcattagttcaggcattaagaagaacaactgacccaaagctctgcattactagggttgaagaactgacttttcatcttctagaatttcctgaaggaaaaggagtggctgtcaaggaaagaattattccatatttattacgactgagacaaattaaggatgaaactcttcaggctgcagttagagaaattttggccctaattggctatgtggatccagtgaaagggagaggaatccgaattctctcaattgatggtggaggaacaaggggcgtggttgctctccagaccctacgaaaattagttgaacttactcagaagccagttcatcagctctttgattacatttgtggtgtaagcacaggtgccatattagctttcatgttggggttgtttcatatgcccttggatgaatgtgaggaactttatcgaaaattaggatcagatgtattttcacaaaatgtcattgttggaacagtaaaaatgagttggagccatgcattttatgacagtcaaacatgggaaaacattcttaaggataggatgggatctgcactgatgattgaaacagcaagaaaccccacatgtcctaaggtagctgctgtaagtaccatagtaaatagagggataacacccaaagcttttgtgttcagaaactatggtcattttcctggaatcaactctcattatttgggaggctgtcagtataaaatgtggcaggccattagagcctcatctgctgctccaggctactttgcagaatatgcattgggaaatgatcttcatcaagatggaggtttgcttctgaataacccttcggcattagctatgcatgagtgtaaatgtctttggccagatgtgccgttagagtgcatagtatccctgggcactggacgttatgagagtgatgtgagaaacacggtaacatacacaagcttgaaaactaaactttctaatgttatcaacagtgctacagatacagaagaagtccatataatgcttgatggcctgttacctcctgacacctattttagattcaatcctgtaatgtgtgaaaacatacctctagatgaaagtcgaaatgaaaagctggatcagctgcagttggaagggttgaaatacatagaaagaaatgaacaaaaaatgaaaaaagttgcaaaaatattaagtcaagaaaaaacaactctgcagaaaattaatgattggataaaattaaaaactgatatgtatgaaggacttccattcttttcaaaattgtgatgagtatatgcttatgttctcataaatgaaggtctgtttagaagatcaaccacattcaataaggaattgtggggttcgacatgagttaactttgaaatacgtatgaattctggagaatcctgaaaaagacggtgcttcaaccagcttgcatagcacagagaatattcttggttacagaattcatatgggaactaggcttttaagatgttaataattagctaagctttagtaacccttactgtgctagtagattttagtagatattggtgttatattgtttgatgtttgaaaatatattaatatatgtgccgaacaagaaaccgaaagctatattgtactgtgtatttttactttagtcctcataatcatgttgaatttatgtgatcattgattttatttcatatggaaaagctaatttcttcttaaatttacattacctaatattctcactagctatgttctccaatccacactgccttttattgtaatatcatctaaatagatgcagaaaaatggaattttctctattaaagtattttacatttgacataaaaaagaaccagatacagttttctattcagatatgtttattttaacattgtttggttaaaaaaggtgaagttccagtcaaccactttttacccctgaaatttcaagataatgctatattaacttttccagatctaacactagcttattcttccctgttataaaatggtttgaacttactgaggagatattcctatcattaacaaaaataaactatttaaataa

SEQ ID NO: 163899 - DNA, 568 bp, Homo sapiens
  Payload ID: 12272
  Gene Symbol: PNPLA8
  Gene Name: patatin-like phospholipase domain containing 8
  ENST ID: ENST00000415498
  CDS Start-End: 404-568
aggggatgaaagagcataagcggagagggaatggtggtgctctctccttgaccatactttagttaggctcctctgagccctcttcccaactaggcctcatccttgggcccctgtcttaggcctgctgagtccagttttagcaagaatcttgcaaagtcagtttagagagtatctcctagccttgataattgatcatctccgcctgtcttcagcaagaatcttagtgttatacagctggaatcatactgctatggtccgaatgtttgtgcctctcaaaattcatgtggaaatcataaccgctaaagtgatggtattaagaggtaagaccatgaattatggcatttcttaaatgaagcgttcaagaagtgagagaatgtcatagaaaataaatgatttttaagttatgtctattaatctgactgtagatatatatatttacctccttagtaatgcaagaagtgtttgtgggaagcagagaagcaagcaactgtatttcttgttctcacctaagcattactggaggataagccacatcagtctacaaagaggttttcatacaaacataata

SEQ ID NO: 163900 - DNA, 4268 bp, Homo sapiens
  Payload ID: 12272
  Gene Symbol: PNPLA8
  Gene Name: patatin-like phospholipase domain containing 8
  Uniprot ID: Q9NP80
  ENST ID: ENST00000426128
  CDS Start-End: 127-2289
gcgagtcgccgctgcagccctagtgactgcggcctgcatcccggtaagaccatgaattatggcatttcttaaatgaagcgttcaagaagtgagagaatgtcatagaaaataaatgatttttaagttatgtctattaatctgactgtagatatatatatttacctccttagtaatgcaagaagtgtttgtgggaagcagagaagcaagcaactgtatttcttgttctcacctaagcattactggaggataagccacatcagtctacaaagaggttttcatacaaacataataagatgtaaatggaccaaaagtgaagcacattcttgcagtaagcactgttactctccaagcaaccatggtttacatattgggattttgaaacttagcacttctgctcccaagggacttacaaaagtgaacatttgtatgtcccgtattaaaagtactttgaactctgtttcaaaggctgtttttggcaatcaaaatgaaatgatttcacgtttagctcaatttaagccaagttcccaaattttaagaaaagtatcggatagtggctggttaaaacagaaaaacatcaaacaagccatcaaatctctgaaaaaatatagtgacaaatcagcagaaaagagtccttttccagaagagaaaagtcacattatagacaaagaagaagatataggtaaacgcagtctttttcattacacaagttctataaccacaaaatttggagactcattctactttttatcaaatcatattaattcatatttcaaacgtaaggaaaaaatgtctcaacaaaaggaaaatgaacatttccgggacaaatcagaacttgaagataaaaaggtagaagaggggaaattaagatctccagatcctggcatcctggcttataagccaggctcagaatctgtacatacggtggacaagcctacaagtccttctgcgatacctgatgttcttcaagtttcaactaaacaaagtattgctaactttctttctcgtcccacggaaggtgtacaagctttagtaggtggttatattggtggacttgtccccaaattaaagtatgattcaaagagtcagtcagaagaacaggaagagcctgctaaaactgatcaggctgtcagcaaagacagaaatgcagaggagaaaaagcgtttatctcttcagcgagaaaagattatcgcaagggtgagtattgataacaggacccgggcattagttcaggcattaagaagaacaactgacccaaagctctgcattactagggttgaagaactgacttttcatcttctagaatttcctgaaggaaaaggagtggctgtcaaggaaagaattattccatatttattacgactgagacaaattaaggatgaaactcttcaggctgcagttagagaaattttggccctaattggctatgtggatccagtgaaagggagaggaatccgaattctctcaattgatggtggaggaacaaggggcgtggttgctctccagaccctacgaaaattagttgaacttactcagaagccagttcatcagctctttgattacatttgtggtgtaagcacaggtgccatattagctttcatgttggggttgtttcatatgcccttggatgaatgtgaggaactttatcgaaaattaggatcagatgtattttcacaaaatgtcattgttggaacagtaaaaatgagttggagccatgcattttatgacagtcaaacatgggaaaacattcttaaggataggatgggatctgcactgatgattgaaacagcaagaaaccccacatgtcctaaggtagctgctgatggaggtttgcttctgaataacccttcggcattagctatgcatgagtgtaaatgtctttggccagatgtgccgttagagtgcatagtatccctgggcactggacgttatgagagtgatgtgagaaacacggtaacatacacaagcttgaaaactaaactttctaatgttatcaacagtgctacagatacagaagaagtccatataatgcttgatggcctgttacctcctgacacctattttagattcaatcctgtaatgtgtgaaaacatacctctagatgaaagtcgaaatgaaaagctggatcagctgcagttggaagggttgaaatacatagaaagaaatgaacaaaaaatgaaaaaagttgcaaaaatattaagtcaagaaaaaacaactctgcagaaaattaatgattggataaaattaaaaactgatatgtatgaaggacttccattcttttcaaaattgtgatgagtatatgcttatgttctcataaatgaaggtctgtttagaagatcaaccacattcaataaggaattgtggggttcgacatgagttaactttgaaatacgtatgaattctggagaatcctgaaaaagacggtgcttcaaccagcttgcatagcacagagaatattcttggttacagaattcatatgggaactaggcttttaagatgttaataattagctaagctttagtaacccttactgtgctagtagattttagtagatattggtgttatattgtttgatgtttgaaaatatattaatatatgtgccgaacaagaaaccgaaagctatattgtactgtgtatttttactttagtcctcataatcatgttgaatttatgtgatcattgattttatttcatatggaaaagctaatttcttcttaaatttacattacctaatattctcactagctatgttctccaatccacactgccttttattgtaatatcatctaaatagatgcagaaaaatggaattttctctattaaagtattttacatttgacataaaaaagaaccagatacagttttctattcagatatgtttattttaacattgtttggttaaaaaaggtgaagttccagtcaaccactttttacccctgaaatttcaagataatgctatattaacttttccagatctaacactagcttattcttccctgttataaaatggtttgaacttactgaggagatattcctatcattaacaaaaataaactatttaaataatctgttgttaaaaggctaatgtcattttaaaattaatttttgttcataatgtagctcccctttagcctttgaatacacctggcagcagtatgcttaaaaataagaagttagttgcctggcgcagtagctcacacctgtaatcccagcactttgggaggccgaggcaggcagatcacctgacgtcaggagtccaagaccagcctggccaacacggtgaaacctcgtctctaataaaaatacaaacattagcccggcatggtggtgcacacctatagtcccagctactcgggaggctaaggcaggagaatggcttgaacctgagagacggaggttgcagtgagccaaatagcgccagtgcactccagcctaggcgacacagcgagactccatctcaaaaaaaaaaaaaaaaaaaagaagaagttaggcttgttttaccttattaactcctttgaactgtctggatttcatggaagttggtaagatgcacttacatggaacattgttcatgccaaacaaactcatctttattgtatctatttgtcacataaatccttacatggaatgttttgatttcttaagaaaaatgaaacaaaggttagcgccccttgttttagacatacaaactaaagctagaccctgttgcccagatagtcatattgcttctttgcaatatcaattcacagaggctgtgagatgtggttcaaagagtggagtcgagagtctggatgctaatcctgcctttgctgcaagaacccttctgtttgttaccttgaggaaggcaaatgtctgtaggctttgcatatctcatttgtaaaatgaggaaaggtagctgtaaaattttctaacatccgaattatataaactttagacatagtataaaataggaaactaccaatgatttctaaagataatatagttctttcagaccacaaataatacataataacatgcaactaagaacaacttgtaaatgcaagaaaaaaacaaataattggaaatcagaatatttctgggaattcttcgtaataaagcaaatttcaagcacaataaagtaatatttatgcatatttacatatttgcacctcatcataaggtcactctagtcctaaactgatgtagttcatctgttttacagctgaagttaagtatgtcccttatttgtgcttggcttatttctttcttaaataatacattacacaagtgaa

SEQ ID NO: 163901 - DNA, 2326 bp, Homo sapiens
  Payload ID: 12272
  Gene Symbol: PNPLA8
  Gene Name: patatin-like phospholipase domain containing 8
  ENST ID: ENST00000453085
  CDS Start-End: 408-2326
aaggatgaaagcctgaactagagcagtggaaatgcgaatgtggagcagaggaacgattcaagaaattctgcggtaaaactcatcagacttcatgactgattaaagattgtcttctcctccaaggtctacatgattacctgaagtttaataataatgcaagaagtgtttgtgggaagcagagaagcaagcaactgtatttcttgttctcacctaagcattactggaggataagccacatcagtctacaaagaggttttcatacaaacataataagatgtaaatggaccaaaagtgaagcacattcttgcagtaagcactgttactctccaagcaaccatggtttacatattgggattttgaaacttagcacttctgctcccaagggacttacaaaagtgaacatttgtatgtcccgtattaaaagtactttgaactctgtttcaaaggctgtttttggcaatcaaaatgaaatgatttcacgtttagctcaatttaagccaagttcccaaattttaagaaaagtatcggatagtggctggttaaaacagaaaaacatcaaacaagccatcaaatctctgaaaaaatatagtgacaaatcagcagaaaagagtccttttccagaagagaaaagtcacattatagacaaagaagaagatataggtaaacgcagtctttttcattacacaagttctataaccacaaaatttggagactcattctactttttatcaaatcatattaattcatatttcaaacgtaaggaaaaaatgtctcaacaaaaggaaaatgaacatttccgggacaaatcagaacttgaagataaaaaggtagaagaggggaaattaagatctccagatcctggcatcctggcttataagccaggctcagaatctgtacatacggtggacaagcctacaagtccttctgcgatacctgatgttcttcaagtttcaactaaacaaagtattgctaactttctttctcgtcccacggaaggtgtacaagctttagtaggtggttatattggtggacttgtccccaaattaaagtatgattcaaagagtcagtcagaagaacaggaagagcctgctaaaactgatcaggctgtcagcaaagacagaaatgcagaggagaaaaagcgtttatctcttcagcgagaaaagattatcgcaagggtgagtattgataacaggacccgggcattagttcaggcattaagaagaacaactgacccaaagctctgcattactagggttgaagaactgacttttcatcttctagaatttcctgaaggaaaaggagtggctgtcaaggaaagaattattccatatttattacgactgagacaaattaaggatgaaactcttcaggctgcagttagagaaattttggccctaattggctatgtggatccagtgaaagggagaggaatccgaattctctcaattgatggtggaggaacaaggggcgtggttgctctccagaccctacgaaaattagttgaacttactcagaagccagttcatcagctctttgattacatttgtggtgtaagcacaggtgccatattagctttcatgttggggttgtttcatatgcccttggatgaatgtgaggaactttatcgaaaattaggatcagatgtattttcacaaaatgtcattgttggaacagtaaaaatgagttggagccatgcattttatgacagtcaaacatgggaaaacattcttaaggataggatgggatctgcactgatgattgaaacagcaagaaaccccacatgtcctaaggtagctgctgtaagtaccatagtaaatagagggataacacccaaagcttttgtgttcagaaactatggtcattttcctggaatcaactctcattatttgggaggctgtcagtataaaatgtggcaggccattagagcctcatctgctgctccaggctactttgcagaatatgcattgggaaatgatcttcatcaagatggaggtttgcttctgaataacccttcggcattagctatgcatgagtgtaaatgtctttggccagatgtgccgttagagtgcatagtatccctgggcactggacgttatgagagtgatgtgagaaacacggtaacatacacaagcttgaaaactaaactttctaatgttatcaacagtgctacagatacagaagaagtccatataatgcttgatggcctgttacctcctgacacctattttagattcaatcctgtaatgtgtgaaaacatacctctagatgaaagtcgaaatgaaaagctggatcagctgcagttggaagggttgaaatacatagaaag

SEQ ID NO: 163902 - DNA, 735 bp, Homo sapiens
  Payload ID: 12272
  Gene Symbol: PNPLA8
  Gene Name: patatin-like phospholipase domain containing 8
  ENST ID: ENST00000427008
  CDS Start-End: 158-735
ggaagctcagctgatgcaggccggttggagtggacgtcattgccgggaacgagcgagtcgccgctgcagccctagtaagaccatgaattatggcatttcttaaatgaagcgttcaagaagtgagagaatgtcatagaaaataaatgatttttaagttatgtctattaatctgactgtagatatatatatttacctccttagtaatgcaagaagtgtttgtgggaagcagagaagcaagcaactgtatttcttgttctcacctaagcattactggaggataagccacatcagtctacaaagaggttttcatacaaacataataagatgtaaatggaccaaaagtgaagcacattcttgcagtaagcactgttactctccaagcaaccatggtttacatattgggattttgaaacttagcacttctgctcccaagggacttacaaaagtgaacatttgtatgtcccgtattaaaagtactttgaactctgtttcaaaggctgtttttggcaatcaaaatgaaatgatttcacgtttagctcaatttaagccaagttcccaaattttaagaaaagtatcggatagtggctggttaaaacagaaaaacatcaaacaagccatcaaatctctgaaaaaatatagtgacaaatcagcagaaaagagtccttttccagaagagaaaagtcacattatagacaaagaagaagatataggtaaacgcagtctttttcattacac

SEQ ID NO: 163903 - DNA, 3462 bp, Homo sapiens
  Payload ID: 12272
  Gene Symbol: PNPLA8
  Gene Name: patatin-like phospholipase domain containing 8
  Uniprot ID: Q9NP80
  ENST ID: ENST00000436062
  CDS Start-End: 374-2722
gtcatgctctattgcgcatatctcggggcgggggaggaacggagattgacaaggaggcagaggcctgagcgaggcggaaaatcctcaccccggcccgcgggtagacccaaacttctagcgcgtcacttccgctgggggcggagcggggcggggctgagtgggtggcgacctagctgctgcgccagtgtttgtgttggaagctcagctgatgcaggccggttggagtggacgtcattgccgggaacgagcgagtcgccgctgcagccctagtgactgcggcctgcatcccggtaagaccatgaattatggcatttcttaaatgaagcgttcaagaagtgagagaatgtcatagaaaataaatgatttttaagttatgtctattaatctgactgtagatatatatatttacctccttagtaatgcaagaagtgtttgtgggaagcagagaagcaagcaactgtatttcttgttctcacctaagcattactggaggataagccacatcagtctacaaagaggttttcatacaaacataataagatgtaaatggaccaaaagtgaagcacattcttgcagtaagcactgttactctccaagcaaccatggtttacatattgggattttgaaacttagcacttctgctcccaagggacttacaaaagtgaacatttgtatgtcccgtattaaaagtactttgaactctgtttcaaaggctgtttttggcaatcaaaatgaaatgatttcacgtttagctcaatttaagccaagttcccaaattttaagaaaagtatcggatagtggctggttaaaacagaaaaacatcaaacaagccatcaaatctctgaaaaaatatagtgacaaatcagcagaaaagagtccttttccagaagagaaaagtcacattatagacaaagaagaagatataggtaaacgcagtctttttcattacacaagttctataaccacaaaatttggagactcattctactttttatcaaatcatattaattcatatttcaaacgtaaggaaaaaatgtctcaacaaaaggaaaatgaacatttccgggacaaatcagaacttgaagataaaaaggtagaagaggggaaattaagatctccagatcctggcatcctggcttataagccaggctcagaatctgtacatacggtggacaagcctacaagtccttctgcgatacctgatgttcttcaagtttcaactaaacaaagtattgctaactttctttctcgtcccacggaaggtgtacaagctttagtaggtggttatattggtggacttgtccccaaattaaagtatgattcaaagagtcagtcagaagaacaggaagagcctgctaaaactgatcaggctgtcagcaaagacagaaatgcagaggagaaaaagcgtttatctcttcagcgagaaaagattatcgcaagggtgagtattgataacaggacccgggcattagttcaggcattaagaagaacaactgacccaaagctctgcattactagggttgaagaactgacttttcatcttctagaatttcctgaaggaaaaggagtggctgtcaaggaaagaattattccatatttattacgactgagacaaattaaggatgaaactcttcaggctgcagttagagaaattttggccctaattggctatgtggatccagtgaaagggagaggaatccgaattctctcaattgatggtggaggaacaaggggcgtggttgctctccagaccctacgaaaattagttgaacttactcagaagccagttcatcagctctttgattacatttgtggtgtaagcacaggtgccatattagctttcatgttggggttgtttcatatgcccttggatgaatgtgaggaactttatcgaaaattaggatcagatgtattttcacaaaatgtcattgttggaacagtaaaaatgagttggagccatgcattttatgacagtcaaacatgggaaaacattcttaaggataggatgggatctgcactgatgattgaaacagcaagaaaccccacatgtcctaaggtagctgctgtaagtaccatagtaaatagagggataacacccaaagcttttgtgttcagaaactatggtcattttcctggaatcaactctcattatttgggaggctgtcagtataaaatgtggcaggccattagagcctcatctgctgctccaggctactttgcagaatatgcattgggaaatgatcttcatcaagatggaggtttgcttctgaataacccttcggcattagctatgcatgagtgtaaatgtctttggccagatgtgccgttagagtgcatagtatccctgggcactggacgttatgagagtgatgtgagaaacacggtaacatacacaagcttgaaaactaaactttctaatgttatcaacagtgctacagatacagaagaagtccatataatgcttgatggcctgttacctcctgacacctattttagattcaatcctgtaatgtgtgaaaacatacctctagatgaaagtcgaaatgaaaagctggatcagctgcagttggaagggttgaaatacatagaaagaaatgaacaaaaaatgaaaaaagttgcaaaaatattaagtcaagaaaaaacaactctgcagaaaattaatgattggataaaattaaaaactgatatgtatgaaggacttccattcttttcaaaattgtgatgagtatatgcttatgttctcataaatgaaggtctgtttagaagatcaaccacattcaataaggaattgtggggttcgacatgagttaactttgaaatacgtatgaattctggagaatcctgaaaaagacggtgcttcaaccagcttgcatagcacagagaatattcttggttacagaattcatatgggaactaggcttttaagatgttaataattagctaagctttagtaacccttactgtgctagtagattttagtagatattggtgttatattgtttgatgtttgaaaatatattaatatatgtgccgaacaagaaaccgaaagctatattgtactgtgtatttttactttagtcctcataatcatgttgaatttatgtgatcattgattttatttcatatggaaaagctaatttcttcttaaatttacattacctaatattctcactagctatgttctccaatccacactgccttttattgtaatatcatctaaatagatgcagaaaaatggaattttctctattaaagtattttacatttgacataaaaaagaaccagatacagttttctattcagatatgtttattttaacattgtttggttaaaaaaggtgaagttccagtcaaccactttttacccctgaaatttcaagataatgctatattaacttttccagatctaacactagcttattcttccctgttataaaatggtttgaacttactgaggagatat

SEQ ID NO: 163904 - DNA, 3530 bp, Homo sapiens
  Payload ID: 12272
  Gene Symbol: PNPLA8
  Gene Name: patatin-like phospholipase domain containing 8
  Uniprot ID: Q9NP80
  ENST ID: ENST00000422087
  CDS Start-End: 408-2756
acttccgctgggggcggagcggggcggggctgagtgggtggcgacctagctgctgcgccagtgtttgtgttggaagctcagctgatgcaggccggttggagtggacgtcattgccgggaacgagcgagtcgccgctgcagccctagtgactgcggcctgcatcccgattgtcttctcctccaaggtctacatgattacctgaagtttaataattttgcctttctagagtgttatacagctggaatcatactgctatggtccgaatgtttgtgcctctcaaaattcatgtggaaatcataaccgctaaagtgatggtattaagaggtaagaccatgaattatggcatttcttaaatgaagcgttcaagaagtgagagaatgtcatagaaaataaatgatttttaagttatgtctattaatctgactgtagatatatatatttacctccttagtaatgcaagaagtgtttgtgggaagcagagaagcaagcaactgtatttcttgttctcacctaagcattactggaggataagccacatcagtctacaaagaggttttcatacaaacataataagatgtaaatggaccaaaagtgaagcacattcttgcagtaagcactgttactctccaagcaaccatggtttacatattgggattttgaaacttagcacttctgctcccaagggacttacaaaagtgaacatttgtatgtcccgtattaaaagtactttgaactctgtttcaaaggctgtttttggcaatcaaaatgaaatgatttcacgtttagctcaatttaagccaagttcccaaattttaagaaaagtatcggatagtggctggttaaaacagaaaaacatcaaacaagccatcaaatctctgaaaaaatatagtgacaaatcagcagaaaagagtccttttccagaagagaaaagtcacattatagacaaagaagaagatataggtaaacgcagtctttttcattacacaagttctataaccacaaaatttggagactcattctactttttatcaaatcatattaattcatatttcaaacgtaaggaaaaaatgtctcaacaaaaggaaaatgaacatttccgggacaaatcagaacttgaagataaaaaggtagaagaggggaaattaagatctccagatcctggcatcctggcttataagccaggctcagaatctgtacatacggtggacaagcctacaagtccttctgcgatacctgatgttcttcaagtttcaactaaacaaagtattgctaactttctttctcgtcccacggaaggtgtacaagctttagtaggtggttatattggtggacttgtccccaaattaaagtatgattcaaagagtcagtcagaagaacaggaagagcctgctaaaactgatcaggctgtcagcaaagacagaaatgcagaggagaaaaagcgtttatctcttcagcgagaaaagattatcgcaagggtgagtattgataacaggacccgggcattagttcaggcattaagaagaacaactgacccaaagctctgcattactagggttgaagaactgacttttcatcttctagaatttcctgaaggaaaaggagtggctgtcaaggaaagaattattccatatttattacgactgagacaaattaaggatgaaactcttcaggctgcagttagagaaattttggccctaattggctatgtggatccagtgaaagggagaggaatccgaattctctcaattgatggtggaggaacaaggggcgtggttgctctccagaccctacgaaaattagttgaacttactcagaagccagttcatcagctctttgattacatttgtggtgtaagcacaggtgccatattagctttcatgttggggttgtttcatatgcccttggatgaatgtgaggaactttatcgaaaattaggatcagatgtattttcacaaaatgtcattgttggaacagtaaaaatgagttggagccatgcattttatgacagtcaaacatgggaaaacattcttaaggataggatgggatctgcactgatgattgaaacagcaagaaaccccacatgtcctaaggtagctgctgtaagtaccatagtaaatagagggataacacccaaagcttttgtgttcagaaactatggtcattttcctggaatcaactctcattatttgggaggctgtcagtataaaatgtggcaggccattagagcctcatctgctgctccaggctactttgcagaatatgcattgggaaatgatcttcatcaagatggaggtttgcttctgaataacccttcggcattagctatgcatgagtgtaaatgtctttggccagatgtgccgttagagtgcatagtatccctgggcactggacgttatgagagtgatgtgagaaacacggtaacatacacaagcttgaaaactaaactttctaatgttatcaacagtgctacagatacagaagaagtccatataatgcttgatggcctgttacctcctgacacctattttagattcaatcctgtaatgtgtgaaaacatacctctagatgaaagtcgaaatgaaaagctggatcagctgcagttggaagggttgaaatacatagaaagaaatgaacaaaaaatgaaaaaagttgcaaaaatattaagtcaagaaaaaacaactctgcagaaaattaatgattggataaaattaaaaactgatatgtatgaaggacttccattcttttcaaaattgtgatgagtatatgcttatgttctcataaatgaaggtctgtttagaagatcaaccacattcaataaggaattgtggggttcgacatgagttaactttgaaatacgtatgaattctggagaatcctgaaaaagacggtgcttcaaccagcttgcatagcacagagaatattcttggttacagaattcatatgggaactaggcttttaagatgttaataattagctaagctttagtaacccttactgtgctagtagattttagtagatattggtgttatattgtttgatgtttgaaaatatattaatatatgtgccgaacaagaaaccgaaagctatattgtactgtgtatttttactttagtcctcataatcatgttgaatttatgtgatcattgattttatttcatatggaaaagctaatttcttcttaaatttacattacctaatattctcactagctatgttctccaatccacactgccttttattgtaatatcatctaaatagatgcagaaaaatggaattttctctattaaagtattttacatttgacataaaaaagaaccagatacagttttctattcagatatgtttattttaacattgtttggttaaaaaaggtgaagttccagtcaaccactttttacccctgaaatttcaagataatgctatattaacttttccagatctaacactagcttattcttccctgttataaaatggtttgaacttactgaggagatattcctatcattaacaaaaataaactatttaaataa

SEQ ID NO: 163905 - DNA, 8057 bp, Homo sapiens
  Payload ID: 12273
  Gene Symbol: PTCH1
  Gene Name: patched 1
  Uniprot ID: Q13635
  ENST ID: ENST00000331920
  CDS Start-End: 301-4644
gaactggatgtgggcagcggcggccgcagagacctcgggacccccgcgcaatgtggcaatggaaggcgcagggtctgactccccggcagcggccgcggccgcagcggcagcagcgcccgccgtgtgagcagcagcagcggctggtctgtcaaccggagcccgagcccgagcagcctgcggccagcagcgtcctcgcaagccgagcgcccaggcgcgccaggagcccgcagcagcggcagcagcgcgccgggccgcccgggaagcctccgtccccgcggcggcggcggcggcggcggcaacatggcctcggctggtaacgccgccgagccccaggaccgcggcggcggcggcagcggctgtatcggtgccccgggacggccggctggaggcgggaggcgcagacggacgggggggctgcgccgtgctgccgcgccggaccgggactatctgcaccggcccagctactgcgacgccgccttcgctctggagcagatttccaaggggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggcagtggaaattggaacatttgtgttacaaatcaggagagcttatcacagaaacaggttacatggatcagataatagaatatctttacccttgtttgattattacacctttggactgcttctgggaaggggcgaaattacagtctgggacagcatacctcctaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaacctcttgatatggcccttgttttgaatggtggatgtcatggcttatccagaaagtatatgcactggcaggaggagttgattgtgggtggcacagtcaagaacagcactggaaaactcgtcagcgcccatgccctgcagaccatgttccagttaatgactcccaagcaaatgtacgagcacttcaaggggtacgagtatgtctcacacatcaactggaacgaggacaaagcggcagccatcctggaggcctggcagaggacatatgtggaggtggttcatcagagtgtcgcacagaactccactcaaaaggtgctttccttcaccaccacgaccctggacgacatcctgaaatccttctctgacgtcagtgtcatccgcgtggccagcggctacttactcatgctcgcctatgcctgtctaaccatgctgcgctgggactgctccaagtcccagggtgccgtggggctggctggcgtcctgctggttgcactgtcagtggctgcaggactgggcctgtgctcattgatcggaatttcctttaacgctgcaacaactcaggttttgccatttctcgctcttggtgttggtgtggatgatgtttttcttctggcccacgccttcagtgaaacaggacagaataaaagaatcccttttgaggacaggaccggggagtgcctgaagcgcacaggagccagcgtggccctcacgtccatcagcaatgtcacagccttcttcatggccgcgttaatcccaattcccgctctgcgggcgttctccctccaggcagcggtagtagtggtgttcaattttgccatggttctgctcatttttcctgcaattctcagcatggatttatatcgacgcgaggacaggagactggatattttctgctgttttacaagcccctgcgtcagcagagtgattcaggttgaacctcaggcctacaccgacacacacgacaatacccgctacagccccccacctccctacagcagccacagctttgcccatgaaacgcagattaccatgcagtccactgtccagctccgcacggagtacgacccccacacgcacgtgtactacaccaccgctgagccgcgctccgagatctctgtgcagcccgtcaccgtgacacaggacaccctcagctgccagagcccagagagcaccagctccacaagggacctgctctcccagttctccgactccagcctccactgcctcgagcccccctgtacgaagtggacactctcatcttttgctgagaagcactatgctcctttcctcttgaaaccaaaagccaaggtagtggtgatcttcctttttctgggcttgctgggggtcagcctttatggcaccacccgagtgagagacgggctggaccttacggacattgtacctcgggaaaccagagaatatgactttattgctgcacaattcaaatacttttctttctacaacatgtatatagtcacccagaaagcagactacccgaatatccagcacttactttacgacctacacaggagtttcagtaacgtgaagtatgtcatgttggaagaaaacaaacagcttcccaaaatgtggctgcactacttcagagactggcttcagggacttcaggatgcatttgacagtgactgggaaaccgggaaaatcatgccaaacaattacaagaatggatcagacgatggagtccttgcctacaaactcctggtgcaaaccggcagccgcgataagcccatcgacatcagccagttgactaaacagcgtctggtggatgcagatggcatcattaatcccagcgctttctacatctacctgacggcttgggtcagcaacgaccccgtcgcgtatgctgcctcccaggccaacatccggccacaccgaccagaatgggtccacgacaaagccgactacatgcctgaaacaaggctgagaatcccggcagcagagcccatcgagtatgcccagttccctttctacctcaacggcttgcgggacacctcagactttgtggaggcaattgaaaaagtaaggaccatctgcagcaactatacgagcctggggctgtccagttaccccaacggctaccccttcctcttctgggagcagtacatcggcctccgccactggctgctgctgttcatcagcgtggtgttggcctgcacattcctcgtgtgcgctgtcttccttctgaacccctggacggccgggatcattgtgatggtcctggcgctgatgacggtcgagctgttcggcatgatgggcctcatcggaatcaagctcagtgccgtgcccgtggtcatcctgatcgcttctgttggcataggagtggagttcaccgttcacgttgctttggcctttctgacggccatcggcgacaagaaccgcagggctgtgcttgccctggagcacatgtttgcacccgtcctggatggcgccgtgtccactctgctgggagtgctgatgctggcgggatctgagttcgacttcattgtcaggtatttctttgctgtgctggcgatcctcaccatcctcggcgttctcaatgggctggttttgcttcccgtgcttttgtctttctttggaccatatcctgaggtgtctccagccaacggcttgaaccgcctgcccacaccctcccctgagccaccccccagcgtggtccgcttcgccatgccgcccggccacacgcacagcgggtctgattcctccgactcggagtatagttcccagacgacagtgtcaggcctcagcgaggagcttcggcactacgaggcccagcagggcgcgggaggccctgcccaccaagtgatcgtggaagccacagaaaaccccgtcttcgcccactccactgtggtccatcccgaatccaggcatcacccaccctcgaacccgagacagcagccccacctggactcagggtccctgcctcccggacggcaaggccagcagccccgcagggacccccccagagaaggcttgtggccacccccctacagaccgcgcagagacgcttttgaaatttctactgaagggcattctggccctagcaatagggcccgctggggccctcgcggggcccgttctcacaaccctcggaacccagcgtccactgccatgggcagctccgtgcccggctactgccagcccatcaccactgtgacggcttctgcctccgtgactgtcgccgtgcacccgccgcctgtccctgggcctgggcggaacccccgagggggactctgcccaggctaccctgagactgaccacggcctgtttgaggacccccacgtgcctttccacgtccggtgtgagaggagggattcgaaggtggaagtcattgagctgcaggacgtggaatgcgaggagaggccccggggaagcagctccaactgagggtgattaaaatctgaagcaaagaggccaaagattggaaaccccccacccccacctctttccagaactgcttgaagagaactggttggagttatggaaaagatgccctgtgccaggacagcagttcattgttactgtaaccgattgtattattttgttaaatatttctataaatatttaagagatgtacacatgtgtaatataggaaggaaggatgtaaagtggtatgatctggggcttctccactcctgccccagagtgtggaggccacagtggggcctctccgtatttgtgcattgggctccgtgccacaaccaagcttcattagtcttaaatttcagcatatgttgctgctgcttaaatattgtataatttacttgtataattctatgcaaatattgcttatgtaataggattattttgtaaaggtttctgtttaaaatattttaaatttgcatatcacaaccctgtggtagtatgaaatgttactgttaactttcaaacacgctatgcgtgataatttttttgtttaatgagcagatatgaagaaagcacgttaatcctggtggcttctctaggtgtcgttgtgtgcggtcctcttgtttggctgtgcgtgtgaacacgtgtgtgagttcaccatgtactgtactgtgattttttttttgtcttgttttgtttctctacactgtctgtaacctgtagtaggctctgacctagtcaggctggaagcgtcaggatatcttttcttcgtgctggtgagggctggccctaaacatccacctaatcctttcaaatcagcccggcaaaagctagactctcctcgtgtctacggcatctcttatgatcattggctgccatccaggaccccaatttgtgcttcagggggataatctccttctctcggatcattgtgatggatgctggaacctcagggtatggagctcacatcagttcatcatggtgggtgttagagaattcggtgacatgcctagtgctgagccttggctgggccatgagagtctgtatactctaaaaagcatgcagcatggtgcccctcttctgaccaacacacacacgacccctcccccaacacccccaaattcaagagtggatgtggccctgtcacaggtagaaaaacctatttagttaattctttcttggcccacagtctcccagaaatgatgttttgagtccctatagtttaaactccctctcttaaatggagcagctggttgaggctttctagatctgtttgcatcttctttaaaactaagtggtgagcatgcattgtggtgtagaggcaggcattatgtaggataagagctccggggggattcttcatgcaccagtgtttagggtacgtgcttcctaagtaaatccaaacattgtctccatcctccccgtcattagtgctctttcaatgtgatgtgggaaagcaggaggatggacacaccccactgaaagatgtaggcaggggcaggtctctcaaccaggcatatttttaaaagttgcttctgtactggttctcttcttttgctctgaggtgtgggctccctcatctcgtaaccagagaccagcacatgtcagggaagcacccagtgtcggctccccatccaaatccacaccagcaccttgttacagacaagaagtcagaggaaagggcggggtccctgcagggctgaagcctaagctactgtgaggcgctcacgagtggcagctcctgttactcccttttaaattacctgggaaatcttaacagaaaggtaatgggcccccagaaatacccacagcatagtgacctcagaccctgatactcaccacaaaacttttaagatgctgattgggagccgcttgtggctgctgggtgtgtgtgtgtgtgtgtgcgtgcgtgcgtgtgtgtgtgtctctgctggggaccctggccacccccctgctgctgtcttggtgcctgtcacccacatggtctgccatcctaacacccagctctgctcagaaaacgtcctgcgtggaggagggatgatgcagaattctgaagtcgacttccctctggctcctggcgtgccctcgctcccttcctgagcccagctcgtgttgcgccggaggctgcgcggcccctgatttctgcatggtgtagaactttctccaatagtcacattggcaaagggagaactggggtgggcggggggtggggctggcagggaattagaatttctctctctcttttaatagttttattttgtctgtcctgtttgttcatttggatgttttaatttttaaaaaaaaaaaaactttgctgatatttataattttgtatcataagaatgttttcctctacagtatttgtcatgccagtttataacaaaaaaaaatgcagggattttatttctattggaaacattacagctatgttttacttttggacagaatttttatttgtatagagtgcttactaatgttaaatagttcagagtatataacatttacattaaggactcatggtaggttttagggtaaggagtttaaaggaaataaatattcaaactgggtctcattgccaattttggtggaaatgagtttgtgtcatttcaattacaaagataaaagtatgccatataatttatttatatgaagatttatttttgtagtgtacatagtagtcatcaagtcttttgacagaagtatatttttaaagaatttatatgtgatgaatccataatgtctggaactttgctgagacatgagtgggcacagttttcattgtaaattacagcaaggaaagaaaatgtttaacagtgttaagagagtcagagcagagtggatattcatgcgattatgaagtgtttattagttaccattggcgacctagcatgcttctcatttcaaaccttggaaggtgaaaatgtacaaactctctaaataattaatgttcaaacactgatagaaattctaacatgaataaaaaataatataacttgttggttatatctttgtttgtagaatgctttttttctttaaaatacttgggagagacagttagtgttggagccatcagaaactgttgtttcatcttgctgaccttgtgacactcttcttttttgctctatctgatggagagagttttaggttttcctcctttttgttttgtataaatagtgggtataagcatagctctgttacatggatgtattacaaagtgggggctgagcttttagtgtgatcatcacccaaatagtgtacattgtacccattaattaatttcttatcacctgaccctatttttgttttctcataccaagaaacttcctaagttaaccatcaaaattagtccttctgtcatctctcttagcatacttatttcccttatgtgatgcctaataatgagggaacataaataaagccaaattcaaagatga

SEQ ID NO: 163906 - DNA, 1058 bp, Homo sapiens
  Payload ID: 12273
  Gene Symbol: PTCH1
  Gene Name: patched 1
  ENST ID: ENST00000375271
  CDS Start-End: 1-1058
aaggctgaggttggtcatggttacatggaccgcccctgcctcaatccggccgatccagactgccccgccacagcccccaacaaaaattcaaccaaacctcttgatatggcccttgttttgaatggtggatgtcatggcttatccagaaagtatatgcactggcaggaggagttgattgtgggtggcacagtcaagaacagcactggaaaactcgtcagcgcccatgccctgcagaccatgttccagttaatgactcccaagcaaatgtacgagcacttcaaggggtacgagtatgtctcacacatcaactggaacgaggacaaagcggcagccatcctggaggcctggcagaggacatatgtggaggtggttcatcagagtgtcgcacagaactccactcaaaaggtgctttccttcaccaccacgaccctggacgacatcctgaaatccttctctgacgtcagtgtcatccgcgtggccagcggctacttactcatggttttgccatttctcgctcttggtgttggtgtggatgatgtttttcttctggcccacgccttcagtgaaacaggacagaataaaagaatcccttttgaggacaggaccggggagtgcctgaagcgcacaggagccagcgtggccctcacgtccatcagcaatgtcacagccttcttcatggccgcgttaatcccaattcccgctctgcgggcgttctccctccaggcagcggtagtagtggtgttcaattttgccatggttctgctcatttttcctgcaattctcagcatggatttatatcgacgcgaggacaggagactggatattttctgctgttttacaagcccctgcgtcagcagagtgattcaggttgaacctcaggcctacaccgacacacacgacaatacccgctacagccccccacctccctacagcagccacagctttgcccatgaaacgcagattaccatgcagtccactgtccagctccgcacggagtacgacccccacacgcacgtgtactacaccaccgctgagccgcgctccgagatctctgtgca

SEQ ID NO: 163907 - DNA, 4720 bp, Homo sapiens
  Payload ID: 12273
  Gene Symbol: PTCH1
  Gene Name: patched 1
  Uniprot ID: Q13635
  ENST ID: ENST00000375274
  CDS Start-End: 146-4486
acccaggagggctgtgctgatagcacgttcctcgagtttactttgctttccttgagtttattgtaaaggggtaaagttttcggatccgtcacgtgaccctgacaggtcctgcctatggcgcggcagaccacccacgccgagggccatggaactgcttaatagaaacaggcttgtaattgtgagtccgcgctgcactccgccgaaagcctccggcggcccagcgcgccggggtttttacactttccgttccttttgtaaagacggaggaggaggagaagaagaagaagaaaacggaggagaagaaaaagacgacaggggagacaaagagacccgcagcgacaaggggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggcagtggaaattggaacatttgtgttacaaatcaggagagcttatcacagaaacaggttacatggatcagataatagaatatctttacccttgtttgattattacacctttggactgcttctgggaaggggcgaaattacagtctgggacagcatacctcctaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaacctcttgatatggcccttgttttgaatggtggatgtcatggcttatccagaaagtatatgcactggcaggaggagttgattgtgggtggcacagtcaagaacagcactggaaaactcgtcagcgcccatgccctgcagaccatgttccagttaatgactcccaagcaaatgtacgagcacttcaaggggtacgagtatgtctcacacatcaactggaacgaggacaaagcggcagccatcctggaggcctggcagaggacatatgtggaggtggttcatcagagtgtcgcacagaactccactcaaaaggtgctttccttcaccaccacgaccctggacgacatcctgaaatccttctctgacgtcagtgtcatccgcgtggccagcggctacttactcatgctcgcctatgcctgtctaaccatgctgcgctgggactgctccaagtcccagggtgccgtggggctggctggcgtcctgctggttgcactgtcagtggctgcaggactgggcctgtgctcattgatcggaatttcctttaacgctgcaacaactcaggttttgccatttctcgctcttggtgttggtgtggatgatgtttttcttctggcccacgccttcagtgaaacaggacagaataaaagaatcccttttgaggacaggaccggggagtgcctgaagcgcacaggagccagcgtggccctcacgtccatcagcaatgtcacagccttcttcatggccgcgttaatcccaattcccgctctgcgggcgttctccctccaggcagcggtagtagtggtgttcaattttgccatggttctgctcatttttcctgcaattctcagcatggatttatatcgacgcgaggacaggagactggatattttctgctgttttacaagcccctgcgtcagcagagtgattcaggttgaacctcaggcctacaccgacacacacgacaatacccgctacagccccccacctccctacagcagccacagctttgcccatgaaacgcagattaccatgcagtccactgtccagctccgcacggagtacgacccccacacgcacgtgtactacaccaccgctgagccgcgctccgagatctctgtgcagcccgtcaccgtgacacaggacaccctcagctgccagagcccagagagcaccagctccacaagggacctgctctcccagttctccgactccagcctccactgcctcgagcccccctgtacgaagtggacactctcatcttttgctgagaagcactatgctcctttcctcttgaaaccaaaagccaaggtagtggtgatcttcctttttctgggcttgctgggggtcagcctttatggcaccacccgagtgagagacgggctggaccttacggacattgtacctcgggaaaccagagaatatgactttattgctgcacaattcaaatacttttctttctacaacatgtatatagtcacccagaaagcagactacccgaatatccagcacttactttacgacctacacaggagtttcagtaacgtgaagtatgtcatgttggaagaaaacaaacagcttcccaaaatgtggctgcactacttcagagactggcttcagggacttcaggatgcatttgacagtgactgggaaaccgggaaaatcatgccaaacaattacaagaatggatcagacgatggagtccttgcctacaaactcctggtgcaaaccggcagccgcgataagcccatcgacatcagccagttgactaaacagcgtctggtggatgcagatggcatcattaatcccagcgctttctacatctacctgacggcttgggtcagcaacgaccccgtcgcgtatgctgcctcccaggccaacatccggccacaccgaccagaatgggtccacgacaaagccgactacatgcctgaaacaaggctgagaatcccggcagcagagcccatcgagtatgcccagttccctttctacctcaacggcttgcgggacacctcagactttgtggaggcaattgaaaaagtaaggaccatctgcagcaactatacgagcctggggctgtccagttaccccaacggctaccccttcctcttctgggagcagtacatcggcctccgccactggctgctgctgttcatcagcgtggtgttggcctgcacattcctcgtgtgcgctgtcttccttctgaacccctggacggccgggatcattgtgatggtcctggcgctgatgacggtcgagctgttcggcatgatgggcctcatcggaatcaagctcagtgccgtgcccgtggtcatcctgatcgcttctgttggcataggagtggagttcaccgttcacgttgctttggcctttctgacggccatcggcgacaagaaccgcagggctgtgcttgccctggagcacatgtttgcacccgtcctggatggcgccgtgtccactctgctgggagtgctgatgctggcgggatctgagttcgacttcattgtcaggtatttctttgctgtgctggcgatcctcaccatcctcggcgttctcaatgggctggttttgcttcccgtgcttttgtctttctttggaccatatcctgaggtgtctccagccaacggcttgaaccgcctgcccacaccctcccctgagccaccccccagcgtggtccgcttcgccatgccgcccggccacacgcacagcgggtctgattcctccgactcggagtatagttcccagacgacagtgtcaggcctcagcgaggagcttcggcactacgaggcccagcagggcgcgggaggccctgcccaccaagtgatcgtggaagccacagaaaaccccgtcttcgcccactccactgtggtccatcccgaatccaggcatcacccaccctcgaacccgagacagcagccccacctggactcagggtccctgcctcccggacggcaaggccagcagccccgcagggacccccccagagaaggcttgtggccacccccctacagaccgcgcagagacgcttttgaaatttctactgaagggcattctggccctagcaatagggcccgctggggccctcgcggggcccgttctcacaaccctcggaacccagcgtccactgccatgggcagctccgtgcccggctactgccagcccatcaccactgtgacggcttctgcctccgtgactgtcgccgtgcacccgccgcctgtccctgggcctgggcggaacccccgagggggactctgcccaggctaccctgagactgaccacggcctgtttgaggacccccacgtgcctttccacgtccggtgtgagaggagggattcgaaggtggaagtcattgagctgcaggacgtggaatgcgaggagaggccccggggaagcagctccaactgagggtgattaaaatctgaagcaaagaggccaaagattggaaaccccccacccccacctctttccagaactgcttgaagagaactggttggagttatggaaaagatgccctgtgccaggacagcagttcattgttactgtaaccgattgtattattttgttaaatatttctataaatatttaagagatgtacacatgtgtaatataggaaggaaggatgtaaagtggtatgatctg

SEQ ID NO: 163908 - DNA, 10631 bp, Homo sapiens
  Payload ID: 12273
  Gene Symbol: PTCH1
  Gene Name: patched 1
  ENST ID: ENST00000375290
  CDS Start-End: 1-1461
gggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacagaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaacctcttgatatggcccttgttttgaatggtggatgtcatggcttatccagaaagtatatgcactggcaggaggagttgattgtgggtggcacagtcaagaacagcactggaaaactcgtcagcgcccatgccctgcagaccatgttccagttaatgactcccaagcaaatgtacgagcacttcaaggggtacgagtatgtctcacacatcaactggaacgaggacaaagcggcagccatcctggaggcctggcagaggacatatgtggaggtggttcatcagagtgtcgcacagaactccactcaaaaggtgctttccttcaccaccacgaccctggacgacatcctgaaatccttctctgacgtcagtgtcatccgcgtggccagcggctacttactcatgctcgcctatgcctgtctaaccatgctgcgctgggactgctccaagtcccagggtgccgtggggctggctggcgtcctgctggttgcactgtcagtggctgcaggactgggcctgtgctcattgatcggaatttcctttaacgctgcaacaactcaggttttgccatttctcgctcttggtgttggtgtggatgatgtttttcttctggcccacgccttcagtgaaacaggacagaataaaagaatcccttttgaggacaggaccggggagtgcctgaagcgcacaggagccagcgtggccctcacgtccatcagcaatgtcacagccttcttcatggccgcgttaatcccaattcccgctctgcgggcgttctccctccagtacatactgatggctcatcgaggccgactctcctttaatgataccctgtggtgtggtggtctgaaaagctacatgaggtttccttacgaggagtagccttgtagaaaatccagtgcgctaaattctcccaaggcagcggtagtagtggtgttcaattttgccatggttctgctcatttttcctgcaattctcagcatggatttatatcgacgcgaggacaggagactggatattttctgctgttttacaagcccctgcgtcagcagagtgattcaggttgaacctcaggcctacaccgacacacacgacaatacccgctacagccccccacctccctacagcagccacagctttgcccatgaaacgcagattaccatgcagtccactgtccagctccgcacggagtacgacccccacacgcacgtgtactacaccaccgctgagccgcgctccgagatctctgtgcagcccgtcaccgtgacacaggacaccctcagctgccagagcccagagagcaccagctccacaagggacctgctctcccagttctccgactccagcctccactgcctcgagcccccctgtacgaagtggacactctcatcttttgctgagaagcactatgctcctttcctcttgaaaccaaaagccaaggtagtggtgatcttcctttttctgggcttgctgggggtcagcctttatggcaccacccgagtgagagacgggctggaccttacggacattgtacctcgggaaaccagagaatatgactttattgctgcacaattcaaatacttttctttctacaacatgtatatagtcacccagaaagcagactacccgaatatccagcacttactttacgacctacacaggagtttcagtaacgtgaagtatgtcatgttggaagaaaacaaacagcttcccaaaatgtggctgcactacttcagagactggcttcagggacttcaggatgcatttgacagtgactgggaaaccgggaaaatcatgccaaacaattacaagaatggatcagacgatggagtccttgcctacaaactcctggtgcaaaccggcagccgcgataagcccatcgacatcagccagttgactaaacagcgtctggtggatgcagatggcatcattaatcccagcgctttctacatctacctgacggcttgggtcagcaacgaccccgtcgcgtatgctgcctcccaggccaacatccggccacaccgaccagaatgggtccacgacaaagccgactacatgcctgaaacaaggctgagaatcccggcagcagagcccatcgagtatgcccagttccctttctacctcaacggcttgcgggacacctcagactttgtggaggcaattgaaaaagtaaggaccatctgcagcaactatacgagcctggggctgtccagttaccccaacggctaccccttcctcttctgggagcagtacatcggcctccgccactggctgctgctgttcatcagcgtggtgttggcctgcacattcctcgtgtgcgctgtcttccttctgaacccctggacggccgggatcattgtgatggtcctggcgctgatgacggtcgagctgttcggcatgatgggcctcatcggaatcaagctcagtgccgtgcccgtggtcatcctgatcgcttctgttggcataggagtggagttcaccgttcacgttgctttggcctttctgacggccatcggcgacaagaaccgcagggctgtgcttgccctggagcacatgtttgcacccgtcctggatggcgccgtgtccactctgctgggagtgctgatgctggcgggatctgagttcgacttcattgtcaggtaagcaggcgtgtgcaaggagacatgttttagaaatcattgtgattgggccgggtgcagtggctcacgcctgtaatcccagcactttaggaggccgaggcgggtggatcagaaggtcaaggagttcaagaccagcctggccaagatggtgaaactcatctccactcaaaatacaaaaattagccgggcgtggtggtgggtgcctgtaatcccagctacttgggaggctgaggcagagaattgctcgaacccgggaggcggaggttgcagtgagctgagattgcgccactacactccagcctgggtgacagagcgagattctgtctcaaaaaaaaaaatattgttattagctcaggtgatcttcgttgcttatttccttctgtatctggtagattgcagcacctcgtcatcgtgactctgctttcttttgaacttgttaacgtagagatattcggaggtataaagacaagctctcttctagagctgtcttggggagtatcttgaaaacagaaggtaaaggatttggggctggcagcaaagacaactctgcagcttgaagccaaaggatcacccaataggtggcccattattgtctcgggttagaaacactgcagaaagaaatgccacatttgacctacgctccctctccttcaaactgtagaaaggaaaacttaaaaatacctaaaattgtcacctgactttattcttttaagaagtgaaaatgacgtgctcagatttcatattcgagtccccacaattaggaagcatttagcattggactttggtgtcaactcttgggaatctaagcctagtttggatctcaaggcaagtcgtttccagttgatttaattaagaatatgactttgtgaaatataaaagaacagtgagttttccttttgaaaagaatttgagaactgcagaggaggaaaccacttgcttctttgagcagcctccatggctttgtgagggacctgctcttggatagaactctgctactttatggagctctaaggccagaatcaccaataagtaaaagatagtccaggattagaaccatgacagggcagaaccagatgtgagaaatgattggtttgtttggcacgcttcagtactgagaggttgtgtgtgtgtgtgtgtgtgtgtgtgtgtcagagagagagatacgcttcttatcttcaagtaaaaagaagagggtttcaactagaagttttagccaaagttttattacgggaaagagatgagtccattggttggcctgtggcatagcccactgggcaatttggcatcatggaggccgccttcttagaatgagtgccaagcttgcttattgtagtttttgcatagagtgaatggtgaagtggaatcgctgtagaccagcgcttctcacaccgatgtgctgaggaatcatctgagggtctaagtgcagggccgatttcggggggcgggaggtgggatgagggctgggtctgcatctccagctacctccctgcaatgtccatggagctagacttctcagcacaaactactgctaagccagcaagccagttcctaaattcctgtttgccaataccaagtagagagttgcccaactgagttaaatgttttggtctgtgttttattttagttcttagtttgattttagcttttcctttgttcttagtatacactttttcaggcactaacgttatcattatgatataaaagctcaatgtcaagtagagtttcttttgcatatttactttctcgtttaacacaaatataacaagcaccccataagtgccatttgcacaacagcaaataatggggacccccatatccctctgtgtagcctaaggtcttttaggggagagacaagttcacaggcaaaaccaggggaaatgcaaggtgtgctggggtctcatgagttacaggagggtctcgctcagccttgtgggggatgctgaatgaggaaacttagcctgaattagagcccccagctggaaacctggcagctggaatcccagcgctctcctctcagccggggttgttcccgcccagaaatatcagggttcctctttcaagcacttaaaagggcttcccattttctaggatgggatggattaacctgataaaggcctcaccaaggtcaaataaatgagcagacactgtatatgctaagccgtcagaaatctaattggcctgtttatgcttcagctagatggatgggatgcaaatgtcttaatgtggctgctgatacatgccccagccgaaagttccagcagtttacattagaccaagacattggctgcttggtttttactaatgtagttcagaagtttctagtgtttacaatagctgtgaggtatttgtatttttatggggattctctctcctttcatctgatgtcaaaacatatatagacatggcagcactggttgcctgttccattttatgaaccagaggaccattaacagatagatatcttgccccccccttcccagaacatcctgagcctctcccctaccccagcccacttccatcagagttgccctagaaatcattagttccagaaacgcatccctgcgtggagtctgtgccctccagccatgcagagtgtctgccagaggctgtccctggctgacaggtttaccttggtattcatgaaggattccagaccttagccctcaatggtgggaaagcagaactacttctgcactctcctcctctgccatggtgctgcggcctttatgtttgaattggctgacgcaaaacaagagtattcagagatgctaaattgttcaacaaaagattggcccgcagagcagccccgccattgtggagtgccctcacccagcacaatgccccagctcccacagaatgggcagcattttctttgcagaaagctggttcctgtgttctaaaaaggttgcaattggagctatttggtaaaactggaactcacagaattctaggcagaaagttgtgattaatgaaaggccagggaaagccttacctgatatgctagagacttaattagagattctgccgtaagatgcagaagcatttcacagtggattagcagcctgcagaagtgggctgcttttcctcctgggctaaattgtttaaattctacacccttcacttcatttgtttgcttctgctgggttttcacgagcggggcccctcggcattgtgtttgtgctttcagtctgcccagccattcaggtcgcattccatatttttgtgtttgtgtaacacattcataaataacattacatgccatcagagttcagcaaattaacaaactaattttttttttcttcccttcatgaactaacactttgggttgtggaatgtagtcctcaaagtcataaggtaaagaaacaaaaagcaaaaactcaccttgtgttgaatgtgaactgcggttggataacagccttttcagtggggtgggttttgttcatttctggcgttgccatgctgctgtgtcgggcacacggagggtggcgcgatccaccctgtcacagcgcgtgttcccgtttcctcttgatctcccaggtatttctttgctgtgctggcgatcctcaccatcctcggcgttctcaatgggctggttttgcttcccgtgcttttgtctttctttggaccatatcctgaggtgtctccagccaacggcttgaaccgcctgcccacaccctcccctgagccaccccccagcgtggtccgcttcgccatgccgcccggccacacgcacagcgggtctgattcctccgactcggagtatagttcccagacgacagtgtcaggcctcagcgaggagcttcggcactacgaggcccagcagggcgcgggaggccctgcccaccaagtgatcgtggaagccacagaaaaccccgtcttcgcccactccactgtggtccatcccgaatccaggcatcacccaccctcgaacccgagacagcagccccacctggactcagggtccctgcctcccggacggcaaggccagcagccccgcagggacccccccagagaaggcttgtggccacccccctacagaccgcgcagagacgcttttgaaatttctactgaagggcattctggccctagcaatagggcccgctggggccctcgcggggcccgttctcacaaccctcggaacccagcgtccactgccatgggcagctccgtgcccggctactgccagcccatcaccactgtgacggcttctgcctccgtgactgtcgccgtgcacccgccgcctgtccctgggcctgggcggaacccccgagggggactctgcccaggctaccctgagactgaccacggcctgtttgaggacccccacgtgcctttccacgtccggtgtgagaggagggattcgaaggtggaagtcattgagctgcaggacgtggaatgcgaggagaggccccggggaagcagctccaactgagggtgattaaaatctgaagcaaagaggccaaagattggaaaccccccacccccacctctttccagaactgcttgaagagaactggttggagttatggaaaagatgccctgtgccaggacagcagttcattgttactgtaaccgattgtattattttgttaaatatttctataaatatttaagagatgtacacatgtgtaatataggaaggaaggatgtaaagtggtatgatctggggcttctccactcctgccccagagtgtggaggccacagtggggcctctccgtatttgtgcattgggctccgtgccacaaccaagcttcattagtcttaaatttcagcatatgttgctgctgcttaaatattgtataatttacttgtataattctatgcaaatattgcttatgtaataggattattttgtaaaggtttctgtttaaaatattttaaatttgcatatcacaaccctgtggtagtatgaaatgttactgttaactttcaaacacgctatgcgtgataatttttttgtttaatgagcagatatgaagaaagcacgttaatcctggtggcttctctaggtgtcgttgtgtgcggtcctcttgtttggctgtgcgtgtgaacacgtgtgtgagttcaccatgtactgtactgtgattttttttttgtcttgttttgtttctctacactgtctgtaacctgtagtaggctctgacctagtcaggctggaagcgtcaggatatcttttcttcgtgctggtgagggctggccctaaacatccacctaatcctttcaaatcagcccggcaaaagctagactctcctcgtgtctacggcatctcttatgatcattggctgccatccaggaccccaatttgtgcttcagggggataatctccttctctcggatcattgtgatggatgctggaacctcagggtatggagctcacatcagttcatcatggtgggtgttagagaattcggtgacatgcctagtgctgagccttggctgggccatgagagtctgtatactctaaaaagcatgcagcatggtgcccctcttctgaccaacacacacacgacccctcccccaacacccccaaattcaagagtggatgtggccctgtcacaggtagaaaaacctatttagttaattctttcttggcccacagtctcccagaaatgatgttttgagtccctatagtttaaactccctctcttaaatggagcagctggttgaggctttctagatctgtttgcatcttctttaaaactaagtggtgagcatgcattgtggtgtagaggcaggcattatgtaggataagagctccggggggattcttcatgcaccagtgtttagggtacgtgcttcctaagtaaatccaaacattgtctccatcctccccgtcattagtgctctttcaatgtgatgtgggaaagcaggaggatggacacaccccactgaaagatgtaggcaggggcaggtctctcaaccaggcatatttttaaaagttgcttctgtactggttctcttcttttgctctgaggtgtgggctccctcatctcgtaaccagagaccagcacatgtcagggaagcacccagtgtcggctccccatccaaatccacaccagcaccttgttacagacaagaagtcagaggaaagggcggggtccctgcagggctgaagcctaagctactgtgaggcgctcacgagtggcagctcctgttactcccttttaaattacctgggaaatcttaacagaaaggtaatgggcccccagaaatacccacagcatagtgacctcagaccctgatactcaccacaaaacttttaagatgctgattgggagccgcttgtggctgctgggtgtgtgtgtgtgtgtgtgcgtgcgtgcgtgtgtgtgtgtctctgctggggaccctggccacccccctgctgctgtcttggtgcctgtcacccacatggtctgccatcctaacacccagctctgctcagaaaacgtcctgcgtggaggagggatgatgcagaattctgaagtcgacttccctctggctcctggcgtgccctcgctcccttcctgagcccagctcgtgttgcgccggaggctgcgcggcccctgatttctgcatggtgtagaactttctccaatagtcacattggcaaagggagaactggggtgggcggggggtggggctggcagggaattagaatttctctctctcttttaatagttttattttgtctgtcctgtttgttcatttggatgttttaatttttaaaaaaaaaaaaactttgctgatatttataattttgtatcataagaatgttttcctctacagtatttgtcatgccagtttataacaaaaaaaaatgcagggattttatttctattggaaacattacagctatgttttacttttggacagaatttttatttgtatagagtgcttactaatgttaaatagttcagagtatataacatttacattaaggactcatggtaggttttagggtaaggagtttaaaggaaataaatattcaaactgggtctcattgccaattttggtggaaatgagtttgtgtcatttcaattacaaagataaaagtatgccatataatttatttatatgaagatttatttttgtagtgtacatagtagtcatcaagtcttttgacagaagtatatttttaaagaatttatatgtgatgaatccataatgtctggaactttgctgagacatgagtgggcacagttttcattgtaaattacagcaaggaaagaaaatgtttaacagtgttaagagagtcagagcagagtggatattcatgcgattatgaagtgtttattagttaccattggcgacctagcatgcttctcatttcaaaccttggaaggtgaaaatgtacaaactctctaaataattaatgttcaaacactgatagaaattctaacatgaataaaaaataatataacttgttggtt

SEQ ID NO: 163909 - DNA, 8049 bp, Homo sapiens
  Payload ID: 12273
  Gene Symbol: PTCH1
  Gene Name: patched 1
  Uniprot ID: Q13635
  ENST ID: ENST00000437951
  CDS Start-End: 495-4640
acccaggagggctgtgctgatagcacgttcctcgagtttactttgctttccttgagtttattgtaaaggggtaaagttttcggatccgtcacgtgaccctgacaggtcctgcctatggcgcggcagaccacccacgccgagggccatggaactgcttaatagaaacaggcttgtaattgtgagtccgcgctgcactccgccgaaagcctccggcggcccagcgcgccggggtttttacactttccgttccttttgtaaagacggaggaggaggagaagaagaagaagaaaacggaggagaagaaaaagacgacaggggagacaaagagacccgcagcgacaaggcaagggggagacgagggaagactgggagaagacggaggagcggaggacgaggaaaggggggccagggaaaaaaaaggaattgatgtgaaatccaagcccagcgtccgcgccatcggcacccgcgctccgagcaggggttgacggccggctatggggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggcagtggaaattggaacatttgtgttacaaatcaggagagcttatcacagaaacaggttacatggatcagataatagaatatctttacccttgtttgattattacacctttggactgcttctgggaaggggcgaaattacagtctgggacagcatacctcctaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaacctcttgatatggcccttgttttgaatggtggatgtcatggcttatccagaaagtatatgcactggcaggaggagttgattgtgggtggcacagtcaagaacagcactggaaaactcgtcagcgcccatgccctgcagaccatgttccagttaatgactcccaagcaaatgtacgagcacttcaaggggtacgagtatgtctcacacatcaactggaacgaggacaaagcggcagccatcctggaggcctggcagaggacatatgtggaggtggttcatcagagtgtcgcacagaactccactcaaaaggtgctttccttcaccaccacgaccctggacgacatcctgaaatccttctctgacgtcagtgtcatccgcgtggccagcggctacttactcatgctcgcctatgcctgtctaaccatgctgcgctgggactgctccaagtcccagggtgccgtggggctggctggcgtcctgctggttgcactgtcagtggctgcaggactgggcctgtgctcattgatcggaatttcctttaacgctgcaacaactcaggttttgccatttctcgctcttggtgttggtgtggatgatgtttttcttctggcccacgccttcagtgaaacaggacagaataaaagaatcccttttgaggacaggaccggggagtgcctgaagcgcacaggagccagcgtggccctcacgtccatcagcaatgtcacagccttcttcatggccgcgttaatcccaattcccgctctgcgggcgttctccctccaggcagcggtagtagtggtgttcaattttgccatggttctgctcatttttcctgcaattctcagcatggatttatatcgacgcgaggacaggagactggatattttctgctgttttacaagcccctgcgtcagcagagtgattcaggttgaacctcaggcctacaccgacacacacgacaatacccgctacagccccccacctccctacagcagccacagctttgcccatgaaacgcagattaccatgcagtccactgtccagctccgcacggagtacgacccccacacgcacgtgtactacaccaccgctgagccgcgctccgagatctctgtgcagcccgtcaccgtgacacaggacaccctcagctgccagagcccagagagcaccagctccacaagggacctgctctcccagttctccgactccagcctccactgcctcgagcccccctgtacgaagtggacactctcatcttttgctgagaagcactatgctcctttcctcttgaaaccaaaagccaaggtagtggtgatcttcctttttctgggcttgctgggggtcagcctttatggcaccacccgagtgagagacgggctggaccttacggacattgtacctcgggaaaccagagaatatgactttattgctgcacaattcaaatacttttctttctacaacatgtatatagtcacccagaaagcagactacccgaatatccagcacttactttacgacctacacaggagtttcagtaacgtgaagtatgtcatgttggaagaaaacaaacagcttcccaaaatgtggctgcactacttcagagactggcttcagggacttcaggatgcatttgacagtgactgggaaaccgggaaaatcatgccaaacaattacaagaatggatcagacgatggagtccttgcctacaaactcctggtgcaaaccggcagccgcgataagcccatcgacatcagccagttgactaaacagcgtctggtggatgcagatggcatcattaatcccagcgctttctacatctacctgacggcttgggtcagcaacgaccccgtcgcgtatgctgcctcccaggccaacatccggccacaccgaccagaatgggtccacgacaaagccgactacatgcctgaaacaaggctgagaatcccggcagcagagcccatcgagtatgcccagttccctttctacctcaacggcttgcgggacacctcagactttgtggaggcaattgaaaaagtaaggaccatctgcagcaactatacgagcctggggctgtccagttaccccaacggctaccccttcctcttctgggagcagtacatcggcctccgccactggctgctgctgttcatcagcgtggtgttggcctgcacattcctcgtgtgcgctgtcttccttctgaacccctggacggccgggatcattgtgatggtcctggcgctgatgacggtcgagctgttcggcatgatgggcctcatcggaatcaagctcagtgccgtgcccgtggtcatcctgatcgcttctgttggcataggagtggagttcaccgttcacgttgctttggcctttctgacggccatcggcgacaagaaccgcagggctgtgcttgccctggagcacatgtttgcacccgtcctggatggcgccgtgtccactctgctgggagtgctgatgctggcgggatctgagttcgacttcattgtcaggtatttctttgctgtgctggcgatcctcaccatcctcggcgttctcaatgggctggttttgcttcccgtgcttttgtctttctttggaccatatcctgaggtgtctccagccaacggcttgaaccgcctgcccacaccctcccctgagccaccccccagcgtggtccgcttcgccatgccgcccggccacacgcacagcgggtctgattcctccgactcggagtatagttcccagacgacagtgtcaggcctcagcgaggagcttcggcactacgaggcccagcagggcgcgggaggccctgcccaccaagtgatcgtggaagccacagaaaaccccgtcttcgcccactccactgtggtccatcccgaatccaggcatcacccaccctcgaacccgagacagcagccccacctggactcagggtccctgcctcccggacggcaaggccagcagccccgcagggacccccccagagaaggcttgtggccacccccctacagaccgcgcagagacgcttttgaaatttctactgaagggcattctggccctagcaatagggcccgctggggccctcgcggggcccgttctcacaaccctcggaacccagcgtccactgccatgggcagctccgtgcccggctactgccagcccatcaccactgtgacggcttctgcctccgtgactgtcgccgtgcacccgccgcctgtccctgggcctgggcggaacccccgagggggactctgcccaggctaccctgagactgaccacggcctgtttgaggacccccacgtgcctttccacgtccggtgtgagaggagggattcgaaggtggaagtcattgagctgcaggacgtggaatgcgaggagaggccccggggaagcagctccaactgagggtgattaaaatctgaagcaaagaggccaaagattggaaaccccccacccccacctctttccagaactgcttgaagagaactggttggagttatggaaaagatgccctgtgccaggacagcagttcattgttactgtaaccgattgtattattttgttaaatatttctataaatatttaagagatgtacacatgtgtaatataggaaggaaggatgtaaagtggtatgatctggggcttctccactcctgccccagagtgtggaggccacagtggggcctctccgtatttgtgcattgggctccgtgccacaaccaagcttcattagtcttaaatttcagcatatgttgctgctgcttaaatattgtataatttacttgtataattctatgcaaatattgcttatgtaataggattattttgtaaaggtttctgtttaaaatattttaaatttgcatatcacaaccctgtggtagtatgaaatgttactgttaactttcaaacacgctatgcgtgataatttttttgtttaatgagcagatatgaagaaagcacgttaatcctggtggcttctctaggtgtcgttgtgtgcggtcctcttgtttggctgtgcgtgtgaacacgtgtgtgagttcaccatgtactgtactgtgattttttttttgtcttgttttgtttctctacactgtctgtaacctgtagtaggctctgacctagtcaggctggaagcgtcaggatatcttttcttcgtgctggtgagggctggccctaaacatccacctaatcctttcaaatcagcccggcaaaagctagactctcctcgtgtctacggcatctcttatgatcattggctgccatccaggaccccaatttgtgcttcagggggataatctccttctctcggatcattgtgatggatgctggaacctcagggtatggagctcacatcagttcatcatggtgggtgttagagaattcggtgacatgcctagtgctgagccttggctgggccatgagagtctgtatactctaaaaagcatgcagcatggtgcccctcttctgaccaacacacacacgacccctcccccaacacccccaaattcaagagtggatgtggccctgtcacaggtagaaaaacctatttagttaattctttcttggcccacagtctcccagaaatgatgttttgagtccctatagtttaaactccctctcttaaatggagcagctggttgaggctttctagatctgtttgcatcttctttaaaactaagtggtgagcatgcattgtggtgtagaggcaggcattatgtaggataagagctccggggggattcttcatgcaccagtgtttagggtacgtgcttcctaagtaaatccaaacattgtctccatcctccccgtcattagtgctctttcaatgtgatgtgggaaagcaggaggatggacacaccccactgaaagatgtaggcaggggcaggtctctcaaccaggcatatttttaaaagttgcttctgtactggttctcttcttttgctctgaggtgtgggctccctcatctcgtaaccagagaccagcacatgtcagggaagcacccagtgtcggctccccatccaaatccacaccagcaccttgttacagacaagaagtcagaggaaagggcggggtccctgcagggctgaagcctaagctactgtgaggcgctcacgagtggcagctcctgttactcccttttaaattacctgggaaatcttaacagaaaggtaatgggcccccagaaatacccacagcatagtgacctcagaccctgatactcaccacaaaacttttaagatgctgattgggagccgcttgtggctgctgggtgtgtgtgtgtgtgtgtgcgtgcgtgcgtgtgtgtgtgtctctgctggggaccctggccacccccctgctgctgtcttggtgcctgtcacccacatggtctgccatcctaacacccagctctgctcagaaaacgtcctgcgtggaggagggatgatgcagaattctgaagtcgacttccctctggctcctggcgtgccctcgctcccttcctgagcccagctcgtgttgcgccggaggctgcgcggcccctgatttctgcatggtgtagaactttctccaatagtcacattggcaaagggagaactggggtgggcggggggtggggctggcagggaattagaatttctctctctcttttaatagttttattttgtctgtcctgtttgttcatttggatgttttaatttttaaaaaaaaaaaaactttgctgatatttataattttgtatcataagaatgttttcctctacagtatttgtcatgccagtttataacaaaaaaaaatgcagggattttatttctattggaaacattacagctatgttttacttttggacagaatttttatttgtatagagtgcttactaatgttaaatagttcagagtatataacatttacattaaggactcatggtaggttttagggtaaggagtttaaaggaaataaatattcaaactgggtctcattgccaattttggtggaaatgagtttgtgtcatttcaattacaaagataaaagtatgccatataatttatttatatgaagatttatttttgtagtgtacatagtagtcatcaagtcttttgacagaagtatatttttaaagaatttatatgtgatgaatccataatgtctggaactttgctgagacatgagtgggcacagttttcattgtaaattacagcaaggaaagaaaatgtttaacagtgttaagagagtcagagcagagtggatattcatgcgattatgaagtgtttattagttaccattggcgacctagcatgcttctcatttcaaaccttggaaggtgaaaatgtacaaactctctaaataattaatgttcaaacactgatagaaattctaacatgaataaaaaataatataacttgttggttatatctttgtttgtagaatgctttttttctttaaaatacttgggagagacagttagtgttggagccatcagaaactgttgtttcatcttgctgaccttgtgacactcttcttttttgctctatctgatggagagagttttaggttttcctcctttttgttttgtataaatagtgggtataagcatagctctgttacatggatgtattacaaagtgggggctgagcttttagtgtgatcatcacccaaatagtgtacattgtacccattaattaatttcttatcacctgaccctatttttgttttctcataccaagaaacttcctaagttaaccatcaaaattagtccttctgtcatctctcttagcatacttatttcccttatgtgatgcctaataatgagggaacataaataaagccaaattcaaag

SEQ ID NO: 163910 - DNA, 7815 bp, Homo sapiens
  Payload ID: 12273
  Gene Symbol: PTCH1
  Gene Name: patched 1
  Uniprot ID: Q13635
  ENST ID: ENST00000418258
  CDS Start-End: 516-4406
aattcagctcacacagcctctccccacgctatggaaatgcgtcgggagtgaactccggcggccgcgctcaccacgtggatccccacttactaccattctcggcgggggtccagttgggggaacccgcaatatgttgttccaaagagcgctcgcccctagcgcccgtccccgagggtgatggacagagcaggactggtttgctggctcctgaaccttgggctccatcgctgggattacgcagcccctcccttctcagctctggggggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggcagtggaaattggaacatttgtgttacaaatcaggagagcttatcacagaaacaggttacatggatcagataatagaatatctttacccttgtttgattattacacctttggactgcttctgggaaggggcgaaattacagtctgggacagcatacctcctaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaacctcttgatatggcccttgttttgaatggtggatgtcatggcttatccagaaagtatatgcactggcaggaggagttgattgtgggtggcacagtcaagaacagcactggaaaactcgtcagcgcccatgccctgcagaccatgttccagttaatgactcccaagcaaatgtacgagcacttcaaggggtacgagtatgtctcacacatcaactggaacgaggacaaagcggcagccatcctggaggcctggcagaggacatatgtggaggtggttcatcagagtgtcgcacagaactccactcaaaaggtgctttccttcaccaccacgaccctggacgacatcctgaaatccttctctgacgtcagtgtcatccgcgtggccagcggctacttactcatgctcgcctatgcctgtctaaccatgctgcgctgggactgctccaagtcccagggtgccgtggggctggctggcgtcctgctggttgcactgtcagtggctgcaggactgggcctgtgctcattgatcggaatttcctttaacgctgcaacaactcaggttttgccatttctcgctcttggtgttggtgtggatgatgtttttcttctggcccacgccttcagtgaaacaggacagaataaaagaatcccttttgaggacaggaccggggagtgcctgaagcgcacaggagccagcgtggccctcacgtccatcagcaatgtcacagccttcttcatggccgcgttaatcccaattcccgctctgcgggcgttctccctccaggcagcggtagtagtggtgttcaattttgccatggttctgctcatttttcctgcaattctcagcatggatttatatcgacgcgaggacaggagactggatattttctgctgttttacaagcccctgcgtcagcagagtgattcaggttgaacctcaggcctacaccgacacacacgacaatacccgctacagccccccacctccctacagcagccacagctttgcccatgaaacgcagattaccatgcagtccactgtccagctccgcacggagtacgacccccacacgcacgtgtactacaccaccgctgagccgcgctccgagatctctgtgcagcccgtcaccgtgacacaggacaccctcagctgccagagcccagagagcaccagctccacaagggacctgctctcccagttctccgactccagcctccactgcctcgagcccccctgtacgaagtggacactctcatcttttgctgagaagcactatgctcctttcctcttgaaaccaaaagccaaggtagtggtgatcttcctttttctgggcttgctgggggtcagcctttatggcaccacccgagtgagagacgggctggaccttacggacattgtacctcgggaaaccagagaatatgactttattgctgcacaattcaaatacttttctttctacaacatgtatatagtcacccagaaagcagactacccgaatatccagcacttactttacgacctacacaggagtttcagtaacgtgaagtatgtcatgttggaagaaaacaaacagcttcccaaaatgtggctgcactacttcagagactggcttcagggacttcaggatgcatttgacagtgactgggaaaccgggaaaatcatgccaaacaattacaagaatggatcagacgatggagtccttgcctacaaactcctggtgcaaaccggcagccgcgataagcccatcgacatcagccagttgactaaacagcgtctggtggatgcagatggcatcattaatcccagcgctttctacatctacctgacggcttgggtcagcaacgaccccgtcgcgtatgctgcctcccaggccaacatccggccacaccgaccagaatgggtccacgacaaagccgactacatgcctgaaacaaggctgagaatcccggcagcagagcccatcgagtatgcccagttccctttctacctcaacggcttgcgggacacctcagactttgtggaggcaattgaaaaagtaaggaccatctgcagcaactatacgagcctggggctgtccagttaccccaacggctaccccttcctcttctgggagcagtacatcggcctccgccactggctgctgctgttcatcagcgtggtgttggcctgcacattcctcgtgtgcgctgtcttccttctgaacccctggacggccgggatcattgtgatggtcctggcgctgatgacggtcgagctgttcggcatgatgggcctcatcggaatcaagctcagtgccgtgcccgtggtcatcctgatcgcttctgttggcataggagtggagttcaccgttcacgttgctttggcctttctgacggccatcggcgacaagaaccgcagggctgtgcttgccctggagcacatgtttgcacccgtcctggatggcgccgtgtccactctgctgggagtgctgatgctggcgggatctgagttcgacttcattgtcaggtatttctttgctgtgctggcgatcctcaccatcctcggcgttctcaatgggctggttttgcttcccgtgcttttgtctttctttggaccatatcctgaggtgtctccagccaacggcttgaaccgcctgcccacaccctcccctgagccaccccccagcgtggtccgcttcgccatgccgcccggccacacgcacagcgggtctgattcctccgactcggagtatagttcccagacgacagtgtcaggcctcagcgaggagcttcggcactacgaggcccagcagggcgcgggaggccctgcccaccaagtgatcgtggaagccacagaaaaccccgtcttcgcccactccactgtggtccatcccgaatccaggcatcacccaccctcgaacccgagacagcagccccacctggactcagggtccctgcctcccggacggcaaggccagcagccccgcagggacccccccagagaaggcttgtggccacccccctacagaccgcgcagagacgcttttgaaatttctactgaagggcattctggccctagcaatagggcccgctggggccctcgcggggcccgttctcacaaccctcggaacccagcgtccactgccatgggcagctccgtgcccggctactgccagcccatcaccactgtgacggcttctgcctccgtgactgtcgccgtgcacccgccgcctgtccctgggcctgggcggaacccccgagggggactctgcccaggctaccctgagactgaccacggcctgtttgaggacccccacgtgcctttccacgtccggtgtgagaggagggattcgaaggtggaagtcattgagctgcaggacgtggaatgcgaggagaggccccggggaagcagctccaactgagggtgattaaaatctgaagcaaagaggccaaagattggaaaccccccacccccacctctttccagaactgcttgaagagaactggttggagttatggaaaagatgccctgtgccaggacagcagttcattgttactgtaaccgattgtattattttgttaaatatttctataaatatttaagagatgtacacatgtgtaatataggaaggaaggatgtaaagtggtatgatctggggcttctccactcctgccccagagtgtggaggccacagtggggcctctccgtatttgtgcattgggctccgtgccacaaccaagcttcattagtcttaaatttcagcatatgttgctgctgcttaaatattgtataatttacttgtataattctatgcaaatattgcttatgtaataggattattttgtaaaggtttctgtttaaaatattttaaatttgcatatcacaaccctgtggtagtatgaaatgttactgttaactttcaaacacgctatgcgtgataatttttttgtttaatgagcagatatgaagaaagcacgttaatcctggtggcttctctaggtgtcgttgtgtgcggtcctcttgtttggctgtgcgtgtgaacacgtgtgtgagttcaccatgtactgtactgtgattttttttttgtcttgttttgtttctctacactgtctgtaacctgtagtaggctctgacctagtcaggctggaagcgtcaggatatcttttcttcgtgctggtgagggctggccctaaacatccacctaatcctttcaaatcagcccggcaaaagctagactctcctcgtgtctacggcatctcttatgatcattggctgccatccaggaccccaatttgtgcttcagggggataatctccttctctcggatcattgtgatggatgctggaacctcagggtatggagctcacatcagttcatcatggtgggtgttagagaattcggtgacatgcctagtgctgagccttggctgggccatgagagtctgtatactctaaaaagcatgcagcatggtgcccctcttctgaccaacacacacacgacccctcccccaacacccccaaattcaagagtggatgtggccctgtcacaggtagaaaaacctatttagttaattctttcttggcccacagtctcccagaaatgatgttttgagtccctatagtttaaactccctctcttaaatggagcagctggttgaggctttctagatctgtttgcatcttctttaaaactaagtggtgagcatgcattgtggtgtagaggcaggcattatgtaggataagagctccggggggattcttcatgcaccagtgtttagggtacgtgcttcctaagtaaatccaaacattgtctccatcctccccgtcattagtgctctttcaatgtgatgtgggaaagcaggaggatggacacaccccactgaaagatgtaggcaggggcaggtctctcaaccaggcatatttttaaaagttgcttctgtactggttctcttcttttgctctgaggtgtgggctccctcatctcgtaaccagagaccagcacatgtcagggaagcacccagtgtcggctccccatccaaatccacaccagcaccttgttacagacaagaagtcagaggaaagggcggggtccctgcagggctgaagcctaagctactgtgaggcgctcacgagtggcagctcctgttactcccttttaaattacctgggaaatcttaacagaaaggtaatgggcccccagaaatacccacagcatagtgacctcagaccctgatactcaccacaaaacttttaagatgctgattgggagccgcttgtggctgctgggtgtgtgtgtgtgtgtgtgcgtgcgtgcgtgtgtgtgtgtctctgctggggaccctggccacccccctgctgctgtcttggtgcctgtcacccacatggtctgccatcctaacacccagctctgctcagaaaacgtcctgcgtggaggagggatgatgcagaattctgaagtcgacttccctctggctcctggcgtgccctcgctcccttcctgagcccagctcgtgttgcgccggaggctgcgcggcccctgatttctgcatggtgtagaactttctccaatagtcacattggcaaagggagaactggggtgggcggggggtggggctggcagggaattagaatttctctctctcttttaatagttttattttgtctgtcctgtttgttcatttggatgttttaatttttaaaaaaaaaaaaactttgctgatatttataattttgtatcataagaatgttttcctctacagtatttgtcatgccagtttataacaaaaaaaaatgcagggattttatttctattggaaacattacagctatgttttacttttggacagaatttttatttgtatagagtgcttactaatgttaaatagttcagagtatataacatttacattaaggactcatggtaggttttagggtaaggagtttaaaggaaataaatattcaaactgggtctcattgccaattttggtggaaatgagtttgtgtcatttcaattacaaagataaaagtatgccatataatttatttatatgaagatttatttttgtagtgtacatagtagtcatcaagtcttttgacagaagtatatttttaaagaatttatatgtgatgaatccataatgtctggaactttgctgagacatgagtgggcacagttttcattgtaaattacagcaaggaaagaaaatgtttaacagtgttaagagagtcagagcagagtggatattcatgcgattatgaagtgtttattagttaccattggcgacctagcatgcttctcatttcaaaccttggaaggtgaaaatgtacaaactctctaaataattaatgttcaaacactgatagaaattctaacatgaataaaaaataatataacttgttggttatatctttgtttgtagaatgctttttttctttaaaatacttgggagagacagttagtgttggagccatcagaaactgttgtttcatcttgctgaccttgtgacactcttcttttttgctctatctgatggagagagttttaggttttcctcctttttgttttgtataaatagtgggtataagcatagctctgttacatggatgtattacaaagtgggggctgagcttttagtgtgatcatcacccaaatagtgtacattgtacccattaattaatttcttatcacctgaccctatttttgttttctcataccaagaaacttcctaagttaaccatcaaaattagtccttctgtcatctctcttagcatacttatttcccttatgtgatgcctaataatgagggaacataaataaagccaaattcaaag

SEQ ID NO: 163911 - DNA, 7659 bp, Homo sapiens
  Payload ID: 12273
  Gene Symbol: PTCH1
  Gene Name: patched 1
  Uniprot ID: Q13635
  ENST ID: ENST00000421141
  CDS Start-End: 360-4250
actcacacctctccaggaaaagcagcagacaaatggggattgaaaaattcaaaccctccctctggtcctgggaggaaagggctgtctgaggtccgcagggggtggaggggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggcagtggaaattggaacatttgtgttacaaatcaggagagcttatcacagaaacaggttacatggatcagataatagaatatctttacccttgtttgattattacacctttggactgcttctgggaaggggcgaaattacagtctgggacagcatacctcctaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaacctcttgatatggcccttgttttgaatggtggatgtcatggcttatccagaaagtatatgcactggcaggaggagttgattgtgggtggcacagtcaagaacagcactggaaaactcgtcagcgcccatgccctgcagaccatgttccagttaatgactcccaagcaaatgtacgagcacttcaaggggtacgagtatgtctcacacatcaactggaacgaggacaaagcggcagccatcctggaggcctggcagaggacatatgtggaggtggttcatcagagtgtcgcacagaactccactcaaaaggtgctttccttcaccaccacgaccctggacgacatcctgaaatccttctctgacgtcagtgtcatccgcgtggccagcggctacttactcatgctcgcctatgcctgtctaaccatgctgcgctgggactgctccaagtcccagggtgccgtggggctggctggcgtcctgctggttgcactgtcagtggctgcaggactgggcctgtgctcattgatcggaatttcctttaacgctgcaacaactcaggttttgccatttctcgctcttggtgttggtgtggatgatgtttttcttctggcccacgccttcagtgaaacaggacagaataaaagaatcccttttgaggacaggaccggggagtgcctgaagcgcacaggagccagcgtggccctcacgtccatcagcaatgtcacagccttcttcatggccgcgttaatcccaattcccgctctgcgggcgttctccctccaggcagcggtagtagtggtgttcaattttgccatggttctgctcatttttcctgcaattctcagcatggatttatatcgacgcgaggacaggagactggatattttctgctgttttacaagcccctgcgtcagcagagtgattcaggttgaacctcaggcctacaccgacacacacgacaatacccgctacagccccccacctccctacagcagccacagctttgcccatgaaacgcagattaccatgcagtccactgtccagctccgcacggagtacgacccccacacgcacgtgtactacaccaccgctgagccgcgctccgagatctctgtgcagcccgtcaccgtgacacaggacaccctcagctgccagagcccagagagcaccagctccacaagggacctgctctcccagttctccgactccagcctccactgcctcgagcccccctgtacgaagtggacactctcatcttttgctgagaagcactatgctcctttcctcttgaaaccaaaagccaaggtagtggtgatcttcctttttctgggcttgctgggggtcagcctttatggcaccacccgagtgagagacgggctggaccttacggacattgtacctcgggaaaccagagaatatgactttattgctgcacaattcaaatacttttctttctacaacatgtatatagtcacccagaaagcagactacccgaatatccagcacttactttacgacctacacaggagtttcagtaacgtgaagtatgtcatgttggaagaaaacaaacagcttcccaaaatgtggctgcactacttcagagactggcttcagggacttcaggatgcatttgacagtgactgggaaaccgggaaaatcatgccaaacaattacaagaatggatcagacgatggagtccttgcctacaaactcctggtgcaaaccggcagccgcgataagcccatcgacatcagccagttgactaaacagcgtctggtggatgcagatggcatcattaatcccagcgctttctacatctacctgacggcttgggtcagcaacgaccccgtcgcgtatgctgcctcccaggccaacatccggccacaccgaccagaatgggtccacgacaaagccgactacatgcctgaaacaaggctgagaatcccggcagcagagcccatcgagtatgcccagttccctttctacctcaacggcttgcgggacacctcagactttgtggaggcaattgaaaaagtaaggaccatctgcagcaactatacgagcctggggctgtccagttaccccaacggctaccccttcctcttctgggagcagtacatcggcctccgccactggctgctgctgttcatcagcgtggtgttggcctgcacattcctcgtgtgcgctgtcttccttctgaacccctggacggccgggatcattgtgatggtcctggcgctgatgacggtcgagctgttcggcatgatgggcctcatcggaatcaagctcagtgccgtgcccgtggtcatcctgatcgcttctgttggcataggagtggagttcaccgttcacgttgctttggcctttctgacggccatcggcgacaagaaccgcagggctgtgcttgccctggagcacatgtttgcacccgtcctggatggcgccgtgtccactctgctgggagtgctgatgctggcgggatctgagttcgacttcattgtcaggtatttctttgctgtgctggcgatcctcaccatcctcggcgttctcaatgggctggttttgcttcccgtgcttttgtctttctttggaccatatcctgaggtgtctccagccaacggcttgaaccgcctgcccacaccctcccctgagccaccccccagcgtggtccgcttcgccatgccgcccggccacacgcacagcgggtctgattcctccgactcggagtatagttcccagacgacagtgtcaggcctcagcgaggagcttcggcactacgaggcccagcagggcgcgggaggccctgcccaccaagtgatcgtggaagccacagaaaaccccgtcttcgcccactccactgtggtccatcccgaatccaggcatcacccaccctcgaacccgagacagcagccccacctggactcagggtccctgcctcccggacggcaaggccagcagccccgcagggacccccccagagaaggcttgtggccacccccctacagaccgcgcagagacgcttttgaaatttctactgaagggcattctggccctagcaatagggcccgctggggccctcgcggggcccgttctcacaaccctcggaacccagcgtccactgccatgggcagctccgtgcccggctactgccagcccatcaccactgtgacggcttctgcctccgtgactgtcgccgtgcacccgccgcctgtccctgggcctgggcggaacccccgagggggactctgcccaggctaccctgagactgaccacggcctgtttgaggacccccacgtgcctttccacgtccggtgtgagaggagggattcgaaggtggaagtcattgagctgcaggacgtggaatgcgaggagaggccccggggaagcagctccaactgagggtgattaaaatctgaagcaaagaggccaaagattggaaaccccccacccccacctctttccagaactgcttgaagagaactggttggagttatggaaaagatgccctgtgccaggacagcagttcattgttactgtaaccgattgtattattttgttaaatatttctataaatatttaagagatgtacacatgtgtaatataggaaggaaggatgtaaagtggtatgatctggggcttctccactcctgccccagagtgtggaggccacagtggggcctctccgtatttgtgcattgggctccgtgccacaaccaagcttcattagtcttaaatttcagcatatgttgctgctgcttaaatattgtataatttacttgtataattctatgcaaatattgcttatgtaataggattattttgtaaaggtttctgtttaaaatattttaaatttgcatatcacaaccctgtggtagtatgaaatgttactgttaactttcaaacacgctatgcgtgataatttttttgtttaatgagcagatatgaagaaagcacgttaatcctggtggcttctctaggtgtcgttgtgtgcggtcctcttgtttggctgtgcgtgtgaacacgtgtgtgagttcaccatgtactgtactgtgattttttttttgtcttgttttgtttctctacactgtctgtaacctgtagtaggctctgacctagtcaggctggaagcgtcaggatatcttttcttcgtgctggtgagggctggccctaaacatccacctaatcctttcaaatcagcccggcaaaagctagactctcctcgtgtctacggcatctcttatgatcattggctgccatccaggaccccaatttgtgcttcagggggataatctccttctctcggatcattgtgatggatgctggaacctcagggtatggagctcacatcagttcatcatggtgggtgttagagaattcggtgacatgcctagtgctgagccttggctgggccatgagagtctgtatactctaaaaagcatgcagcatggtgcccctcttctgaccaacacacacacgacccctcccccaacacccccaaattcaagagtggatgtggccctgtcacaggtagaaaaacctatttagttaattctttcttggcccacagtctcccagaaatgatgttttgagtccctatagtttaaactccctctcttaaatggagcagctggttgaggctttctagatctgtttgcatcttctttaaaactaagtggtgagcatgcattgtggtgtagaggcaggcattatgtaggataagagctccggggggattcttcatgcaccagtgtttagggtacgtgcttcctaagtaaatccaaacattgtctccatcctccccgtcattagtgctctttcaatgtgatgtgggaaagcaggaggatggacacaccccactgaaagatgtaggcaggggcaggtctctcaaccaggcatatttttaaaagttgcttctgtactggttctcttcttttgctctgaggtgtgggctccctcatctcgtaaccagagaccagcacatgtcagggaagcacccagtgtcggctccccatccaaatccacaccagcaccttgttacagacaagaagtcagaggaaagggcggggtccctgcagggctgaagcctaagctactgtgaggcgctcacgagtggcagctcctgttactcccttttaaattacctgggaaatcttaacagaaaggtaatgggcccccagaaatacccacagcatagtgacctcagaccctgatactcaccacaaaacttttaagatgctgattgggagccgcttgtggctgctgggtgtgtgtgtgtgtgtgtgcgtgcgtgcgtgtgtgtgtgtctctgctggggaccctggccacccccctgctgctgtcttggtgcctgtcacccacatggtctgccatcctaacacccagctctgctcagaaaacgtcctgcgtggaggagggatgatgcagaattctgaagtcgacttccctctggctcctggcgtgccctcgctcccttcctgagcccagctcgtgttgcgccggaggctgcgcggcccctgatttctgcatggtgtagaactttctccaatagtcacattggcaaagggagaactggggtgggcggggggtggggctggcagggaattagaatttctctctctcttttaatagttttattttgtctgtcctgtttgttcatttggatgttttaatttttaaaaaaaaaaaaactttgctgatatttataattttgtatcataagaatgttttcctctacagtatttgtcatgccagtttataacaaaaaaaaatgcagggattttatttctattggaaacattacagctatgttttacttttggacagaatttttatttgtatagagtgcttactaatgttaaatagttcagagtatataacatttacattaaggactcatggtaggttttagggtaaggagtttaaaggaaataaatattcaaactgggtctcattgccaattttggtggaaatgagtttgtgtcatttcaattacaaagataaaagtatgccatataatttatttatatgaagatttatttttgtagtgtacatagtagtcatcaagtcttttgacagaagtatatttttaaagaatttatatgtgatgaatccataatgtctggaactttgctgagacatgagtgggcacagttttcattgtaaattacagcaaggaaagaaaatgtttaacagtgttaagagagtcagagcagagtggatattcatgcgattatgaagtgtttattagttaccattggcgacctagcatgcttctcatttcaaaccttggaaggtgaaaatgtacaaactctctaaataattaatgttcaaacactgatagaaattctaacatgaataaaaaataatataacttgttggttatatctttgtttgtagaatgctttttttctttaaaatacttgggagagacagttagtgttggagccatcagaaactgttgtttcatcttgctgaccttgtgacactcttcttttttgctctatctgatggagagagttttaggttttcctcctttttgttttgtataaatagtgggtataagcatagctctgttacatggatgtattacaaagtgggggctgagcttttagtgtgatcatcacccaaatagtgtacattgtacccattaattaatttcttatcacctgaccctatttttgttttctcataccaagaaacttcctaagttaaccatcaaaattagtccttctgtcatctctcttagcatacttatttcccttatgtgatgcctaataatgagggaacataaataaagccaaattcaaag

SEQ ID NO: 163912 - DNA, 8232 bp, Homo sapiens
  Payload ID: 12273
  Gene Symbol: PTCH1
  Gene Name: patched 1
  Uniprot ID: Q13635
  ENST ID: ENST00000430669
  CDS Start-End: 587-4732
cggccgcggggggcggggagagggtggctaggctcgcgggagctcgccgggcagggcgcctcccaggaaggcggggaggggagcgcctgtttacccaggagggctgtgctgatagcacgttcctcgagtttactttgctttccttgagtttattgtaaaggggtaaagttttcggatccgtcacgtgaccctgacaggtcctgcctatggcgcggcagaccacccacgccgagggccatggaactgcttaatagaaacaggcttgtaattgtgagtccgcgctgcactccgccgaaagcctccggcggcccagcgcgccggggtttttacactttccgttccttttgtaaagacggaggaggaggagaagaagaagaagaaaacggaggagaagaaaaagacgacaggggagacaaagagacccgcagcgacaaggcaagggggagacgagggaagactgggagaagacggaggagcggaggacgaggaaaggggggccagggaaaaaaaaggaattgatgtgaaatccaagcccagcgtccgcgccatcggcacccgcgctccgagcaggggttgacggccggctatggggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggcagtggaaattggaacatttgtgttacaaatcaggagagcttatcacagaaacaggttacatggatcagataatagaatatctttacccttgtttgattattacacctttggactgcttctgggaaggggcgaaattacagtctgggacagcatacctcctaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaacctcttgatatggcccttgttttgaatggtggatgtcatggcttatccagaaagtatatgcactggcaggaggagttgattgtgggtggcacagtcaagaacagcactggaaaactcgtcagcgcccatgccctgcagaccatgttccagttaatgactcccaagcaaatgtacgagcacttcaaggggtacgagtatgtctcacacatcaactggaacgaggacaaagcggcagccatcctggaggcctggcagaggacatatgtggaggtggttcatcagagtgtcgcacagaactccactcaaaaggtgctttccttcaccaccacgaccctggacgacatcctgaaatccttctctgacgtcagtgtcatccgcgtggccagcggctacttactcatgctcgcctatgcctgtctaaccatgctgcgctgggactgctccaagtcccagggtgccgtggggctggctggcgtcctgctggttgcactgtcagtggctgcaggactgggcctgtgctcattgatcggaatttcctttaacgctgcaacaactcaggttttgccatttctcgctcttggtgttggtgtggatgatgtttttcttctggcccacgccttcagtgaaacaggacagaataaaagaatcccttttgaggacaggaccggggagtgcctgaagcgcacaggagccagcgtggccctcacgtccatcagcaatgtcacagccttcttcatggccgcgttaatcccaattcccgctctgcgggcgttctccctccaggcagcggtagtagtggtgttcaattttgccatggttctgctcatttttcctgcaattctcagcatggatttatatcgacgcgaggacaggagactggatattttctgctgttttacaagcccctgcgtcagcagagtgattcaggttgaacctcaggcctacaccgacacacacgacaatacccgctacagccccccacctccctacagcagccacagctttgcccatgaaacgcagattaccatgcagtccactgtccagctccgcacggagtacgacccccacacgcacgtgtactacaccaccgctgagccgcgctccgagatctctgtgcagcccgtcaccgtgacacaggacaccctcagctgccagagcccagagagcaccagctccacaagggacctgctctcccagttctccgactccagcctccactgcctcgagcccccctgtacgaagtggacactctcatcttttgctgagaagcactatgctcctttcctcttgaaaccaaaagccaaggtagtggtgatcttcctttttctgggcttgctgggggtcagcctttatggcaccacccgagtgagagacgggctggaccttacggacattgtacctcgggaaaccagagaatatgactttattgctgcacaattcaaatacttttctttctacaacatgtatatagtcacccagaaagcagactacccgaatatccagcacttactttacgacctacacaggagtttcagtaacgtgaagtatgtcatgttggaagaaaacaaacagcttcccaaaatgtggctgcactacttcagagactggcttcagggacttcaggatgcatttgacagtgactgggaaaccgggaaaatcatgccaaacaattacaagaatggatcagacgatggagtccttgcctacaaactcctggtgcaaaccggcagccgcgataagcccatcgacatcagccagttgactaaacagcgtctggtggatgcagatggcatcattaatcccagcgctttctacatctacctgacggcttgggtcagcaacgaccccgtcgcgtatgctgcctcccaggccaacatccggccacaccgaccagaatgggtccacgacaaagccgactacatgcctgaaacaaggctgagaatcccggcagcagagcccatcgagtatgcccagttccctttctacctcaacggcttgcgggacacctcagactttgtggaggcaattgaaaaagtaaggaccatctgcagcaactatacgagcctggggctgtccagttaccccaacggctaccccttcctcttctgggagcagtacatcggcctccgccactggctgctgctgttcatcagcgtggtgttggcctgcacattcctcgtgtgcgctgtcttccttctgaacccctggacggccgggatcattgtgatggtcctggcgctgatgacggtcgagctgttcggcatgatgggcctcatcggaatcaagctcagtgccgtgcccgtggtcatcctgatcgcttctgttggcataggagtggagttcaccgttcacgttgctttggcctttctgacggccatcggcgacaagaaccgcagggctgtgcttgccctggagcacatgtttgcacccgtcctggatggcgccgtgtccactctgctgggagtgctgatgctggcgggatctgagttcgacttcattgtcaggtatttctttgctgtgctggcgatcctcaccatcctcggcgttctcaatgggctggttttgcttcccgtgcttttgtctttctttggaccatatcctgaggtgtctccagccaacggcttgaaccgcctgcccacaccctcccctgagccaccccccagcgtggtccgcttcgccatgccgcccggccacacgcacagcgggtctgattcctccgactcggagtatagttcccagacgacagtgtcaggcctcagcgaggagcttcggcactacgaggcccagcagggcgcgggaggccctgcccaccaagtgatcgtggaagccacagaaaaccccgtcttcgcccactccactgtggtccatcccgaatccaggcatcacccaccctcgaacccgagacagcagccccacctggactcagggtccctgcctcccggacggcaaggccagcagccccgcagggacccccccagagaaggcttgtggccacccccctacagaccgcgcagagacgcttttgaaatttctactgaagggcattctggccctagcaatagggcccgctggggccctcgcggggcccgttctcacaaccctcggaacccagcgtccactgccatgggcagctccgtgcccggctactgccagcccatcaccactgtgacggcttctgcctccgtgactgtcgccgtgcacccgccgcctgtccctgggcctgggcggaacccccgagggggactctgcccaggctaccctgagactgaccacggcctgtttgaggacccccacgtgcctttccacgtccggtgtgagaggagggattcgaaggtggaagtcattgagctgcaggacgtggaatgcgaggagaggccccggggaagcagctccaactgaggtgagtgccactgacaagggcagccaagggacctagagccaggcaaagaggaggacaaggttctcctggggttctcggcatccccgaggggctgtggcgctcgggcacatcccacgctggaccccagtgaccttttatccccagagcaaggctgatgtgtccaagctttgtcatccttggggaaccagtccagctccacactgctctcttcccccactgctaacctgcggagggtcggtgcagcgccacaaggacacaaacagcaccaccttttaccaatatttgccagtctttatggaggtgcatgccacagcgaattggtcacatgggaacgcatccgtgtaaccagcccccagatgaagggagaggtcacaagcagcccccagggacacctcaggcccacaccccactctcgtgatttctaataccaaggttactgctgcctgcttttgtactttataaatacggacttgcacacctcttactctgttcaacttccttttttgcttccttttaaagggtgattaaaatctgaagcaaagaggccaaagattggaaaccccccacccccacctctttccagaactgcttgaagagaactggttggagttatggaaaagatgccctgtgccaggacagcagttcattgttactgtaaccgattgtattattttgttaaatatttctataaatatttaagagatgtacacatgtgtaatataggaaggaaggatgtaaagtggtatgatctggggcttctccactcctgccccagagtgtggaggccacagtggggcctctccgtatttgtgcattgggctccgtgccacaaccaagcttcattagtcttaaatttcagcatatgttgctgctgcttaaatattgtataatttacttgtataattctatgcaaatattgcttatgtaataggattattttgtaaaggtttctgtttaaaatattttaaatttgcatatcacaaccctgtggtagtatgaaatgttactgttaactttcaaacacgctatgcgtgataatttttttgtttaatgagcagatatgaagaaagcacgttaatcctggtggcttctctaggtgtcgttgtgtgcggtcctcttgtttggctgtgcgtgtgaacacgtgtgtgagttcaccatgtactgtactgtgattttttttttgtcttgttttgtttctctacactgtctgtaacctgtagtaggctctgacctagtcaggctggaagcgtcaggatatcttttcttcgtgctggtgagggctggccctaaacatccacctaatcctttcaaatcagcccggcaaaagctagactctcctcgtgtctacggcatctcttatgatcattggctgccatccaggaccccaatttgtgcttcagggggataatctccttctctcggatcattgtgatggatgctggaacctcagggtatggagctcacatcagttcatcatggtgggtgttagagaattcggtgacatgcctagtgctgagccttggctgggccatgagagtctgtatactctaaaaagcatgcagcatggtgcccctcttctgaccaacacacacacgacccctcccccaacacccccaaattcaagagtggatgtggccctgtcacaggtagaaaaacctatttagttaattctttcttggcccacagtctcccagaaatgatgttttgagtccctatagtttaaactccctctcttaaatggagcagctggttgaggctttctagatctgtttgcatcttctttaaaactaagtggtgagcatgcattgtggtgtagaggcaggcattatgtaggataagagctccggggggattcttcatgcaccagtgtttagggtacgtgcttcctaagtaaatccaaacattgtctccatcctccccgtcattagtgctctttcaatgtgatgtgggaaagcaggaggatggacacaccccactgaaagatgtaggcaggggcaggtctctcaaccaggcatatttttaaaagttgcttctgtactggttctcttcttttgctctgaggtgtgggctccctcatctcgtaaccagagaccagcacatgtcagggaagcacccagtgtcggctccccatccaaatccacaccagcaccttgttacagacaagaagtcagaggaaagggcggggtccctgcagggctgaagcctaagctactgtgaggcgctcacgagtggcagctcctgttactcccttttaaattacctgggaaatcttaacagaaaggtaatgggcccccagaaatacccacagcatagtgacctcagaccctgatactcaccacaaaacttttaagatgctgattgggagccgcttgtggctgctgggtgtgtgtgtgtgtgtgtgcgtgcgtgcgtgtgtgtgtgtctctgctggggaccctggccacccccctgctgctgtcttggtgcctgtcacccacatggtctgccatcctaacacccagctctgctcagaaaacgtcctgcgtggaggagggatgatgcagaattctgaagtcgacttccctctggctcctggcgtgccctcgctcccttcctgagcccagctcgtgttgcgccggaggctgcgcggcccctgatttctgcatggtgtagaactttctccaatagtcacattggcaaagggagaactggggtgggcggggggtggggctggcagggaattagaatttctctctctcttttaatagttttattttgtctgtcctgtttgttcatttggatgttttaatttttaaaaaaaaaaaaactttgctgatatttataattttgtatcataagaatgttttcctctacagtatttgtcatgccagtttataacaaaaaaaaatgcagggattttatttctattggaaacattacagctatgttttacttttggacagaatttttatttgtatagagtgcttactaatgttaaatagttcagagtatataacatttacattaaggactcatggtaggttttagggtaaggagtttaaaggaaataaatattcaaactgggtctcattgccaattttggtggaaatgagtttgtgtcatttcaattacaaagataaaagtatgccatataatttatttatatgaagatttatttttgtagtgtacatagtagtcatcaagtcttttgacagaagtatatttttaaagaatttatatgtgatgaatccataatgtctggaactttgctgagacatgagtgggcacagttttcattgtaaattacagcaaggaaagaaaatgtttaacagtgttaagagagtcagagcagagtggatattcatgcgattatgaagtgtttattagttaccattggcgacctagcatgcttctcatttcaaaccttggaaggtgaaaatgtacaaactctctaaataattaatgttcaaacactgatagaaattctaacatgaataaaaaataatataacttgttggtt

SEQ ID NO: 163913 - DNA, 6563 bp, Homo sapiens
  Payload ID: 12273
  Gene Symbol: PTCH1
  Gene Name: patched 1
  Uniprot ID: Q13635
  ENST ID: ENST00000429896
  CDS Start-End: 442-4332
gaaggcgagcacccagacgggggcccgccggggccgcggccagcgccggggaaatgccgcgccggggagcagcctgcgccggcctgagcccttccctttgcactcggctgttttttacgtttaaccagaaaggaagggagaggagggaaagatccatgtggctgccctcttccgatcacaaatattgtcgggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggcagtggaaattggaacatttgtgttacaaatcaggagagcttatcacagaaacaggttacatggatcagataatagaatatctttacccttgtttgattattacacctttggactgcttctgggaaggggcgaaattacagtctgggacagcatacctcctaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaacctcttgatatggcccttgttttgaatggtggatgtcatggcttatccagaaagtatatgcactggcaggaggagttgattgtgggtggcacagtcaagaacagcactggaaaactcgtcagcgcccatgccctgcagaccatgttccagttaatgactcccaagcaaatgtacgagcacttcaaggggtacgagtatgtctcacacatcaactggaacgaggacaaagcggcagccatcctggaggcctggcagaggacatatgtggaggtggttcatcagagtgtcgcacagaactccactcaaaaggtgctttccttcaccaccacgaccctggacgacatcctgaaatccttctctgacgtcagtgtcatccgcgtggccagcggctacttactcatgctcgcctatgcctgtctaaccatgctgcgctgggactgctccaagtcccagggtgccgtggggctggctggcgtcctgctggttgcactgtcagtggctgcaggactgggcctgtgctcattgatcggaatttcctttaacgctgcaacaactcaggttttgccatttctcgctcttggtgttggtgtggatgatgtttttcttctggcccacgccttcagtgaaacaggacagaataaaagaatcccttttgaggacaggaccggggagtgcctgaagcgcacaggagccagcgtggccctcacgtccatcagcaatgtcacagccttcttcatggccgcgttaatcccaattcccgctctgcgggcgttctccctccaggcagcggtagtagtggtgttcaattttgccatggttctgctcatttttcctgcaattctcagcatggatttatatcgacgcgaggacaggagactggatattttctgctgttttacaagcccctgcgtcagcagagtgattcaggttgaacctcaggcctacaccgacacacacgacaatacccgctacagccccccacctccctacagcagccacagctttgcccatgaaacgcagattaccatgcagtccactgtccagctccgcacggagtacgacccccacacgcacgtgtactacaccaccgctgagccgcgctccgagatctctgtgcagcccgtcaccgtgacacaggacaccctcagctgccagagcccagagagcaccagctccacaagggacctgctctcccagttctccgactccagcctccactgcctcgagcccccctgtacgaagtggacactctcatcttttgctgagaagcactatgctcctttcctcttgaaaccaaaagccaaggtagtggtgatcttcctttttctgggcttgctgggggtcagcctttatggcaccacccgagtgagagacgggctggaccttacggacattgtacctcgggaaaccagagaatatgactttattgctgcacaattcaaatacttttctttctacaacatgtatatagtcacccagaaagcagactacccgaatatccagcacttactttacgacctacacaggagtttcagtaacgtgaagtatgtcatgttggaagaaaacaaacagcttcccaaaatgtggctgcactacttcagagactggcttcagggacttcaggatgcatttgacagtgactgggaaaccgggaaaatcatgccaaacaattacaagaatggatcagacgatggagtccttgcctacaaactcctggtgcaaaccggcagccgcgataagcccatcgacatcagccagttgactaaacagcgtctggtggatgcagatggcatcattaatcccagcgctttctacatctacctgacggcttgggtcagcaacgaccccgtcgcgtatgctgcctcccaggccaacatccggccacaccgaccagaatgggtccacgacaaagccgactacatgcctgaaacaaggctgagaatcccggcagcagagcccatcgagtatgcccagttccctttctacctcaacggcttgcgggacacctcagactttgtggaggcaattgaaaaagtaaggaccatctgcagcaactatacgagcctggggctgtccagttaccccaacggctaccccttcctcttctgggagcagtacatcggcctccgccactggctgctgctgttcatcagcgtggtgttggcctgcacattcctcgtgtgcgctgtcttccttctgaacccctggacggccgggatcattgtgatggtcctggcgctgatgacggtcgagctgttcggcatgatgggcctcatcggaatcaagctcagtgccgtgcccgtggtcatcctgatcgcttctgttggcataggagtggagttcaccgttcacgttgctttggcctttctgacggccatcggcgacaagaaccgcagggctgtgcttgccctggagcacatgtttgcacccgtcctggatggcgccgtgtccactctgctgggagtgctgatgctggcgggatctgagttcgacttcattgtcaggtatttctttgctgtgctggcgatcctcaccatcctcggcgttctcaatgggctggttttgcttcccgtgcttttgtctttctttggaccatatcctgaggtgtctccagccaacggcttgaaccgcctgcccacaccctcccctgagccaccccccagcgtggtccgcttcgccatgccgcccggccacacgcacagcgggtctgattcctccgactcggagtatagttcccagacgacagtgtcaggcctcagcgaggagcttcggcactacgaggcccagcagggcgcgggaggccctgcccaccaagtgatcgtggaagccacagaaaaccccgtcttcgcccactccactgtggtccatcccgaatccaggcatcacccaccctcgaacccgagacagcagccccacctggactcagggtccctgcctcccggacggcaaggccagcagccccgcagggacccccccagagaaggcttgtggccacccccctacagaccgcgcagagacgcttttgaaatttctactgaagggcattctggccctagcaatagggcccgctggggccctcgcggggcccgttctcacaaccctcggaacccagcgtccactgccatgggcagctccgtgcccggctactgccagcccatcaccactgtgacggcttctgcctccgtgactgtcgccgtgcacccgccgcctgtccctgggcctgggcggaacccccgagggggactctgcccaggctaccctgagactgaccacggcctgtttgaggacccccacgtgcctttccacgtccggtgtgagaggagggattcgaaggtggaagtcattgagctgcaggacgtggaatgcgaggagaggccccggggaagcagctccaactgagggtgattaaaatctgaagcaaagaggccaaagattggaaaccccccacccccacctctttccagaactgcttgaagagaactggttggagttatggaaaagatgccctgtgccaggacagcagttcattgttactgtaaccgattgtattattttgttaaatatttctataaatatttaagagatgtacacatgtgtaatataggaaggaaggatgtaaagtggtatgatctggggcttctccactcctgccccagagtgtggaggccacagtggggcctctccgtatttgtgcattgggctccgtgccacaaccaagcttcattagtcttaaatttcagcatatgttgctgctgcttaaatattgtataatttacttgtataattctatgcaaatattgcttatgtaataggattattttgtaaaggtttctgtttaaaatattttaaatttgcatatcacaaccctgtggtagtatgaaatgttactgttaactttcaaacacgctatgcgtgataatttttttgtttaatgagcagatatgaagaaagcacgttaatcctggtggcttctctaggtgtcgttgtgtgcggtcctcttgtttggctgtgcgtgtgaacacgtgtgtgagttcaccatgtactgtactgtgattttttttttgtcttgttttgtttctctacactgtctgtaacctgtagtaggctctgacctagtcaggctggaagcgtcaggatatcttttcttcgtgctggtgagggctggccctaaacatccacctaatcctttcaaatcagcccggcaaaagctagactctcctcgtgtctacggcatctcttatgatcattggctgccatccaggaccccaatttgtgcttcagggggataatctccttctctcggatcattgtgatggatgctggaacctcagggtatggagctcacatcagttcatcatggtgggtgttagagaattcggtgacatgcctagtgctgagccttggctgggccatgagagtctgtatactctaaaaagcatgcagcatggtgcccctcttctgaccaacacacacacgacccctcccccaacacccccaaattcaagagtggatgtggccctgtcacaggtagaaaaacctatttagttaattctttcttggcccacagtctcccagaaatgatgttttgagtccctatagtttaaactccctctcttaaatggagcagctggttgaggctttctagatctgtttgcatcttctttaaaactaagtggtgagcatgcattgtggtgtagaggcaggcattatgtaggataagagctccggggggattcttcatgcaccagtgtttagggtacgtgcttcctaagtaaatccaaacattgtctccatcctccccgtcattagtgctctttcaatgtgatgtgggaaagcaggaggatggacacaccccactgaaagatgtaggcaggggcaggtctctcaaccaggcatatttttaaaagttgcttctgtactggttctcttcttttgctctgaggtgtgggctccctcatctcgtaaccagagaccagcacatgtcagggaagcacccagtgtcggctccccatccaaatccacaccagcaccttgttacagacaagaagtcagaggaaagggcggggtccctgcagggctgaagcctaagctactgtgaggcgctcacgagtggcagctcctgttactcccttttaaattacctgggaaatcttaacagaaaggtaatgggcccccagaaatacccacagcatagtgacctcagaccctgatactcaccacaaaacttttaagatgctgattgggagccgcttgtggctgctgggtgtgtgtgtgtgtgtgtgcgtgcgtgcgtgtgtgtgtgtctctgctggggaccctggccacccccctgctgctgtcttggtgcctgtcacccacatggtctgccatcctaacacccagctctgctcagaaaacgtcctgcgtggaggagggatgatgcagaattctgaagtcgacttccctctggctcctggcgtgccctcgctcccttcctgagcccagctcgtgttgcgccggaggctgcgcggcccctgatttctgcatggtgtagaactttctccaatagtcacattggcaaagggagaactggggtgggcggggggtggggctggcagggaattagaatttctctctctcttttaatagtt

SEQ ID NO: 163914 - DNA, 809 bp, Homo sapiens
  Payload ID: 12273
  Gene Symbol: PTCH1
  Gene Name: patched 1
  ENST ID: ENST00000551845
  CDS Start-End: 288-809
atccatgtggctgccctcttccgatcacaaatattgggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggcagtggaaattggaacatttgtgttacaaatcaggagagcttatcacagaaacaggttacatggatcagataatagaatatctttacccttgtttgattattacacctttggactgcttctgggaaggggcgaaattacagtctgggacagcatacctcctaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaacctcttgatatggcccttgttttgaatggt

SEQ ID NO: 163915 - DNA, 366 bp, Homo sapiens
  Payload ID: 12273
  Gene Symbol: PTCH1
  Gene Name: patched 1
  ENST ID: ENST00000551623
  CDS Start-End: 1-51
gacgacaggggagacaaagagacccgcagcgacaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggcagtggaaattggaacatttgtgttacaaatcaggagagcttatcacagaaacaggttacatggatcagataatagaatatctttacccttgtttgattattacacctttggactgcttctgggaaggggcgaaattac

SEQ ID NO: 163916 - DNA, 1037 bp, Homo sapiens
  Payload ID: 12273
  Gene Symbol: PTCH1
  Gene Name: patched 1
  ENST ID: ENST00000553011
  CDS Start-End: 516-1037
aattcagctcacacagcctctccccacgctatggaaatgcgtcgggagtgaactccggcggccgcgctcaccacgtggatccccacttactaccattctcggcgggggtccagttgggggaacccgcaatatgttgttccaaagagcgctcgcccctagcgcccgtccccgagggtgatggacagagcaggactggtttgctggctcctgaaccttgggctccatcgctgggattacgcagcccctcccttctcagctctggggggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggcagtggaaattggaacatttgtgttacaaatcaggagagcttatcacagaaacaggttacatggatcagataatagaatatctttacccttgtttgattattacacctttggactgcttctgggaaggggcgaaattacagtctgggacagcatacctcctaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaacctcttgatatggcccttgttttgaatggt

SEQ ID NO: 163917 - DNA, 881 bp, Homo sapiens
  Payload ID: 12273
  Gene Symbol: PTCH1
  Gene Name: patched 1
  ENST ID: ENST00000547672
  CDS Start-End: 360-881
actcacacctctccaggaaaagcagcagacaaatggggattgaaaaattcaaaccctccctctggtcctgggaggaaagggctgtctgaggtccgcagggggtggaggggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggcagtggaaattggaacatttgtgttacaaatcaggagagcttatcacagaaacaggttacatggatcagataatagaatatctttacccttgtttgattattacacctttggactgcttctgggaaggggcgaaattacagtctgggacagcatacctcctaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaacctcttgatatggcccttgttttgaatggt

SEQ ID NO: 163918 - DNA, 864 bp, Homo sapiens
  Payload ID: 12273
  Gene Symbol: PTCH1
  Gene Name: patched 1
  ENST ID: ENST00000546820
  CDS Start-End: 343-864
actcacacctctccaggaaaagcagcagacaaatggggattgaaaaattcaaaccctccctctggtcctgggaggaaagggctgtctgaggggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggcagtggaaattggaacatttgtgttacaaatcaggagagcttatcacagaaacaggttacatggatcagataatagaatatctttacccttgtttgattattacacctttggactgcttctgggaaggggcgaaattacagtctgggacagcatacctcctaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaacctcttgatatggcccttgttttgaatggt

SEQ ID NO: 163919 - DNA, 553 bp, Homo sapiens
  Payload ID: 12273
  Gene Symbol: PTCH1
  Gene Name: patched 1
  ENST ID: ENST00000548420
  CDS Start-End: 354-553
aagcgggcgtgggcgcgcgggccgcgactccccggcgctcactcctcccttctgcttcgtccccaggggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaacctcttgatatggcccttgttttgaatggtggatgtcatggcttatccagaaagtatatgcactggcaggaggagttgattgtgggtggcacagt

SEQ ID NO: 163920 - DNA, 1254 bp, Homo sapiens
  Payload ID: 12273
  Gene Symbol: PTCH1
  Gene Name: patched 1
  ENST ID: ENST00000468211
  CDS Start-End: 587-1138
cggccgcggggggcggggagagggtggctaggctcgcgggagctcgccgggcagggcgcctcccaggaaggcggggaggggagcgcctgtttacccaggagggctgtgctgatagcacgttcctcgagtttactttgctttccttgagtttattgtaaaggggtaaagttttcggatccgtcacgtgaccctgacaggtcctgcctatggcgcggcagaccacccacgccgagggccatggaactgcttaatagaaacaggcttgtaattgtgagtccgcgctgcactccgccgaaagcctccggcggcccagcgcgccggggtttttacactttccgttccttttgtaaagacggaggaggaggagaagaagaagaagaaaacggaggagaagaaaaagacgacaggggagacaaagagacccgcagcgacaaggcaagggggagacgagggaagactgggagaagacggaggagcggaggacgaggaaaggggggccagggaaaaaaaaggaattgatgtgaaatccaagcccagcgtccgcgccatcggcacccgcgctccgagcaggggttgacggccggctatggggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggcagtggaaattggaacatttgtgttacaaatcaggagagcttatcacagaaacaggttacatggatcagataatagaatatctttacccttgtttgattattacacctttggactgcttctgggaaggggcgaaattacagtctgggacagcatacctcctgtaagtgtgtgatcatgctttctgatgtctgtgacttctctaggactcagtgtttctaatgttgcttatcattgtttgttccatttcagttttgaacaagaaataaaaacattgaaattc

SEQ ID NO: 163921 - DNA, 630 bp, Homo sapiens
  Payload ID: 12273
  Gene Symbol: PTCH1
  Gene Name: patched 1
  ENST ID: ENST00000550914
  CDS Start-End: 253-492
gggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacagtgagaaatttttgtctctgcttttcattttattaggcagtggaaattggaacatttgtgttacaaatcaggagagcttatcacagaaacaggttacatggatcagataatagaatatctttacccttgtttgattattacacctttggactgcttctgggaaggggcgaaattacagtctgggacagcatacctcctaggtaaacctcctttgcggtggacaaacttcgaccctttggaattcctgg

SEQ ID NO: 163922 - DNA, 539 bp, Homo sapiens
  Payload ID: 12273
  Gene Symbol: PTCH1
  Gene Name: patched 1
  ENST ID: ENST00000551630
  CDS Start-End: 264-539
ttcgtccccaggggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggcagtggaaattggaacatttgtgttacaaatcaggagagcttatcacagaaacaggttacatggatcagataatagaatatctttacccttgtttgattattacacctttggactgcttctgggaaggggcgaaattacagtct

SEQ ID NO: 163923 - DNA, 4225 bp, Homo sapiens
  Payload ID: 12274
  Gene Symbol: PTCH2
  Gene Name: patched 2
  Uniprot ID: Q9Y6C5
  ENST ID: ENST00000372192
  CDS Start-End: 132-3743
cccacgcccgcgccttggcggccccactgaatccctacgcggggcccagcggtaccgggagaccgggctagcctatgggagcgcccagataacgcgggttgggggcgcccgcgccccccatccccgccagcatgactcgatcgccgcccctcagagagctgcccccgagttacacacccccagctcgaaccgcagcaccccagatcctagctgggagcctgaaggctccactctggcttcgtgcttacttccagggcctgctcttctctctgggatgcgggatccagagacattgtggcaaagtgctctttctgggactgttggcctttggggccctggcattaggtctccgcatggccattattgagacaaacttggaacagctctgggtagaagtgggcagccgggtgagccaggagctgcattacaccaaggagaagctgggggaggaggctgcatacacctctcagatgctgatacagaccgcacgccaggagggagagaacatcctcacacccgaagcacttggcctccacctccaggcagccctcactgccagtaaagtccaagtatcactctatgggaagtcctgggatttgaacaaaatctgctacaagtcaggagttccccttattgaaaatggaatgattgagcggatgattgagaagctgtttccgtgcgtgatcctcacccccctcgactgcttctgggagggagccaaactccaagggggctccgcctacctgcccggccgcccggatatccagtggaccaacctggatccagagcagctgctggaggagctgggtccctttgcctcccttgagggcttccgggagctgctagacaaggcacaggtgggccaggcctacgtggggcggccctgtctgcaccctgatgacctccactgcccacctagtgcccccaaccatcacagcaggcaggctcccaatgtggctcacgagctgagtgggggctgccatggcttctcccacaaattcatgcactggcaggaggaattgctgctgggaggcatggccagagacccccaaggagagctgctgagggcagaggccctgcagagcaccttcttgctgatgagtccccgccagctgtacgagcatttccggggtgactatcagacacatgacattggctggagtgaggagcaggccagcacagtgctacaagcctggcagcggcgctttgtgcagctggcccaggaggccctgcctgagaacgcttcccagcagatccatgccttctcctccaccaccctggatgacatcctgcatgcgttctctgaagtcagtgctgcccgtgtggtgggaggctatctgctcatgctggcctatgcctgtgtgaccatgctgcggtgggactgcgcccagtcccagggttccgtgggccttgccggggtactgctggtggccctggcggtggcctcaggccttgggctctgtgccctgctcggcatcaccttcaatgctgccactacccaggtgctgcccttcttggctctgggaatcggcgtggatgacgtattcctgctggcgcatgccttcacagaggctctgcctggcacccctctccaggagcgcatgggcgagtgtctgcagcgcacgggcaccagtgtcgtactcacatccatcaacaacatggccgccttcctcatggctgccctcgttcccatccctgcgctgcgagccttctccctacaggcggccatagtggttggctgcacctttgtagccgtgatgcttgtcttcccagccatcctcagcctggacctacggcggcgccactgccagcgccttgatgtgctctgctgcttctccagtccctgctctgctcaggtgattcagatcctgccccaggagctgggggacgggacagtaccagtgggcattgcccacctcactgccacagttcaagcctttacccactgtgaagccagcagccagcatgtggtcaccatcctgcctccccaagcccacctggtgcccccaccttctgacccactgggctctgagctcttcagccctggagggtccacacgggaccttctaggccaggaggaggagacaaggcagaaggcagcctgcaagtccctgccctgtgcccgctggaatcttgcccatttcgcccgctatcagtttgccccgttgctgctccagtcacatgctaaggccatcgtgctggtgctctttggtgctcttctgggcctgagcctctacggagccaccttggtgcaagacggcctggccctgacggatgtggtgcctcggggcaccaaggagcatgccttcctgagcgcccagctcaggtacttctccctgtacgaggtggccctggtgacccagggtggctttgactacgcccactcccaacgcgccctctttgatctgcaccagcgcttcagttccctcaaggcggtgctgcccccaccggccacccaggcaccccgcacctggctgcactattaccgcaactggctacagggaatccaggctgcctttgaccaggactgggcttctgggcgcatcacccgccactcgtaccgcaatggctctgaggatggggccctggcctacaagctgctcatccagactggagacgcccaggagcctctggatttcagccagctgaccacaaggaagctggtggacagagagggactgattccacccgagctcttctacatggggctgaccgtgtgggtgagcagtgaccccctgggtctggcagcctcacaggccaacttctaccccccacctcctgaatggctgcacgacaaatacgacaccacgggggagaaccttcgcatcccgccagctcagcccttggagtttgcccagttccccttcctgctgcgtggcctccagaagactgcagactttgtggaggccatcgagggggcccgggcagcatgcgcagaggccggccaggctggggtgcacgcctaccccagcggctcccccttcctcttctgggaacagtatctgggcctgcggcgctgcttcctgctggccgtctgcatcctgctggtgtgcactttcctcgtctgtgctctgctgctcctcaacccctggacggctggcctcatagtgctggtcctggcgatgatgacagtggaactctttggtatcatgggtttcctgggcatcaagctgagtgccatccccgtggtgatccttgtggcctctgtaggcattggcgttgagttcacagtccacgtggctctgggcttcctgaccacccagggcagccggaacctgcgggccgcccatgcccttgagcacacatttgcccccgtgaccgatggggccatctccacattgctgggtctgctcatgcttgctggttcccactttgacttcattgtaaggtacttctttgcggcgctgacagtgctcacgctcctgggcctcctccatggactcgtgctgctgcctgtgctgctgtccatcctgggcccgccgccagaggtgatacagatgtacaaggaaagcccagagatcctgagtccaccagctccacagggaggcgggcttaggtggggggcatcctcctccctgccccagagctttgccagagtgactacctccatgaccgtggccatccacccaccccccctgcctggtgcctacatccatccagcccctgatgagcccccttggtcccctgctgccactagctctggcaacctcagttccaggggaccaggtccagccactgggtgaaagagcagctgaagcacagagaccatgtgtggggcgtgtggggtcactgggaagcactgggtctggtgttagacgcaggatggacccctggagggccctgctgctgctgcatcccctctcccgacccagctgtcatgggcctccctgatatccatacagaacagccaccgatttgcacatccaggcctgtgtgagcctgtatctgtgtcacttgagagtgaaagctggcacttggggctgcagtgcagccctgtcccccttcccaccccacaccactgcctgcccagctgaccaagcctgagggaccctccagcacccttccgtctggtgactcctgggcaggctctccatatccctgcccacctcctaccacatccattatttatatgaaaatgtctatttttgtagtatacatacatgttagctatgatgaaagttttattttttaaagaatgaaatatattctatgtgaactaatctca

SEQ ID NO: 163924 - DNA, 4298 bp, Homo sapiens
  Payload ID: 12274
  Gene Symbol: PTCH2
  Gene Name: patched 2
  Uniprot ID: Q9Y6C5
  ENST ID: ENST00000447098
  CDS Start-End: 13-3453
atccccgccagcatgactcgatcgccgcccctcagagagctgcccccgagttacacacccccagctcgaaccgcagcaccccagatcctagctgggagcctgaaggctccactctggcttcgtgcttacttccagggcctgctcttctctctgggatgcgggatccagagacattgtggcaaagtgctctttctgggactgttggcctttggggccctggcattaggtctccgcatggccattattgagacaaacttggaacagctctgggtagaagtgggcagccgggtgagccaggagctgcattacaccaaggagaagctgggggaggaggctgcatacacctctcagatgctgatacagaccgcacgccaggagggagagaacatcctcacacccgaagcacttggcctccacctccaggcagccctcactgccagtaaagtccaagtatcactctatgggaagtcctgggatttgaacaaaatctgctacaagtcaggagttccccttattgaaaatggaatgattgagcggatgattgagaagctgtttccgtgcgtgatcctcacccccctcgactgcttctgggagggagccaaactccaagggggctccgcctacctgcccggccgcccggatatccagtggaccaacctggatccagagcagctgctggaggagctgggtccctttgcctcccttgagggcttccgggagctgctagacaaggcacaggtgggccaggcctacgtggggcggccctgtctgcaccctgatgacctccactgcccacctagtgcccccaaccatcacagcaggcaggctcccaatgtggctcacgagctgagtgggggctgccatggcttctcccacaaattcatgcactggcaggaggaattgctgctgggaggcatggccagagacccccaaggagagctgctgagggcagaggccctgcagagcaccttcttgctgatgagtccccgccagctgtacgagcatttccggggtgactatcagacacatgacattggctggagtgaggagcaggccagcacagtgctacaagcctggcagcggcgctttgtgcagctggcccaggaggccctgcctgagaacgcttcccagcagatccatgccttctcctccaccaccctggatgacatcctgcatgcgttctctgaagtcagtgctgcccgtgtggtgggaggctatctgctcatgctggcctatgcctgtgtgaccatgctgcggtgggactgcgcccagtcccagggttccgtgggccttgccggggtactgctggtggccctggcggtggcctcaggccttgggctctgtgccctgctcggcatcaccttcaatgctgccactacccaggtgctgcccttcttggctctgggaatcggcgtggatgacgtattcctgctggcgcatgccttcacagaggctctgcctggcacccctctccaggagcgcatgggcgagtgtctgcagcgcacgggcaccagtgtcgtactcacatccatcaacaacatggccgccttcctcatggctgccctcgttcccatccctgcgctgcgagccttctccctacaggcggccatagtggttggctgcacctttgtagccgtgatgcttgtcttcccagccatcctcagcctggacctacggcggcgccactgccagcgccttgatgtgctctgctgcttctccagtccctgctctgctcaggtgattcagatcctgccccaggagctgggggacgggacagtaccagtgggcattgcccacctcactgccacagttcaagcctttacccactgtgaagccagcagccagcatgtggtcaccatcctgcctccccaagcccacctggtgcccccaccttctgacccactgggctctgagctcttcagccctggagggtccacacgggaccttctaggccaggaggaggagacaaggcagaaggcagcctgcaagtccctgccctgtgcccgctggaatcttgcccatttcgcccgctatcagtttgccccgttgctgctccagtcacatgctaaggccatcgtgctggtgctctttggtgctcttctgggcctgagcctctacggagccaccttggtgcaagacggcctggccctgacggatgtggtgcctcggggcaccaaggagcatgccttcctgagcgcccagctcaggtacttctccctgtacgaggtggccctggtgacccagggtggctttgactacgcccactcccaacgcgccctctttgatctgcaccagcgcttcagttccctcaaggcggtgctgcccccaccggccacccaggcaccccgcacctggctgcactattaccgcaactggctacagggaatccaggctgcctttgaccaggactgggcttctgggcgcatcacccgccactcgtaccgcaatggctctgaggatggggccctggcctacaagctgctcatccagactggagacgcccaggagcctctggatttcagccagctgaccacaaggaagctggtggacagagagggactgattccacccgagctcttctacatggggctgaccgtgtgggtgagcagtgaccccctgggtctggcagcctcacaggccaacttctaccccccacctcctgaatggctgcacgacaaatacgacaccacgggggagaaccttcgcatcccgccagctcagcccttggagtttgcccagttccccttcctgctgcgtggcctccagaagactgcagactttgtggaggccatcgagggggcccgggcagcatgcgcagaggccggccaggctggggtgcacgcctaccccagcggctcccccttcctcttctgggaacagtatctgggcctgcggcgctgcttcctgctggccgtctgcatcctgctggtgtgcactttcctcgtctgtgctctgctgctcctcaacccctggacggctggcctcatagtgctggtcctggcgatgatgacagtggaactctttggtatcatgggtttcctgggcatcaagctgagtgccatccccgtggtgatccttgtggcctctgtaggcattggcgttgagttcacagtccacgtggctctgggcttcctgaccacccagggcagccggaacctgcgggccgcccatgcccttgagcacacatttgcccccgtgaccgatggggccatctccacattgctgggtctgctcatgcttgctggttcccactttgacttcattgtaaggtacttctttgcggcgctgacagtgctcacgctcctgggcctcctccatggactcgtgctgctgcctgtgctgctgtccatcctgggcccgccgccagaggtgatacagatgtacaaggaaagcccagagatcctgagtccaccagctccacagggaggcgggcttaggcccgaggagatctagcctctgcctcccaccccagcaccccctcatcagacacacggagcgccactgtctggacaggctgaattggtcttcgggtccctaatttctcatacgccattccctctgcctagaacactttctcacctccccttgatgtgaccccatatcacccttcgaggtgaattggatcggatgccatctcctccaggaggggtggggtcgtgcctcctgtgaggtcccagtgcccctgagtgtctgtgcccgtctgtttccccgtccctctctctaagcccggaggcttactgcgggtaaggacggcgggacaggaccttaacccctgggacgaacaccagctccgcaaaggactccgcacccggcgccgcccacggggtgcgggtcccaggaggaccagcagagaggagcataggagagcaaaggagatcagtgacccatggcttccccggtggcgcggaacagcccggagccgcctgtgatttgcatacccatggtgcaccacgaaaagataccctcaagatgcttgcactccctctgtgcgcgcatttctgcactgttttagagcatgatgcctcttacacgcatctgtgtgcataaactacatatagggagtgcgtaccacgcaggcatccaacaaccataagtgtgttaagtgttagttctccctgcgaggttcgaagcggaagtcacgaatatactcgggtttctcttcaaagcgcataaatctttcgccttttactaaagatttccgtggagagaaagttgtgagtttttattcaattttttgaggcctcttatttcctgaggctacatttttaagtattaaaagttaggcaactacaaccaag

SEQ ID NO: 163925 - DNA, 1110 bp, Homo sapiens
  Payload ID: 12274
  Gene Symbol: PTCH2
  Gene Name: patched 2
  ENST ID: ENST00000438067
  CDS Start-End: 1-265
ctttgacttcattgtaaggtacttctttgcggcgctgacagtgctcacgctcctgggcctcctccatggactcgtgctgctgcctgtgctgctgtccatcctgggcccgccgccagaggtgatacagatgtacaaggaaagcccagagatcctgagtccaccagctccacagggaggcgggcttagagtggggagtttgcaagtgaacattagctattggaaggagcttctctggtgccaggacctgaggcccgaggagatctagcctctgcctcccaccccagcaccccctcatcagacacacggagcgccactgtctggacaggctgaattggtcttcgggtccctaatttctcatacgccattccctctgcctagaacactttctcacctccccttgatgtgaccccatatcacccttcgaggtgaattggatcggatgccatctcctccaggaggggtggggtcgtgcctcctgtgaggtcccagtgcccctgagtgtctgtgcccgtctgtttccccgtccctctctctaagcccggaggcttactgcgggtaaggacggcgggacaggaccttaacccctgggacgaacaccagctccgcaaaggactccgcacccggcgccgcccacggggtgcgggtcccaggaggaccagcagagaggagcataggagagcaaaggagatcagtgacccatggcttccccggtggcgcggaacagcccggagccgcctgtgatttgcatacccatggtgcaccacgaaaagataccctcaagatgcttgcactccctctgtgcgcgcatttctgcactgttttagagcatgatgcctcttacacgcatctgtgtgcataaactacatatagggagtgcgtaccacgcaggcatccaacaaccataagtgtgttaagtgttagttctccctgcgaggttcgaagcggaagtcacgaatatactcgggtttctcttcaaagcgcataaatctttcgccttttactaaagatttccgtggagagaaagttgtgagtttttattcaattttttgaggcctcttatttcctgaggctacatttttaagtattaaaagttaggcaactacaaccaag

SEQ ID NO: 163926 - DNA, 13714 bp, Homo sapiens
  Payload ID: 12275
  Gene Symbol: PTCHD1
  Gene Name: patched domain containing 1
  Uniprot ID: Q96NR3
  ENST ID: ENST00000379361
  CDS Start-End: 861-3527
tttggaaggaggcgtgatttccacgttcgagcgtcttcgctccccaccccctctcggcaccagccagtgcgcgccaccacctgagcctggcgagagccgggacgcacgcagtcttcagcctgctcctttaagcctctggagagactcggctctgagcgggtccgcccgacacccgccccctccccccactcctgagaactctttactttttgtttggaaaatcggggccatttctttatttatctctgggtcttcccggaggagggcagagaaggggagagcgagcttggcgggccggaccgggggaggggagcgaagggaggggaggggactgggtgtagcctggaattctccgtcctcgtgttcctgggcgggcgcgcagagtctcctggcgatagcgccgtcgccgctccccgcgccaccccgtcgttggccttgggggtcgggtgagtggggtcatgacgagccgcgggggctgccccgggccccgcccgcgctgagaggggacgcggccgcgcggcgcggagcccccctggcggggaggccgcggggggtggggagggcgcacgcggtagggcggagtgggggcggcgcagaggccgccaagctggggggctctccgggagggcgcggccgcgggcaggagggcgtgtctccggctcgaggggaccctcccgaggcgcggcgcgggactccccgatggtggtgccgcggctccgggagagctcagggtctcgccgccgccgccgtcgccgccgccgcgggcgccgctgccgccgccgccgccgccgccgccgccgccgcccgaacccgcgccgagcgtgcgcctcgccctcctcccgcgcccgctctgctctaggatgctgcggcaggttctgcacaggggcttgaggacgtgtttctcccggctcggccacttcattgccagtcaccctgtcttcttcgcctcggcgccggtgctcatctccatcctgctcggcgccagcttcagccgctaccaggtcgaggagagcgtggagcacctgctggcgccccagcacagcctggccaagatcgagcgcaacctcgttaacagcctcttcccggtcaaccgctccaagcaccgtctctactcggacctgcagacccccgggcgctacggccgggtcatcgtcacctccttccagaaagccaacatgctggaccagcatcacaccgacctgatcttaaagttgcatgctgctgtcaccaagatccaggttccaaggcctggttttaattacacgtttgcccatatatgtatcctgaataatgataagacttgcatcgtggatgacatagtgcacgtcctggaagagctaaagaatgctcgggccaccaatcggaccaattttgctatcacatacccaatcactcacttaaaggacgggagggctgtgtacaatgggcaccagcttgggggcgtcactgtgcacagcaaagaccgggtgaaatctgcagaggccatccagctcacctactacctgcagtcaatcaacagtctcaatgacatggtggctgagaggtgggagtccagcttctgcgacactgtcagactgtttcagaaatccaacagcaaagtcaaaatgtacccttacacgtcctcctcactgagggaagatttccagaagaccagccgcgtatcagaacgttacctggtcaccagcctgattctggtggttaccatggccatcctgtgttgctctatgcaggactgcgtccgcagcaaaccctggctaggcctgctcggattggtgaccataagcctggccactctcactgcagccgggatcatcaatcttactggtgggaaatataattccaccttcctgggagtccctttcgtcatgctaggtcatggattatatgggacttttgaaatgttatcctcctggaggaaaactagagaagaccaacatgttaaagagagaactgcagcagtctatgcagactccatgctctccttttctctcaccactgccatgtacctggtcacctttggcataggggccagccctttcacgaacattgaggcagccaggattttctgctgcaattcctgtattgcaatcttcttcaactacctctatgtactctcgttttatggttccagcctagtgttcactggctacatagaaaacaattaccagcatagtatcttctgtagaaaagtcccaaagcctgaggcattgcaggagaagccggcatggtacaggtttctcctgacggccagattcagtgaggacacagctgaaggcgaggaagcgaacacttacgagagtcacctattggtatgtttcctcaaacgctattactgtgactggataaccaacacctatgtcaagccttttgtagttctcttttaccttatttatatttcctttgccttaatgggctatctgcaggtcagtgaagggtcagaccttagtaacattgtagcaaccgcgacacaaaccattgagtacactactgcccagcaaaagtacttcagcaactacagtcctgtgattgggttttacatatatgagtctatagaatactggaacactagtgtccaagaagatgttctagaatacaccaaggggtttgtgcggatatcctggtttgagagctatttaaattaccttcggaaactcaatgtatccactggcttgcctaagaaaaatttcacagacatgttgaggaattcctttctgaaagcccctcaattttcacattttcaagaggacatcatcttctctaaaaaatacaatgatgaggtcgatgtagtggcctccagaatgtttttggtggccaagaccatggaaacaaacagagaagaactctatgatctcttggaaaccctgaggagactttctgtcacctccaaggtgaagttcatcgtcttcaatccgtcctttgtatacatggatcgatatgcctcctctctgggagcccccctgcacaactcctgcatcagtgctttgttcctgctcttcttctcggcattcctggtggcagattcactgattaacgtctggatcactctcacagttgtgtccgtggagtttggagtgataggtttcatgacattatggaaagtagaactggactgcatttctgtgctatgcttaatttatggaattaattacacaattgacaattgtgctccaatgttatccacatttgttctgggcaaggatttcacaagaactaaatgggtaaaaaatgccctggaagtgcatggggtagctattttacagagttacctctgctatattgttggtctgattcctcttgcagctgtgccttcaaatctgacctgtacactgttcaggtgcttgtttttaatagcatttgtcaccttctttcactgctttgccattttacctgtgatactgactttcctgccaccctctaagaaaaaaaggaaagagaagaaaaatcctgagaaccgggaggaaattgagtgtgtagaaatggtagatatcgatagtacccgtgtggttgaccaaattacaacagtgtgataatgtctgcttggcatattttcaccttaggtcttatcaagaccaaagagattatgttaatgaaacaattaaattcaaagttcttcccttttttaaagataggaaacaggcattgccaaaaaaaaaaaaaaaaaaaaaaggaaaggacagtggggagaaatgggcctggcatattttcagtctttaaaacaaaggagttgttatgagaattcacacacacatagacacacacacacacacacacacacacacacacacacacacaccctgggagacctatagtctcttaaactaagatcaagtagaagaaagcttattaacaagcaggatcctgccttatccaaactgcagatgttgctggcattgtgacaaaacccactgattgaaaggtcaactgccaaggcagaaacacctttaagcattgttcaaacaataaggcttccagaacttctgtagagcagtagctccagtcatggtctgtggtttgaggttttagctgtctcacctagctccctaacactgaaggagatacttgtgaaagttctgaccagcaaaagcaagccagagccttggaaactgatatgtggtagagtggccatcactcatggactaaaattgattcaccgctaaatttacccaggtgaagcagtttcgttgtctagaatgaaattatcatattccgccattggtatgcctttaacatttgtatagtttggtttgcttaaaacaccttaaaaccaatgacagctccagcactgcagaattggtgtgattctactttggaatagcttgtcacttgtcaccaaatgggtctgctttattagttacagctcttggcaggaggatccagggacccaaaaccacagggccaaacccaaatacctggcatgatggagcaaaagcaggtgtctacttggacccagatatagtgtctccattttaacaacaacaacaaaatagccagctggtacagctgtttgcattggccctacatgcattttttgcatggatatccagaaacatctgcccacacaaaactgcggggaaaaaaaatgaacactgaaatagttatttgctgttgcttccaacttgtagtgccagtctgcctttgctgtgaaacacacctgctcagagacagagaggggaagaagatctttggtaagtctaagtcctgacgctgagaagctttgtaaaagtgcagggagataaagggccaaaagggagatagatggaaaacactggaaaaagtattcactgatacaaatctatcaatgatggcagtccaattctcttgctaaagtggctgcacctcaccttgctggtcccccccacaccttttttgatgtccttctgcgtcatcatagcaaggcccttctgtaaattaacaagcctagatatttatactcttgacttccagtatctacagaagaatggttcatagatctaaacagaaatggtttagatctaaaaaggctgtatacgttgcccaggcccctgcatttctttaaatttataaaaatgaagctaaaacctggttacatttgaagcaaatatctacagtatttttcccttttagagatgtagcttccttagacatctgtagtggtaagcatttcccaaaagcatcttacctttctgaaccttagcagacatactgtgcagcttacctatcttctgcagaggaggaaactgagacctaggagaataaagtgactcactcaggtcacaccactaaagggttttcatcatttcagcatacctaagacagggcagtccaattttcagtattctcataagatggctattactcctctcaaaatgcatttccaaagtaggaacataggacttcgttggccacagggcagacatttttttagtgtctggaattaaaatgtttgaggtttaggtttgccattgtctttccaaaaggccaaataattcagatgtaaccacaccaagtgcaaacctgtgctttctatttcacgtactgttgtccatacagttctaaatacatgtgcaggggattgtagctaatgcattacacagtcgttcagtcttctctgcagacacactaagtgatcataccaacgtgttatacactcaactagaagataataagctttaatctgagggcaagtacagtcctgacaaaagggcaagtttgcataatagatcttcgatcaattctctctccaaggggcccgcaactaggctattattcataaaacacaactgaagaggggattggttttactgttaaatcatgtgttgctaaatcattttctgaacagtgtgttctaaatcagtcattgatttagtgtcagccacgtggagcacctcggcttaaagcagctccacaaaacctgacacaacacacacaccaattaaatggattttgttgagaatttaatcattcaatttggtcaaccagaatgacttcctgtggaactctgttttatgacagataatagttttccaacttgattgagtctctgtataccctgggatattgtattttttaatgaagggcattttcaaacttgtcaacttctcttttcagcacttgaaatgaaggcttatggaattctgactgtgaaatgaatttttctattgggagattatgcatgccaagatttattatttattgttagataattattatttatttgttaatactgattattgattattgctctgctgcattggtttagccccgctatggagaagacactttagaagtaactcagaatcacatccccataaaatctaagtctttacttcatcaagttttactttttgaattgctataaagacggaaaaattgatccctgcaaacacttgaagaagctgtgttttttttctttcaattaattccaaccaagacattaacgtccactttaccaaagaaacttacttggttggtttttagttggtgtttgttgtttgtttaccaaagaaaatattcgattcatcaaaaatattgctcctggtcaactaaaaaactgtgatactgggacttttttggccattcataaggaaaatttttaaaagtcaaggtaagggtgatattctctcatttagtggaagaagaagatgtcaattcacagggaatgtggtgttcgcaagaaagaaaatgatacttgaaatagggcattattgtttagcctacagcaacatttcaacaagcagcatcagggctcctcaggttaaaagaagtacagtttgtttcagagaaaaaggaagacaaaccctcgtgaaatgtttctccattgttccagctcataagttttactttgttttgggttttggagtttttagtttctttgatgtttgttttgctttaatttggtttgtggtttgtgtttgcttgtgtttgcttctgcctttcctaccttctgccttttactccctcagttttcagtcagaagtgtgataatcagatgccatcctccatggccacgcttatgtatgcaatataccgctccaaatgaggaccttggtaacccttgaccctttaattctaactaaccatcacccaatcgtaagtggcattatgggaccatgataccacttttctccagtgtcaatgacagagctcagctgtgtccatcacaagaaaaggtggaatgggcagctgtcttgggggtgtggcaagaggcagaacctcttggacacaaatgttatcttcctcataatggctttattcttttggatcctattaaagtacccctgtagcttatagtagtgtttgacctctgtgactctgttttctcatctgtaaaatggggataatatcagtaaatgtctttaaattcagcaaatacttatcgagtgccaaatatcgcccagatactgttcgagaggctggggacacaacagtcaacaaatcagattttttaaaatctgctcttgtagagtctacctttgagtgacattgcaggtatattgtggggattgaatgagatgagagatgacatttggaaagcactcttggaaaggcctggcaaagaaaagagactcaagacattatttgtaattcagcaatctcgcacagtagcattagggctcgggatgtaaagctactgagaagtagatttgagcctgagaattagggctacaaatacaatgagttgccacagaaggtagttaattaccagtcattttaggacatcaaaatgaagctgatcaccacatagtggggccactgtaaaggggctgcaagtcctggatgttggcatcatactatgatctttgaaaaaaacagatacaggcacttgcttttggggatggggaagggacaccactgattactgaataactgtggctggcttgtctgagggaatgtaaacattcccttgaggtaatttgcttttaattttgtgtaaaaagcaccaggtatttagagacataaagttcccgttttttaaaagaatagtaaatctgcaatacaaagaaaaatattaagttagtggattcgctggcaaagaactaagaatggctgcagccaacacactgcagagttcctccctgtggtggttacaactgttatttctgtttcatgccagtccaggagaaagcaaagaggaaagtggatgagctataatccgttcacctgaataggcagtgccaggatgtcccccccagcttgcctctcacccgccccgctgctgcccagctgatttgtttgaagtcctctttgatatctatgagagcaccgtggaaggaagaagaagggaggcgaccggagagctatggcctctgtgcagatttttgagttagattaaaattagtaccacctgattaggagcctacctggtgaggaaaaaagccttcttttcaaagtacaaaaaaaagcgatgtgtaccaaggagaaaaccagcagagaaagcttggtggaagaagtgatgttcttgtggaatgtgccagcagcttctccttccagaatgctgacaccagatgaatctttggttagaattaagcctacccctttgtttttcacatgagaaaactgaaccctcgagtaatgaaattatattcacagagctaattagaaacaggagactataattgaaatctagtttttagcctcaattctttctccattttgccactttactgccaaattctattcatctaaattattggggtcttaacctgggggccaaatgagttcatgggaggggtctctgagtttcctacaattaagttacatgcaaaaatgtgtgtatatgttcaacatgtgcattttcctaaactgagggctcagattccaaaagaggtctatgaccgaaaaagggtgaagaaccactgtcctaaattaatacagacctcattgggagtgtgatcctggtgtcctcattttggctaatgagcaatcaagaacttttgaactatcttttctctaaggatccaaaaatgcttcaaaatattggtttcttcatcccaagccaagtgcctacttctattcatttattcttcattcattctttcattcattcatttctttattctgcaaatgtattttcagtgccaattcatgttctagcagcagctaaatatgccctccacagcaggaccaggaaaggagccctctgtactgtgctcttgttggcaagaggaacaccaggttgctaccacattctcactgttgcaacaaattatatatagcctcaaattttcagtaaccatcccacacacacatacacacataaaggcagcagccaacaaagccaacatatagaagtgtgccctgtcaaagaaccaggaagagcagcctatttccaggttatatacagtgatatgctgtttacaactgcataccacatccttagaaggcctgctcccaaatgagccctactctgagatgtctacaccaggcatgctttcacacacgtgcagtaccctactctcaaaacaagtatggagagaataagtctcattcatctcgttaatatttttagtgggcaaagaagcaaccgtggccatggacagatgggtgcatttaaggacaggtgtggccgggcacagtggctcaagcctgtaatcccagcactttgggaggcggaggcgggcagatcacgaggttaagagattgagaccatcctggccagcatggtgaaaccccgcctctactaaaaaatacaaaaaaattagctgggcgtggtggcacgtgcctgtagtcccagctactcaggaggcaggagaatcccttgaacccgggaggtagaagttgcagtgagccgagatttcaccactgccctccagactggcaacagagtgagacttcgtctcaaaaaaataaaggacaagtgtgttttatacacaaatatgcagaagcccagttctcttgactccaagtcagaagctagataaaatagaggttgctgggggaagttggaaaataaatgactatactgtacttgttggctctgctgctgctgatataacttcaggcacaacggaagccgcctcggttggcctatgggaagggctgggtgaatcactgcttggccttgcatgaagcacaaaggacacaccaatggctgatcagtggcccttccatcatcttctgcccagccatgataaggaaagccttctattgagatggaggaatattagctcaactttgtagcatctgatgtaaagtttgaggggtttgtcttttttgtttgtttgtttgtttttttttgagatggagtctcactctgtcacccaggctggagtgcagtggcgccatctcagctcactgcaagctccacctcccaggttcacgacattctcctgcctcagcctcctgagtagctgggactacaggtgcccgccaccgcgcccggctaattgtgtgtgtgtgtgtgtgtgtgtgtgtgtgtgtgtttagtagagatggggtttcaccgtgttacccatgatagtctcgatctcctaacctcgtgatccacccgcctcggcctcccaaagtgctgggattacaggcgtgagccaccgtgcccggcaagggctttgttcattaggatcaacaaagtgctttgtctaattcctgcaaaatggcaaagacccagcccatttccattactcattccaggctcatgctcaggaaaactaataacgttctctttgacaaaacaatttccttaattttctaggatgaatcttgaacatgtttagctcagcctttcagatatttattctttaaattaccatcctgtcaaaattgcctttacgcactgatccagaatcaccaaggcagttgccacgatgcctcccaggactgtgggtgactgggcaaactggtaatgacccgttggctctgcttcacacacacacatacacattgacacacataaatgtacacatgcatatatgtgtgtacaacacaactataaaacatagaaacatatacctgtacatatgcacatgcttacatacacacatatcacagatgtgcatgcacacatacacatgcacaccaccttttacaatatgcctgacacatttgaggcacattaaaatgccttggcaggcccagccctatagttctgtaaggtttggcaggccaaaggcttcggatgtctgcaggataccattgaaaaaatgttatcttccccttctatatgtttcttatgcacgagcacagctaagagcagccaaatagtaagctttaaagaaaagaaacctggaaaagtgaatgtgccttgcaatttaaaaattgctaacagtttcacagtgggaaaattgcatttgttggaattttccaagtcataagcaagaagaatagcatagacccaaaacgacagagatctcttccaaggtatggaattgtggaaatttatttagaatatttgcttggtgatccagagaagggggaaagaagtggtgaggaagaatatatggggtgatccctccaaattgccaactcctcgtcttaggaagaagtgggcagtttccattgatccctagcatcagtttgacgggaaaaccggtgcatttcatcaacctcaaggaaaggaagtgccatgcatggaggcctggtgataggcaacatccatttagaagaacagtcacacaagcaacagaagaactatccaagactagaagcttagaagcttataccaaactctctgtctctctctctctctctcacacacacacacacagagtggatgggaggggacattaagaggaaccctagtgcagttcccccaaaaaaccttggcatagagtataacagggaaaaagtaattactgggaagctgaaaacaatcaaatatgtgaggaatgactgaatatgagctgaggataatgtaaattgttctggattgtctataagataaagatacagagcctgaatctatgtttttctgaataaagagaccccatattctcttttgaattattgacctataattcctcttcagcagctttgaatacactcaagttctcttcctattgtttatgatcccataatacaaccacccactatttgttgtggtttacaatccagcttagaacccttgagcaaaattattgaattattgaatgctaggcccaaacaaaagaaatttcagcttggttttagtaatttcttgatcaaacttctctcattcctctaaatgtacaaaggtttcaaagttgtaaaaaatatgtctacatagccaatgctcttagtatttttaacagcaaagataatctctgccaataattattaatgacaaaatagtgataactgttcaatgttgctttaacagtccaattgtagtaggtgagaaaacaaaaaagaagagaagctatgttgaatatttagtaatgttggaaaagatcctcaccctagacataaaatagtttaaacatttaaacatggcccctctcttattgtcattgctagtgaaagaagttcctgaaattgcatattacattgtaaagttttgggctaaatcacaatacatttttaagttgcttccatggcaatagatcgtaagaccacagcttgtcaaagtaaccactaattcagtattcagaaaccttatcatctgttcctccaaaaagaccccatagttaatgttgtgtttcccagtattttagttgggtttcttcacacttaggcaagtgggtgattctggtcataataaactattttcaaactaggaaaaagtatccaaatgctagagcacataatgagttcagcttggtcagttttgagacagataagcataaaaccctactagaaaaaaataatagtcaaacctaaagctttaaaaaatgtgagtcacatcacttttctccaggaaaggcagaacgtgctcagggtggaatttaatcaaaaatgtacccagaacaatttcccacaaagagctgtaatactttgcagcaaggggcattaataaactctaatttttaccgaaagtcaagagacacacagatcttttttggtaccctctacatcatcatagcaaggcccttctgaacattaacaagcctagatgtttctactgcttatttgcagtatctacaggggaatggttcgtggatataaacagaaatgttttatctgaagaggctgtgtatgccaccccagacccctgcatttcttaatatctataaaaatatgactaaacttgttacatttgaggcaaatatgtacagtatttttcccttttaaagatagtttaaaaaatcaaggtaataaaaaacggccaactctttcaggaaaaaaaaaatccggtattttgtactacttgagtttctctaatgcctaaaatatgcatttaaatcatcccacacctacacagaaacaaaatcagcagggaaaaccatcccactgatgattggcaattccaccgttcctctccatctgaccagctttcaccagagggcgatctttcatgcttgcacatcgagtttatacaatgtagaagcccccaagtcacctgggaaatggctcatgccaaatacatggagtccttagttgactatcttttcatattaaaatcccatcttccaatgaagcatcctgttttcaatactgatatcaaatttcgaatgtaaaggagatttcaaatgtattgctttcaccttttcttttttattcatttatttttaattgacataaaaattgtatatatttatgggatacaatgtgatgttttgatatatgtatgcattgtggaatgattaaatcaagctaattaaca

SEQ ID NO: 163927 - DNA, 736 bp, Homo sapiens
  Payload ID: 12275
  Gene Symbol: PTCHD1
  Gene Name: patched domain containing 1
  ENST ID: ENST00000456522
  CDS Start-End: 1-311
tcgagcgcaacctcgttaacagcctcttcccggtcaaccgctccaagcaccgtctctactcggacctgcagacccccgggcgctacggccgggtcatcgtcacctccttccagaaagccaacatgctggaccagcatcacaccgacctgatcttaaaggtcatggattatatgggacttttgaaatgttatcctcctggaggaaaactagagaagaccaacatgttaaagagagaactgcagcagtctatgcagactccatgctctccttttctctcaccactgccatgtacctggtcacctttggcataggggccagccctttcacgaacattgaggcagccaggattttctgctgcaattcctgtattgcaatcttcttcaactacctctatgtactctcgttttatggttccagcctagtgttcactggctacatagaaaacaattaccagcatagtatcttctgtagaaaagtcccaaagcctgaggcattgcaggagaagccggcatggtacaggtttctcctgacggccagattcagtgaggacacagctgaaggcgaggaagcgaacacttacgagagtcacctattggtatgtttcctcaaacgctattactgtgactggataaccaacacctatgtcaagccttttgtagttctcttttaccttatttatatttcctttgccttaatgggctatctgcaggtcagtgaagggtcagaccttagtaac

SEQ ID NO: 163928 - DNA, 2286 bp, Homo sapiens
  Payload ID: 12275
  Gene Symbol: PTCHD1
  Gene Name: patched domain containing 1
  Uniprot ID: Q96NR3
  ENST ID: ENST00000616022
  CDS Start-End: 410-1180
atttggaaggaggcgtgatttccacgttcgagcgtcttcgctccccaccccctctcggcaccagccagtgcgcgccaccacctgagcctggcgagagccgggacgcacgcagtcttcagcctgctcctttaagcctctggagagactcggctctgagcgggtccgcccgacacccgccccctccccccactcctgagaactctttactttttgtttggaaaatcggggccatttctttatttatctctgggtcttcccggaggagggcagagaaggggagagcgagatcgagcgcaacctcgttaacagcctcttcccggtcaaccgctccaagcaccgtctctactcggacctgcagacccccgggcgctacggccgggtcatcgtcacctccttccagaaagccaacatgctggaccagcatcacaccgacctgatcttaaagttgcatgctgctgtcaccaagatccaggttccaaggcctggttttaattacacgtttgcccatatatgtatcctgaataatgataagacttgcatcgtggatgacatagtgcacgtcctggaagagctaaagaatgctcgggccaccaatcggaccaattttgctatcacatacccaatcactcacttaaaggacgggagggctgtgtacaatgggcaccagcttgggggcgtcactgtgcacagcaaagaccgggtgaaatctgcagaggccatccagctcacctactacctgcagtcaatcaacagtctcaatgacatggtggctgagaggtgggagtccagcttctgcgacactgtcagactgtttcagaaatccaacagcaaagtcaaaatgtacccttacacgtcctcctcactgagggaagatttccagaagaccagccgcgtatcagaacgttacctggtcaccagcctgattctggtggttaccatggccatcctgtgttgctctatgcaggactgcgtccgcagcaaaccctggctaggcctgctcggattggtgaccataagcctggccactctcactgcagccgggatcatcaatcttactggtgggaaatataattccaccttcctgggagtccctttcgtcatgctaggtaattactactcttctttcttctgtttccgcctgctggtggtgttgactaggttcctaaaaggccaggagtagccttctaacaactttgtttcatttaacagtatcttcattttgcccaaaagtcctgggacccactctataaagtgctggtaatcagcaaaaaacaacctaatctggtaaatgtgccagaagttcaaagtcctgggttctagcgctgactctccattgagcagccatgtggtgtctagcaggtattaatcttctccttgtcccagtgtcttaggttgggcttccccataagcagggccctgagaaaaagatttggatacaagtagtgtatttgggaggtgagcccaggaagcaccagtatgggagtgaggaagtggaagttgaaggcacttcagttgaaggcaggcagttgaaggtatgttaatgagcccaagatatatcacattctgccggttgctgtgggcacctgtggttcagccccacaggggacctttgggagaccttgtgaaacacacctcagagaggtcctcccccggggtgaggaatttgggctattttcccacagaccctttgtgattcattgagggctgctccccaggccagttaactgccagcacttcccagggaggtgctcctgcagcacactcctgcagccagagaaatccttcaggtgactttgtagttataagccttcagcaagctcaagaatggggaatgggagggcatgttgggttggcactgagagcgcctgctactctcagtttccccaccttatgaatagagtggatgtgagcatcacacaaaaggacatgataaatgtataagaactttgaaagtgacatgtgagataccagtaggaagtaactttttttcctattcttactatgaactcaggagaatattttaaagcgatgctgatggtgacagcgtgcttccagtgtgtccactcagggggctgctggaactccctgatagagattaatggtcaaaacaaagccatagtggccataacatcggttgccctgtccatctgttatcgaaaatggcatgcccagcaagcctgatggcagggttcttgcgggccaaggattcaagaggttcactttcccccttttctatggtagcttctcatcaattcctttaacaaaattaaaatgtcatttggaatc

SEQ ID NO: 163929 - DNA, 5215 bp, Homo sapiens
  Payload ID: 12276
  Gene Symbol: PTCHD2
  Gene Name: patched domain containing 2
  Uniprot ID: Q9P2K9
  ENST ID: ENST00000294484
  CDS Start-End: 139-4317
gcggctccgagaagcttccccctgcgacttccgcgaggagacgagtctgcgcagcgtggtggccgccgccccccgaccctctgcgcactctctcccgcgccggcggctcagcctagccccgttcggccggccgagactatggacacggaggatgaccccttgctgcaggatgtgtggctagaggaggagcaggaggaggaagaagcaacgggtgaaacctttttaggggcccagaagccagggccccaacctggggcagggggacagtgttgctggcggcactggcccctggcttcccgacccccagcttcgggcttctggagtaccctgggctgggccttcaccaatccgtgctgtgctgggctggtgctcttcctgggctgcagcatccccatggccctgtcagccttcatgttcctttactacccaccgctggacattgacatctcctacaacgcctttgagatccgcaaccacgaggcctcacagcgtttcgacgctctcactctggcgcttaagtcccagtttggatcctgggggcggaaccggcgcgatttggccgacttcacctccgagacgcttcagcgccttatctcagagcagctgcagcagctgcatctcggcaaccgctcgcggcaagcctcccgagccccccgcgtcatccccgcggcctcactcggtggcccaggcccttaccgggacacttccgcggctcaaaagcccacagccaatcggagcgggcgacttcggcgtgagaccccgcccctggaggatctggcagccaaccagagtgaagacccgcgaaaccagcggctgagcaagaatgggcggtaccagcccagcatcccgccccacgcggcagtcgcggccaatcagagccgtgcccgccgaggcgcctcgcgctgggactactcgcgcgcctatgtgagtgccaacactcagacgcacgcgcactggcgcatcgagctcatcttcctggcgcgcggcgacgcggagcgcaacattttcaccagtgagcgcctggtcacgatccatgagatcgagcgcaagatcatggaccacccaggcttccgggagttctgctggaagccccacgaggtgctcaaggatctgccgctgggctcctactcctactgctcgccccccagctcgctcatgacctacttttttcccaccgagaggggcggcaagatctactatgacggcatgggccaggacctggcggacatccggggctccctggagctggccatgactcaccctgagttctactggtatgtggatgagggcctctctgcagacaatctgaagagctccctcctgcgcagtgagatcctgtttggagcacccctgcccaactactactcagtagatgaccgctgggaggaacaacgggctaagtttcagagcttcgtggtcacctacgtggccatgctggccaagcagtctaccagcaaagtccaggttctctatggggggacagacctgtttgactatgaagtgcgcaggacgttcaacaatgacatgctcctggccttcatcagcagcagctgcattgctgccctggtctacatcctcacctcctgctcagtgttcctgtccttctttgggattgccagcattggtctcagctgcctggtggccctcttcctgtaccacgtggtctttggtatccagtacttgggcatcctgaatggggtggccgccttcgtgatcgtgggcattggtgtggacgatgtctttgtgttcatcaacacctaccgccaggccacccacctggaagacccacagctgcgcatgatccacaccgtccaaactgcaggcaaggccaccttcttcacctccctgaccacagccgccgcctacgcagctaacgtcttctcccagatcccagccgtccacgactttggcctgttcatgtctctcatcgtgtcctgttgctggctggccgtgcttgtcaccatgcctgcagctctgggcctctggagcctctacctggcaccactggagagctcctgccagaccagctgccaccagaattgcagccggaagacctccctgcacttccccggagacgtgtttgccgctcccgagcaggttggaggcagccctgcccagggccccataccctacctggatgatgacatccccttgctggaggtcgaggaagagccagtgtcactggagctgggagacgtgtccctggtgtctgtgtcccccgagggtctgcagccagcctccaacacgggcagccgcggccatctcatcgtgcagctgcaggagctgctgcaccactgggtcctgtggtcagccgtcaagagccgctgggtgattgtggggctgttcgtctccatcctcatcttgtccctggtgttcgccagccggctccgccccgccagccgggccccgctactcttccggcctgataccaacatccaggtgctgctggacctcaagtacaacctgagcgccgagggcatctcctgcatcacctgttcaggtctgttccaggagaagccccacagcctgcagaacaacatccggacgtccctggagaagaagaggcgaggctcaggggtcccctgggctagccggcctgaggccaccctgcaggatttcccaggcaccgtgtacatctctaaagtgaagagtcaaggccaccccgctgtctacaggctctccctcaatgccagcctgcctgctccttggcaggctgtgtcgcctggggatggagaggtgccctccttccaggtgtatagagcgccttttggtaacttcaccaagaagctgaccgcttgtatgtctacagtagggctgctccaggcggcgagcccctcccgcaagtggatgctgacgaccttggcctgtgatgccaagcggggctggaagtttgacttcagcttctacgtggccaccaaggagcagcagcacacccggaagctgtacttcgcccagtcccacaagccccccttccacgggcgcgtatgcatggcaccccctggctgcctgcttagctccagccccgatgggcctaccaaaggcttcttcttcgtgcctagtgagaaagtgcccaaggcccgtctctcagccaccttcggcttcaacccctgcgtgaacacgggctgcgggaagccggcggtgcggccactagtggataccggggccatggtctttgtggtcttcggcattattggcgtcaaccgcactcggcaggtggacaaccacgtcattggagacccgggtagtgttgtctacgacagcagctttgacctcttcaaggaaattgggcacctgtgtcacctctgcaaggccatcgcagccaactccgagctggtgaagccgggtggggcccagtgcctgccttcaggctacagcatctcctccttcctgcagatgttgcaccctgagtgcaaggagctgcccgagcccaacctgctcccggggcagctgtcccacggggcagtgggcgtcagggagggccgcgtgcagtggatctccatggctttcgagtcgaccacgtacaagggcaaatcctccttccagacctactcggactacctgcgctgggagagcttcctccagcagcagctgcaggccttgcccgagggctcagtcctgcgccggggcttccagacctgcgagcactggaagcagatattcatggaaatcgtaggggtgcagagcgccctgtgcggcctggtgctatccctgctcatctgcgtggccgcggtggccgtgttcaccacccacatcctgctcctgctgcccgtgctcctcagcatcttgggcatcgtgtgcctggtggtgaccatcatgtactggagcggctgggagatgggggctgtggaagccatctccctgtccatcctcgttggctcctccgtggattactgcgtccacctggtcgagggctacctgctggctggagagaacctgcccccccaccaggccgaggacgcccgaacgcagcgccagtggcgtacgctggaggccgtgcggcacgtgggcgtggccatcgtctccagtgccctcaccacggtcatcgccacagtgcccctcttcttctgcatcatcgccccatttgccaagttcggcaagattgtggcactcaacacgggcgtgtccatcctctacacgctgaccgtcagcaccgccctgctgggcatcatggcgcccagctctttcactcggacccggacttccttcctcaaggccctgggtgccgtgctgctggcaggggccctggggctgggtgcctgcctcgtgctcctgcagagcggctataagattcccctgcccgcaggggcctccctatagcccgggacgggctctggacacttgcacctttggtcccatgggtgggggacaggagctgcttcccagctcgacttcagctagctgtgtccccaggcctgggcccagggcgccctgcgggccagcgtggaggctgacacccacacagatggtgtggaccatgctgccttgtggagctgggagttggagacagccgccaccccacaggccgggctactggcagccacactcggctttttgcccagtggcagaagagaccagccctcctcccatgcccggtcaccatgggggtcaggttatttttgtagggggtctccctctcacactgcctcagtgctcacaaccttccagtgtggatgttacagggtggcccccattctaccgatgtgaaaactgaggcgccaggacacagtggctgccctgtcgctggatcagtagcagagccagagctgcctccgagcgccatgccgccctcgggaatcatacaggaagagcacagtggatccagggtgggggcctctcaccccctaaccccgcccccccgcaaccctccccttcagctttacggcggccagtgctgaatggccctgtggccctccctgggccttttggtcttggccagagaagacagaaggacccggcttgggcttctgcatgtcctacccctgaccccagcctcaaggggcccctcaaaggccctctctgggggctctggggctcagcacagctttcctcatggatctaagcccctgtctttcccacctgactctgagtggatgttttgggggatggcccctgtggggaggagctgccatgccggccgcctgctcacggcagaaggttgctattaaaatgacataggattgcagactgctgctgttaatacgagcattttaagcac

SEQ ID NO: 163930 - DNA, 1495 bp, Homo sapiens
  Payload ID: 12276
  Gene Symbol: PTCHD2
  Gene Name: patched domain containing 2
  ENST ID: ENST00000304391
  CDS Start-End: 119-925
ggctcaccacacggcaaggtgcccgcttccaagctgaccccaccagcactcagacacgcatgcacacacacacgcagacctactatgaactggcttgtgctcagcaagagcagaattgatgagcagataccttaagaatcttttagagcaggaccacgtacaagggcaaatcctccttccagacctactcggactacctgcgctgggagagcttcctccagcagcagctgcaggccttgcccgagggctcagtcctgcgccggggcttccagacctgcgagcactggaagcagatattcatggaaatcgtaggggtgcagagcgccctgtgcggcctggtgctatccctgctcatctgcgtggccgcggtggccgtgttcaccacccacatcctgctcctgctgcccgtgctcctcagcatcttgggcatcgtgtgcctggtggtgaccatcatgtactggagcggctgggagatgggggctgtggaagccatctccctgtccatcctcgttggctcctccgtggattactgcgtccacctggtcgagggctacctgctggctggagagaacctgcccccccaccaggccgaggacgcccgaacgcagcgccagtggcgtacgctggaggccgtgcggcacgtgggcgtggccatcgtctccagtgccctcaccacggtcatcgccacagtgcccctcttcttctgcatcatcgccccatttgccaagttcggcaagattgtggcactcaacacgggcgtgtccatcctctacacgctgaccgtcagcaccgccctgctgggcatcatggcgcccagctctttcactcggacccggacttccttcctcaaggccctgggtgccgtgctgctggcaggggccctggggctgggtgcctgcctcgtgctcctgcagagcggctataagattcccctgcccgcaggggcctccctatagcccgggacgggctctggacacttgcacctttggtcccatgggtgggggacaggagctgcttcccagctcgacttcagctagctgtgtccccaggcctgggcccagggcgccctgcgggccagcgtggaggctgacacccacacagatggtgtggaccatgctgccttgtggagctgggagttggagacagccgccaccccacaggccgggctactggcagccacactcggctttttgcccagtggcagaagagaccagccctcctcccatgcccggtcaccatgggggtcaggttatttttgtagggggtctccctctcacactgcctcagtgctcacaaccttccagtgtggatgttacagggtggcccccattctaccgatgtgaaaactgaggcgccaggacacagtggctgccctgtcgctggatcagtagcagagccagagctgcctccgagcgccatgccgccctcgggaatcatacaggaagagcacagtggatccagggtgggggcctctcaccccctaaccccgcccccc

SEQ ID NO: 163931 - DNA, 2529 bp, Homo sapiens
  Payload ID: 12277
  Gene Symbol: PTCHD3
  Gene Name: patched domain containing 3
  Uniprot ID: Q3KNS1
  ENST ID: ENST00000438700
  CDS Start-End: 119-2422
aggaaaccgttgggtggggccaggagagcgttgggtggggccaggaaaccgtctggtgggatctccgcagctgcttttcacctgctgttcctcctgcgcttcctaagaggaagaatcaatgccgtgggtggagcccaagcccaggccggggccggagcagaagcccaagctcaccaaaccggactctgccaccgggccgcagtggtaccaggaatctcaggaatcggagtcggaaggcaagcagccacccccgggacccctggcacccccgaaatcccccgaaccctcaggacccctggcgtcggagcaggatgcacccctgccagagggggacgatgcacccccccggccgtcgatgctggacgatgcaccccgcctgccgctggagctggacgatgcacccctgccggaggaggaaacccccgaacccacggccatctgcaggcaccggcaccgctgtcacaccgactgcctagaggggctgctgtcccgcaccttccagtggctggggtggcaggtgggcgcgcacccctggatcttcctgctggcgcccttgatgctgacagccgcgctgggcaccggcttcctgtacctacccaaggacgaagaggaagacctagaggagcattacacccctgtggggagcccggccaaggcggagcggcgcttcgtgcagggccatttcaccaccaacgactcctaccgcttctccgcctccaggaggagcaccgaagccaatttcgtctcgcttctggtggtctcctacagcgactcactgctggacccagctacctttgcagaagtcagcaaactggacggcgcggtgcaggatctgcgcgtggcgcgggaaaagggaagccagatccagtaccagcaggtgtgcgcgaggtacagggcgctctgcgtgccccccaacccgatcctgtacgcctggcaggtgaacaaaacgctcaacctgagcagcatctccttccccgcctacaaccacggcaggcatcccctctacctgaccggcttcttcggaggatacatcttggggggcagcctaggaatgggccagttactcctgcgggccaaagccatgcggctgctgtactacctgaagaccgaggaccctgagtacgacgtgcagagcaagcagtggctcacccatttgctcgatcaatttaccaacattaagaacatcttggccttgaaaaaaattgaggtagtccactttacatcgctttccagacaactggaatttgaggcaacttctgtgactgtgatccctgtgtttcacctggcatacattctcatcattctgtttgcagtcacatcatgctttaggtttgactgcatacgaaacaaaatgtgtgttgcggcctttggagtgatttctgctttcttggcagtggtgagcggctttggcctgctgttgcacattggggtgccatttgtcatcatagttgccaattcaccatttcttattctaggtgttggggtcgatgacatgtttatcatgatttctgcctggcataagaccaaccttgcagatgacatacgagagcggatgtccaatgtctattcaaaagcggcagtgtctattacaatcaccaccatcactaacatcctggccttatatacagggattatgagctcttttaggtctgtacaatgtttttgcatctatacaggaatgaccctgttattttgctatttttataacatcacgtgttttggagcatttatggccttggatggtaaaagagaagtagtctgcctatgctggttgaaaaaggctgacccaaaatggccctcatttaaaaagttctgctgtttcccatttggttctgtcccagatgaacatggaactgatatccatccaataagtttgttttttagagactattttggcccctttctcacaaggagtgagtccaagtattttgtagtctttatatatgttttgtacatcataagcagtatatatgggtgtttccatgtgcaggaaggtttagaccttcgaaatctggcaagtgacgattcctacatcacaccatattttaacgtagaggagaattatttttcagattatggtcccagggttatggttattgttactaaaaaagttgactactgggataaagatgttaggcaaaaactggaaaactgtactaaaatttttgaaaaaaatgtctatgtagataaaaatcttacagagttttggttagatgcatatgtgcaatatttaaaaggtaacagccaagatcctaatgagaagaatacttttatgaacaatattcctgattttttaagcaattttccaaattttcagcatgatattaatatttcttcatcaaatgaaatcatttcttcccggggcttcattcagacaacagatgtttcttcctcagccaaaaagaaaatattgttattctaattacgacgcatagctgaagactgtcaaattcccctaatggtgtataaccaggcatttatatattttgatcagtatgctgcaatattagaagacactgttagaaatgt

SEQ ID NO: 163932 - DNA, 1720 bp, Homo sapiens
  Payload ID: 12277
  Gene Symbol: PTCHD3
  Gene Name: patched domain containing 3
  ENST ID: ENST00000610715
  CDS Start-End: 119-1720
aggaaaccgttgggtggggccaggagagcgttgggtggggccaggaaaccgtctggtgggatctccgcagctgcttttcacctgctgttcctcctgcgcttcctaagaggaagaatcaatgccgtgggtggagcccaagcccaggccggggccggagcagaagcccaagctcaccaaaccggactctgccaccgggccgcagtggtaccaggaatctcaggaatcggagtcggaaggcaagcagccacccccgggacccctggcacccccgaaatcccccgaaccctcaggacccctggcgtcggagcaggatgcacccctgccagagggggacgatgcacccccccggccgtcgatgctggacgatgcaccccgcctgccgctggagctggacgatgcacccctgccggaggaggaaacccccgaacccacggccatctgcaggcaccggcaccgctgtcacaccgactgcctagaggggctgctgtcccgcaccttccagtggctggggtggcaggtgggcgcgcacccctggatcttcctgctggcgcccttgatgctgacagccgcgctgggcaccggcttcctgtacctacccaaggacgaagaggaagacctagaggagcattacacccctgtggggagcccggccaaggcggagcggcgcttcgtgcagggccatttcaccaccaacgactcctaccgcttctccgcctccaggaggagcaccgaagccaatttcgtctcgcttctggtggtctcctacagcgactcactgctggacccagctacctttgcagaagtcagcaaactggacggcgcggtgcaggatctgcgcgtggcgcgggaaaagggaagccagatccagtaccagcaggtgtgcgcgaggtacagggcgctctgcgtgccccccaacccgatcctgtacgcctggcaggtgaacaaaacgctcaacctgagcagcatctccttccccgcctacaaccacggcaggcatcccctctacctgaccggcttcttcggaggatacatcttggggggcagcctaggaatgggccagttactcctgcgggccaaagccatgcggctgctgtactacctgaagaccgaggaccctgagtacgacgtgcagagcaagcagtggctcacccatttgctcgatcaatttaccaacattaagaacatcttggccttgaaaaaaattgaggtagtccactttacatcgctttccagacaactggaatttgaggcaacttctgtgactgtgatccctgtgtttcacctggcatacattctcatcattctgtttgcagtcacatcatgctttaggtttgactgcatacgaaacaaaatgtgtgttgcggcctttggagtgatttctgctttcttggcagtggtgagcggctttggcctgctgttgcacattggggtgccatttgtcatcatagttgccaattcaccatttcttattctaggtgttggggtcgatgacatgtttatcatgatttctgcctggcataagaccaaccttgcagatgacatacgagagcggatgtccaatgtctattcaaaagcggcagtgtctattacaatcaccaccatcactaacatcctggccttatatacagggattatgagctcttttagggcttcattcagacaacagatgtttcttcctcagccaaaaagaaaatattgttattctaattacgacgcatag

SEQ ID NO: 163933 - DNA, 1720 bp, Homo sapiens; identical to SEQ ID NO: 163932
  Payload ID: 12277
  Gene Symbol: PTCHD3
  Gene Name: patched domain containing 3
  ENST ID: ENST00000622555
  CDS Start-End: 119-1720

SEQ ID NO: 163934 - DNA, 2529 bp, Homo sapiens; identical to SEQ ID NO: 163931
  Payload ID: 12277
  Gene Symbol: PTCHD3
  Gene Name: patched domain containing 3
  Uniprot ID: Q3KNS1
  ENST ID: ENST00000617711
  CDS Start-End: 119-2422

SEQ ID NO: 163935 - DNA, 2850 bp, Homo sapiens
  Payload ID: 12278
  Gene Symbol: PTCHD4
  Gene Name: patched domain containing 4
  Uniprot ID: Q6ZW05
  ENST ID: ENST00000339488
  CDS Start-End: 35-2575
gagaacggggtagcccggcgcttacacatgtcacatgtgctttttaagacggccgggagcgcctgcgagctggatctggtggaggatgctgcggcaggtgcttcgcagagggctccagtcgttctgccacaggctgggtttgtgcgtgagccggcacccggtctttttcctcaccgtgcccgcagtcctgacaatcaccttcggcctcagcgcgctcaaccgcttccagcccgagggcgacctggagcgcctggtcgctcccagccacagcctggccaagatcgagcgcagcctggccagcagccttttccccctggaccagtccaaaagccagctctattcggacttacacacccctgggaggtatggcagggtgatcctcctctccccaaccggggacaatattttgctccaggctgaggggatcctgcagacccaccgagccgtgctggaaatgaaggatgggaggaacagttttattggacaccaactgggcggggtagtggaagtgccaaacagcaaagatcagcgggtcaagtcagccagagccattcaaatcacctactacctccagacctatggctctgccacccaagacctcataggggagaagtgggagaatgagttctgtaagcttataaggaagctccaggaggagcatcaagaactccagctctactctttagcatcctttagcctctggagggactttcataagaccagcatcctggccagaagcaaggtcctggtgagcctcgtgctgatcctgaccacagccaccctctccagctccatgaaggactgcttgcgcagtaagcccttcctgggcctcctgggggtgctcacagtatgcatctccatcatcacagcagcagggatcttcttcatcaccgatggaaagtacaactccaccctgctgggaatcccgttcttcgccatgggtcatggaactaaaggagtgtttgagcttctgtccggatggcggagaaccaaagagaacttgcccttcaaagacaggatagcagatgcctattctgatgtgatggtcacctataccatgaccagctccctgtacttcatcacttttggcatgggtgccagcccattcacaaacatagaggctgtgaaggtcttctgtcaaaacatgtgtgtctctattctgttgaactacttctacattttctccttctttggctcctgtctggtctttgctggccaactagagcaaaaccgctaccacagcatcttttgctgtaagatcccttctgcagaatacctggatcgcaaacctgtgtggttccagacagtgatgagtgatgggcatcaacagacgtcccatcatgagacgaacccctaccagcaccacttcattcagcacttcctccgtgaacattataatgaatggattaccaatatatatgtgaagccatttgttgtcatcctctatctcatttatgcctccttctccttcatggggtgcttacagatcagtgacggagccaacatcatcaatctactagccagtgattcgccaagtgtttcctatgccatggttcagcagaaatatttcagcaactatagccctgtgataggattctacgtctatgagcccctagagtactggaacagcagcgtccaggatgacctaagaagactctgtagtggattcactgcagtgtcctgggtggagcagtactaccagttcctgaaagtcagcaacgtcagtgccaataacaaaagtgacttcatcagtgtcctgcaaagctcatttttaaaaaagccagaattccagcattttcgaaatgatatcatcttctccaaggcaggggatgaaagcaatatcattgcttctcgcttgtatctggtggccaggactagcagagacaagcagaaagaaatcacagaagtgttggaaaagctgaggcccctatccctctcaaagagcatccgattcatcgtgttcaacccctcctttgtcttcatggaccattacagcttgtctgtcacagtgcctgttctgattgcaggctttggtgttctcctggtgttaatcctgacttttttcctagtgatccaccctctgggaaacttctggctaattcttagcgtcacctcaattgagctgggcgttctgggcttaatgacattatggaacgtcgacatggattgcatttctatcttgtgccttatctacaccttgaatttcgccattgaccactgtgcaccactgcttttcacatttgtattagcaactgagcacacccgaacacaatgtataaaaagctccttgcaagaccatgggacagccattttgcaaaatgttacttcttttcttattgggttagtcccccttctatttgtgccttcgaacctgaccttcacactgttcaaatgcttgctgctcactgggggttgcacacttctgcactgttttgttattttacctgtgttcctaacgtttttccccccttccaaaaagcaccacaagaaaaagaaacgtgccaagcgaaaggagagagaggaaattgaatgcatagaaattcaagagaacccggatcacgtcaccacagtatgaggggtatagaccagtggattatttttcttttccagtattgcacaatgatgcagggcaagtaaagctcagacctcagctgcttgggctggccaggggtaacaaggcaagtcagatcaagagtgcattattcatgacacttcaaggtgcctgcttcttggggggaagagggaataaaaaaagaggaaaaagttatttgcaaccttgttctcctctaaaaacaagtttctggatgtaatctgagagctcttccaaggaatggatgaatcaatggagtg

SEQ ID NO: 163936 - DNA, 3232 bp, Homo sapiens
  Payload ID: 12278
  Gene Symbol: PTCHD4
  Gene Name: patched domain containing 4
  ENST ID: ENST00000398738
  CDS Start-End: 1-934
gtgctttttaagacggccgggagcgcctgcgagctggatctggtggaggatgctgcggcaggtgcttcgcagagggctccagtcgttctgccacaggctgggtttgtgcgtgagccggcacccggtctttttcctcaccgtgcccgcagtcctgacaatcaccttcggcctcagcgcgctcaaccgcttccagcccgagggcgacctggagcgcctggtcgctcccagccacagcctggccaagatcgagcgcagcctggccagcagccttttccccctggaccagtccaaaagccagctctattcggacttacacacccctgggaggtatggcagggtgatcctcctctccccaaccggggacaatattttgctccaggctgaggggatcctgcagacccaccgagccgtgctggaaatgaaggatgggaggaacagttttattggacaccaactgggcggggtagtggaagtgccaaacagcaaagatcagcgggtcaagtcagccagagccattcaaatcacctactacctccagacctatggctctgccacccaagacctcataggggagaagtgggagaatgagttctgtaagcttataaggaagctccaggaggagcatcaagaactccagctctactctttagcatcctttagcctctggagggactttcataagaccagcatcctggccagaagcaaggtcctggtgagcctcgtgctgatcctgaccacagccaccctctccagctccatgaaggactgcttgcgcagtaagcccttcctgggcctcctgggggtgctcacagtatgcatctccatcatcacagcagcagggatcttcttcatcaccgatggaaagtacaactccaccctgctgggaatcccgttcttcgccatgggcatctccactgaatttacctcaagctagaaacaaatttagtttggaagaaagaaaggagagaaggaaggagagaaaaaactggagaggagaaaaatatcacatttggaagattatatgtgaagactcctaggatacaataaaatcatcatcatcgtcatcatcatcatcatcaccaccaataccatcagagcaatctgagagttcattctagtctaagaacccagccctctattttttggaggttaagtatcctccaggtatttctttcctccctgtgcttaacagctgtgtgtctgtaacccatactgtcttttctatctcccacctgactcctctcatgggaaactaaattggtttaaatcatatggaagcattataagtactgtttagtgatgaaaataaattgattccaatcatataggtactttcctaaatactgactgatgaagtttagatgtgctgtaatttataaataaaatgaaggaggttacctggcaatatgtgagagggaggaacaattatcgtgtttgagatttaaaggaaagagtaatgaacacttcccaaataattctatgagataaatattaccctgatactaaaaccagacaaaaacatcacaaggaaggaaaactacaggttaataactttatgaacttgagtgtaaaaattctcaataaaatactagcaagccaaattcaatgaacaaatgaggtttatttctatttatttttatttttttttatttttattttattttattattttttttttttgagacggagtcttgctctgtcgcccaggccggactgcggactgcagtggcgcaatctcggctcactgcaagctccgcctcccaggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccatgcccggcccaaatgaggtttattttataaatgcaagagtggtttaacatttgaaaatcattaacataatataccatcaatagaattaaggtcaaaaaccgcatggtcatctcaatagacaaagaaagggcatttgacaaactctaacaacattttatgacaacaaaataactctcaacaaactagtaatagaagggaacttgcttaatctgatacagatatccataaaaacccaaagctaatatcatatttaatggagaaagaatgaacttaaaagttgtacttcaatgaataccatcaagaaagtgaaaaacaaactcacagaatgggagaaaatattttcaaattatctatcttataagagacttgtatacagaatatttaaaggactattacagcttaataataaaaacacaacccaatttcaaagtggacagaagattcgaatagacatttattctaagaagataaacaagtggccaaaagtatatttaaaatgctcaaaataattagttattaaagaaatgcaaatcaaaaccacattgagcacatcatatccattaggatgactaaaatcaagaagtaaggcaataacaagtattgatgaggtaggttaggaactctttacacattgctgatgaaaatgtaaatgatgcagctcttttggaaaatagtctgacagttcctaaaaatgctaaacttagtattagcattttgattcagtaattccactgctaggtatatactcaagagaaatgaaaatatttatccacacaaaactgtacaaatgttcatagcaatattattcataatggcaaaaggtagacacaatccaaatgtccatcaactgatgaatggaaacataaaaagtggtatatgcatacaatggaatattattcagccattaaaaaggaaacaagtactgatacatgctccaatatggatgagcattgaaaatattttgataagtgaaagaagtcatgaaagtgtacataattgcatgattctatatatatgaaatgttcagagtaggcaaatatgtagagacaggaagtagatgagtagttgctgaggattggtgggttaggggatgaagccagggaatggagtcactgctaatgatacagaagttctttcaggttgatgaaatgttctgaaattgattatggcaatcattgcacaactttgtagtatactagaaacttttaaattgtacacttttaatcaatgaattgcttggcattatatcacaataaagctgttaaaaacaaac

SEQ ID NO: 163937 - DNA, 6618 bp, Homo sapiens
  Payload ID: 12279
  Gene Symbol: PEG10
  Gene Name: paternally expressed 10
  Uniprot ID: Q86TG7
  ENST ID: ENST00000482108
  CDS Start-End: 480-1457
ctcctcggtgcaacctatataaggctcacagtctgcgctcctggtacacgcgcttcaacttcggttggtgtgtgtcgaagaaacctgactgcgccctgaggagaacagcggagaaggtccaccgagcctggcgaaaggtccgctgagcgggctgtcgtccggagccactccgggctgcggagcacccagtggagaccgcgcctggctcaggtgtgggaccccatccttcctgtcttcgcagaggagtcctcgcgtgaaataagcgggttttgaaaacaaaaaaaagaaggagtggaagagggggccaggatccaggcctccatccccacagaagtgaagctacagctgggaggtctcctcccaccccaaccgtcaccctgggtcccgactgcccacctcctcctcctccccctccccccaacaacaacaacaacaacaactccaagcacaccggccataagagtgcgtgtgtccccaacatgaccgaacgaagaagggacgagctctctgaagagatcaacaacttaagagagaaggtcatgaagcagtcggaggagaacaacaacctgcagagccaggtgcagaagctcacagaggagaacaccacccttcgagagcaagtggaacccacccctgaggatgaggatgatgacatcgagctccgcggtgctgcagcagctgctgccccaccccctccaatagaggaagagtgcccagaagacctcccagagaagttcgatggcaacccagacatgctggctcctttcatggcccagtgccagatcttcatggaaaagagcaccagggatttctcagttgatcgtgtccgtgtctgcttcgtgacaagcatgatgaccggccgtgctgcccgttgggcctcagcaaagctggagcgctcccactacctgatgcacaactacccagctttcatgatggaaatgaagcatgtctttgaagaccctcagaggcgagaggttgccaaacgcaagatcagacgcctgcgccaaggcatggggtctgtcatcgactactccaatgctttccagatgattgcccaggacctggattggaacgagcctgcgctgattgaccagtaccacgagggcctcagcgaccacattcaggaggagctctcccacctcgaggtcgccaagtcgctgtctgctctgattgggcagtgcattcacattgagagaaggctggccagggctgctgcagctcgcaagccacgctcgccaccccgggcgctggtgttgcctcacattgcaagccaccaccaggtagatccaaccgagccggtgggaggtgcccgcatgcgcctgacgcaggaagaaaaagaaagacgcagaaagctgaacctgtgcctctactgtggaacaggaggtcactacgctgacaattgtcctgccaaggcctcaaagtcttcgccggcgggaaactccccggccccgctgtagagggaccttcagcgaccgggccagaaataataaggtccccacaagatgatgcctcatctccacacttgcaagtgatgctccagattcatcttccgggcagacacaccctgttcgtccgagccatgatcgattctggtgcttctggcaacttcattgatcacgaatatgttgctcaaaatggaattcctctaagaatcaaggactggccaatacttgtggaagcaattgatgggcgccccatagcatcgggcccagttgtccacgaaactcacgacctgatagttgacctgggagatcaccgagaggtgctgtcatttgatgtgactcagtctccattcttccctgtcgtcctaggggttcgctggctgagcacacatgatcccaatatcacatggagcactcgatctatcgtctttgattctgaatactgccgctaccactgccggatgtattctccaataccaccatcgctcccaccaccagcaccacaaccgccactctattatccagtagatggatacagagtttaccaaccagtgaggtattactatgtccagaatgtgtacactccagtagatgagcacgtctacccagatcaccgcctggttgaccctcacatagaaatgatacctggagcacacagtattcccagtggacatgtgtattcactgtccgaacctgaaatggcagctcttcgagattttgtggcaagaaatgtaaaagatgggctaattactccaacgattgcacctaatggagcccaagttctccaggtgaagagggggtggaaactgcaagtttcttatgattgccgagctccaaacaattttactatccagaatcagtatcctcgcctatctattccaaatttagaagaccaagcacacctggcaacgtacactgaattcgtacctcaaatacctggataccaaacataccccacatatgccgcgtacccgacctacccagtaggattcgcctggtacccagtgggacgagacggacaaggaagatcactatatgtacctgtgatgatcacttggaatccacactggtaccgccagcctccggtaccacagtacccgccgccacagccgccgcctccaccaccaccaccgccgccgcctccatcttacagtaccctgtaaatacctgtcatgtccttcaggatctctgccctcaaaatttattcctgttcagcttctcaatcagtgactgtgtgctaaattttaggctactgtatcttcaggccacctgaggcacatcctctctgaaacggctatggaaggttagggccactctggactggcacacatcctaaagcaccaaaagaccttcaacattttctgagagcaacagagtatttgccaataaatgatctctcatttttccaccttgactgccaatctaactaaaataattaataagtttactttccagccagtcctggaagtctgggttttacctgccaaaacctccatcaccatctaaattataggctgccaaatttgctgtttaacatttacagagaagctgatacaaacgcaggaaatgctgatttctttatggagggggagacgaggaggaggaggacatgacttttcttgcggtttcggtaccctctttttaaatcactggaggactgaggccttattaaggaagccaaaattatcggtgcagtgtggaaaggcttccgtgatcctctcgctgcacccttagaaacttcaccgtcttcaaactccatttccatggttctgttaattctcaaggagcagcaactcgactggttctcccaggagcaggaaaaacccttgtgacatgaaacatctcaggcctgaaaagaaagtgctctctcagatggactcttgcatgttaagactatgtcttcacatcatggtgcaaatcacatgtacccaatgactccggctttgacacaacaccttaccatcatcatgccatgatggcttccacaaagcattaaacctggtaaccagagattactggtggctccagcgttgttagatgttcatgaaatgtgaccacctctcaatcacctttgagggctaaagagtagcacatcaaaaggactccaaaatcccatacccaactcttaagagatttgtcctggtacttcagaaagaattttcatgagtgttcttaattggctggaaaagcaccagctgacgttttggaagaatctatccatgtgtctgcctccatatgcatctgggcatttcatcttcagtcccctcattagactgtagcattaggatgtgtggagagaggagaaatgatttagcacccagattcacactcctatgcctggaagggggacatctttgaagaagaggaattagggctgtggacactgtcttgaggatgtggacttccttagtgagctccacattacttgatggtaaccacttcaaaaggatcagaatccacgtaatgaaaaaggtccctctagaggatggagctgatgtgaagctgccaatggatgaaaagcctcagaaagcaactcaaaggactcaaagcaacggacaacacaagagttgtcttcagcccagtgacacctctgatgtcccctggaagctttgtgctaacctgggactgcctgacttcctttagcctggtcccttgctactaccttgaactgttttatctaacctctctttttctgtttaattctttgctactgccattgaccctgctgcaggatttgtgtcattttcctgcctggttgctgagactccattttgctgccacacacagagatgtaagaggcaggctttaattgccaaagcacagtttgagcagtagaaaacaacatggtgtatatctcaaattgcctgacatgaagaggagtctaacggtgaagtttcacttttcatcagcatcatctttcacatgttcattatcatctgctcttattcttgcatgtttaaacacttaaaatttttagtataatttttagtgtgttttgaagtggtgactaggctttcaaaaacttccattgaattacaaagcactatccagttcttattgttaaactaagtaaaaatgataagtaacatagtgtaaaatattcctttactgtgaacttcttacaatgctgtgaatgagaggctcctcagaactggagcatttgtataataattcatcctgttcatcttcaattttaacatcatatataatttcaattctatcaattgggcctttaaaaatcatataaaaggatataaaatttgaaaagagaaacctaattggctatttaatccaaaacaactttttttttccttcaatggaatcagaaagcttgtcaatcactcatgtgttttagagtaattacttttaaaatggtgcatttgtgcttctgaactattttgaagagtcacttctgtttacctcaagtatcaattcatcctccatacatttgaattcaagttgtttttttgtcaaatttacagttgtcaattgatcttcaagctgcagggtgcctagaaatgggccgttgtctgtagccctggcatgtgcacacggacatttgccaccactgcaagcaaaagtctggagaagttcaccaacgacaagaacgattagggaaaatatgctgctgtgggttaacaactcagaaagtccctgatccacatttggctgtttactaaagcttgtgattaactttttggcagtgtgtactatgctctattgctatatatgctatctataaatgtagatgttaaggataagtaattctaaatttattattctatagttttgaagtttggttaagtttcctttcactcaattgatttattttgttgttaatcaaatttatgttaattggatcctttaaattttttttggcattttccaacaaaaatggctttattcataagaaaggaaaaaaatcaatggaatttgatatctaaagaagttagaaagggagcaaaataaaaaacataaaggagatagatgaattagtaagcaaatcagtagtcgagtttttcaaactggcaaaattaattaattgacttttagcccaaatttacattgttaattaaatcaagaaggaagaagatctaagagctcccattgataggcaagcctagagagaactagctaaatttatcatgctaggatattgaaacacagaaagtttacatacatttatgaagggtcaatttagtttggacagtgaggtatttgtcttagtggaaaaaaggagaattagtctgatcaaatcgtgaagtaatacagtgaacttgcaggtgcacaaaataagagggccacatctatatggtgcagtctggaattctgtttaagtttgtaggtacctcttggacttctgaattgatccagttgtcatccaccacagacatctcacatcagatacagacagttccaagattgacaacagagaacaacctgctggaaagacctgggcagaaatggagagccctgcgggaaccatgctacattttcatctaaagagagaatgcacatctgatgagactgaaagttctttgttgttttagattgtagaatggtattgaattggtctgtggaaaattgcattgcttttatttctttgtgtaatcaagtttaagtaataggggatatataatcataagcattttagggtgggagggactattaagtaattttaagtgggtggggttatttagaatgttagaataatattatgtattagatatcgctataagtggacatgcgtacttacttgtaaccctttaccctataattgctatccttaaagatttcaaataaactcggagggaactgcagggagaccaacttatttagagcgaattggacatggataaaaaccccagtgggagaaagttcaaaggtgattagattaataatttaatagaggatgagtgacctctgataaattactgctagaatgaacttgtcaatgatggatggtaaattttcatggaagttataaaagtgataaataaaaacccttgcttttacccctgtcagtagccctcctcctaccactgaaccccattgcccctacccctccttctaactttattgctgtattctcttcactctatatttctctctatttgctaatattgcattgctgttacaataaaaattcaataaagatttagtggttaagtgcaaa

SEQ ID NO: 163938 - DNA, 2587 bp, Homo sapiens
  Payload ID: 12279
  Gene Symbol: PEG10
  Gene Name: paternally expressed 10
  ENST ID: ENST00000488574
  CDS Start-End: 218-1423
acacgcgcttcaacttcggttggtgtgtgtcgaagaaacctgactgcgccctgaggagaacagcggagaaggtccaccgagcctggcgaaaggtccgctgagcgggctgtcgtccggagccactccgggctgcggagcacccagtggagaccgcgcctggctcaggtgtgggaccccatccttcctgtcttcgcagaggagtcctcgcgtggtgagtatgcgaaataagcgggttttgaaaacaaaaaaaagaaggagtggaagagggggccaggatccaggcctccatccccacagaagtgaagctacagctgggaggtctcctcccaccccaaccgtcaccctgggtcccgactgcccacctcctcctcctccccctccccccaacaacaacaacaacaacaactccaagcacaccggccataagagtgcgtgtgtccccaacatgaccgaacgaagaagggacgagctctctgaagagatcaacaacttaagagagaaggtcatgaagcagtcggaggagaacaacaacctgcagagccaggtgcagaagctcacagaggagaacaccacccttcgagagcaagtggaacccacccctgaggatgaggatgatgacatcgagctccgcggtgctgcagcagctgctgccccaccccctccaatagaggaagagtgcccagaagacctcccagagaagttcgatggcaacccagacatgctggctcctttcatggcccagtgccagatcttcatggaaaagagcaccagggatttctcagttgatcgtgtccgtgtctgcttcgtgacaagcatgatgaccggccgtgctgcccgttgggcctcagcaaagctggagcgctcccactacctgatgcacaactacccagctttcatgatggaaatgaagcatgtctttgaagaccctcagaggcgagaggttgccaaacgcaagatcagacgcctgcgccaaggcatggggtctgtcatcgactactccaatgctttccagatgattgcccaggacctggattggaacgagcctgcgctgattgaccagtaccacgagggcctcagcgaccacattcaggaggagctctcccacctcgaggtcgccaagtcgctgtctgctctgattgggcagtgcattcacattgagagaaggctggccagggctgctgcagctcgcaagccacgctcgccaccccgggcgctggtgttgcctcacattgcaagccaccaccaggtagatccaaccgagccggtgggaggtgcccgcatgcgcctgacgcaggaagaaaaagaaagacgcagaaagctgaacctgtgcctctactgtggaacaggaggtcactacgctgacaattgtcctgccaaggcctcaaagtcttcgccggcgggaaactccccggccccgctgtagagggaccttcagcgaccgggccagaaataataaggtccccacaagatgatgcctcatctccacacttgcaagtgatgctccagattcatcttccgggcagacacaccctgttcgtccgagccatgatcgattctggtgcttctggcaacttcattgatcacgaatatgttgctcaaaatggaattcctctaagaatcaaggactggccaatacttgtggaagcaattgatgggcgccccatagcatcgggcccagttgtccacgaaactcacgacctgatagttgacctgggagatcaccgagaggtgctgtcatttgatgtgactcagtctccattcttccctgtcgtcctaggggttcgctggctgagcacacatgatcccaatatcacatggagcactcgatctatcgtctttgattctgaatactgccgctaccactgccggatgtattctccaataccaccatcgctcccaccaccagcaccacaaccgccactctattatccagtagatggatacagagtttaccaaccagtgaggtattactatgtccagaatgtgtacactccagtagatgagcacgtctacccagatcaccgcctggttgaccctcacatagaaatgatacctggagcacacagtattcccagtggacatgtgtattcactgtccgaacctgaaatggcagctcttcgagattttgtggcaagaaatgtaaaagatgggctaattactccaacgattgcacctaatggagcccaagttctccaggtgaagagggggtggaaactgcaagtttcttatgattgccgagctccaaacaattttactatccagaatcagtatcctcgcctatctattccaaatttagaagaccaagcacacctggcaacgtacactgaattcgtacctcaaatacctggataccaaacataccccacatatgccgcgtacccgacctacccagtaggattcgcctggtacccagtgggacgagacggacaaggaagatcactatatgtacctgtgatgatcacttggaatccacactggtaccgccagcctccggtaccacagtacccgccgccacagccgccgcctccaccaccaccaccgccgccgcctccatcttacagtaccctgtaaatacctgtcatgtcct

SEQ ID NO: 163939 - DNA, 6392 bp, Homo sapiens
  Payload ID: 12279
  Gene Symbol: PEG10
  Gene Name: paternally expressed 10
  ENST ID: ENST00000612941
  CDS Start-End: 157-2382
catccttcctgtcttcgcagaggagtcctcgcgtgaaataagcgggttttgaaaacaaaaaaaagaaggagtggaagagggggccaggatccaggcctccatccccacagaagtgaagctacagctgggaggtctcctcccaccccaaccgtcaccctgggtcccgactgcccacctcctcctcctccccctccccccaacaacaacaacaacaacaactccaagcacaccggccataagagtgcgtgtgtccccaacatgaccgaacgaagaagggacgagctctctgaagagatcaacaacttaagagagaaggtcatgaagcagtcggaggagaacaacaacctgcagagccaggtgcagaagctcacagaggagaacaccacccttcgagagcaagtggaacccacccctgaggatgaggatgatgacatcgagctccgcggtgctgcagcagctgctgccccaccccctccaatagaggaagagtgcccagaagacctcccagagaagttcgatggcaacccagacatgctggctcctttcatggcccagtgccagatcttcatggaaaagagcaccagggatttctcagttgatcgtgtccgtgtctgcttcgtgacaagcatgatgaccggccgtgctgcccgttgggcctcagcaaagctggagcgctcccactacctgatgcacaactacccagctttcatgatggaaatgaagcatgtctttgaagaccctcagaggcgagaggttgccaaacgcaagatcagacgcctgcgccaaggcatggggtctgtcatcgactactccaatgctttccagatgattgcccaggacctggattggaacgagcctgcgctgattgaccagtaccacgagggcctcagcgaccacattcaggaggagctctcccacctcgaggtcgccaagtcgctgtctgctctgattgggcagtgcattcacattgagagaaggctggccagggctgctgcagctcgcaagccacgctcgccaccccgggcgctggtgttgcctcacattgcaagccaccaccaggtagatccaaccgagccggtgggaggtgcccgcatgcgcctgacgcaggaagaaaaagaaagacgcagaaagctgaacctgtgcctctactgtggaacaggaggtcactacgctgacaattgtcctgccaaggcctcaaagtcttcgccggggaaactccccggccccgctgtagagggaccttcagcgaccgggccagaaataataaggtccccacaagatgatgcctcatctccacacttgcaagtgatgctccagattcatcttccgggcagacacaccctgttcgtccgagccatgatcgattctggtgcttctggcaacttcattgatcacgaatatgttgctcaaaatggaattcctctaagaatcaaggactggccaatacttgtggaagcaattgatgggcgccccatagcatcgggcccagttgtccacgaaactcacgacctgatagttgacctgggagatcaccgagaggtgctgtcatttgatgtgactcagtctccattcttccctgtcgtcctaggggttcgctggctgagcacacatgatcccaatatcacatggagcactcgatctatcgtctttgattctgaatactgccgctaccactgccggatgtattctccaataccaccatcgctcccaccaccagcaccacaaccgccactctattatccagtagatggatacagagtttaccaaccagtgaggtattactatgtccagaatgtgtacactccagtagatgagcacgtctacccagatcaccgcctggttgaccctcacatagaaatgatacctggagcacacagtattcccagtggacatgtgtattcactgtccgaacctgaaatggcagctcttcgagattttgtggcaagaaatgtaaaagatgggctaattactccaacgattgcacctaatggagcccaagttctccaggtgaagagggggtggaaactgcaagtttcttatgattgccgagctccaaacaattttactatccagaatcagtatcctcgcctatctattccaaatttagaagaccaagcacacctggcaacgtacactgaattcgtacctcaaatacctggataccaaacataccccacatatgccgcgtacccgacctacccagtaggattcgcctggtacccagtgggacgagacggacaaggaagatcactatatgtacctgtgatgatcacttggaatccacactggtaccgccagcctccggtaccacagtacccgccgccacagccgccgcctccaccaccaccaccgccgccgcctccatcttacagtaccctgtaaatacctgtcatgtccttcaggatctctgccctcaaaatttattcctgttcagcttctcaatcagtgactgtgtgctaaattttaggctactgtatcttcaggccacctgaggcacatcctctctgaaacggctatggaaggttagggccactctggactggcacacatcctaaagcaccaaaagaccttcaacattttctgagagcaacagagtatttgccaataaatgatctctcatttttccaccttgactgccaatctaactaaaataattaataagtttactttccagccagtcctggaagtctgggttttacctgccaaaacctccatcaccatctaaattataggctgccaaatttgctgtttaacatttacagagaagctgatacaaacgcaggaaatgctgatttctttatggagggggagacgaggaggaggaggacatgacttttcttgcggtttcggtaccctctttttaaatcactggaggactgaggccttattaaggaagccaaaattatcggtgcagtgtggaaaggcttccgtgatcctctcgctgcacccttagaaacttcaccgtcttcaaactccatttccatggttctgttaattctcaaggagcagcaactcgactggttctcccaggagcaggaaaaacccttgtgacatgaaacatctcaggcctgaaaagaaagtgctctctcagatggactcttgcatgttaagactatgtcttcacatcatggtgcaaatcacatgtacccaatgactccggctttgacacaacaccttaccatcatcatgccatgatggcttccacaaagcattaaacctggtaaccagagattactggtggctccagcgttgttagatgttcatgaaatgtgaccacctctcaatcacctttgagggctaaagagtagcacatcaaaaggactccaaaatcccatacccaactcttaagagatttgtcctggtacttcagaaagaattttcatgagtgttcttaattggctggaaaagcaccagctgacgttttggaagaatctatccatgtgtctgcctccatatgcatctgggcatttcatcttcagtcccctcattagactgtagcattaggatgtgtggagagaggagaaatgatttagcacccagattcacactcctatgcctggaagggggacatctttgaagaagaggaattagggctgtggacactgtcttgaggatgtggacttccttagtgagctccacattacttgatggtaaccacttcaaaaggatcagaatccacgtaatgaaaaaggtccctctagaggatggagctgatgtgaagctgccaatggatgaaaagcctcagaaagcaactcaaaggactcaaagcaacggacaacacaagagttgtcttcagcccagtgacacctctgatgtcccctggaagctttgtgctaacctgggactgcctgacttcctttagcctggtcccttgctactaccttgaactgttttatctaacctctctttttctgtttaattctttgctactgccattgaccctgctgcaggatttgtgtcattttcctgcctggttgctgagactccattttgctgccacacacagagatgtaagaggcaggctttaattgccaaagcacagtttgagcagtagaaaacaacatggtgtatatctcaaattgcctgacatgaagaggagtctaacggtgaagtttcacttttcatcagcatcatctttcacatgttcattatcatctgctcttattcttgcatgtttaaacacttaaaatttttagtataatttttagtgtgttttgaagtggtgactaggctttcaaaaacttccattgaattacaaagcactatccagttcttattgttaaactaagtaaaaatgataagtaacatagtgtaaaatattcctttactgtgaacttcttacaatgctgtgaatgagaggctcctcagaactggagcatttgtataataattcatcctgttcatcttcaattttaacatcatatataatttcaattctatcaattgggcctttaaaaatcatataaaaggatataaaatttgaaaagagaaacctaattggctatttaatccaaaacaactttttttttccttcaatggaatcagaaagcttgtcaatcactcatgtgttttagagtaattacttttaaaatggtgcatttgtgcttctgaactattttgaagagtcacttctgtttacctcaagtatcaattcatcctccatacatttgaattcaagttgtttttttgtcaaatttacagttgtcaattgatcttcaagctgcagggtgcctagaaatgggccgttgtctgtagccctggcatgtgcacacggacatttgccaccactgcaagcaaaagtctggagaagttcaccaacgacaagaacgattagggaaaatatgctgctgtgggttaacaactcagaaagtccctgatccacatttggctgtttactaaagcttgtgattaactttttggcagtgtgtactatgctctattgctatatatgctatctataaatgtagatgttaaggataagtaattctaaatttattattctatagttttgaagtttggttaagtttcctttcactcaattgatttattttgttgttaatcaaatttatgttaattggatcctttaaattttttttggcattttccaacaaaaatggctttattcataagaaaggaaaaaaatcaatggaatttgatatctaaagaagttagaaagggagcaaaataaaaaacataaaggagatagatgaattagtaagcaaatcagtagtcgagtttttcaaactggcaaaattaattaattgacttttagcccaaatttacattgttaattaaatcaagaaggaagaagatctaagagctcccattgataggcaagcctagagagaactagctaaatttatcatgctaggatattgaaacacagaaagtttacatacatttatgaagggtcaatttagtttggacagtgaggtatttgtcttagtggaaaaaaggagaattagtctgatcaaatcgtgaagtaatacagtgaacttgcaggtgcacaaaataagagggccacatctatatggtgcagtctggaattctgtttaagtttgtaggtacctcttggacttctgaattgatccagttgtcatccaccacagacatctcacatcagatacagacagttccaagattgacaacagagaacaacctgctggaaagacctgggcagaaatggagagccctgcgggaaccatgctacattttcatctaaagagagaatgcacatctgatgagactgaaagttctttgttgttttagattgtagaatggtattgaattggtctgtggaaaattgcattgcttttatttctttgtgtaatcaagtttaagtaataggggatatataatcataagcattttagggtgggagggactattaagtaattttaagtgggtggggttatttagaatgttagaataatattatgtattagatatcgctataagtggacatgcgtacttacttgtaaccctttaccctataattgctatccttaaagatttcaaataaactcggagggaactgcagggagaccaacttatttagagcgaattggacatggataaaaaccccagtgggagaaagttcaaaggtgattagattaataatttaatagaggatgagtgacctctgataaattactgctagaatgaacttgtcaatgatggatggtaaattttcatggaagttataaaagtgataaataaaaacccttgcttttacccctgtcagtagccctcctcctaccactgaaccccattgcccctacccctccttctaactttattgctgtattctcttcactctatatttctctctatttgctaatattgcattgctgttacaataaaaattcaataaagatttagtggttaagtgc

SEQ ID NO: 163940 - DNA, 2585 bp, Homo sapiens
  Payload ID: 12279
  Gene Symbol: PEG10
  Gene Name: paternally expressed 10
  ENST ID: ENST00000612748
  CDS Start-End: 218-2569
acacgcgcttcaacttcggttggtgtgtgtcgaagaaacctgactgcgccctgaggagaacagcggagaaggtccaccgagcctggcgaaaggtccgctgagcgggctgtcgtccggagccactccgggctgcggagcacccagtggagaccgcgcctggctcaggtgtgggaccccatccttcctgtcttcgcagaggagtcctcgcgtggtgagtatgcgaaataagcgggttttgaaaacaaaaaaaagaaggagtggaagagggggccaggatccaggcctccatccccacagaagtgaagctacagctgggaggtctcctcccaccccaaccgtcaccctgggtcccgactgcccacctcctcctcctccccctccccccaacaacaacaacaacaacaactccaagcacaccggccataagagtgcgtgtgtccccaacatgaccgaacgaagaagggacgagctctctgaagagatcaacaacttaagagagaaggtcatgaagcagtcggaggagaacaacaacctgcagagccaggtgcagaagctcacagaggagaacaccacccttcgagagcaagtggaacccacccctgaggatgaggatgatgacatcgagctccgcggtgctgcagcagctgctgccccaccccctccaatagaggaagagtgcccagaagacctcccagagaagttcgatggcaacccagacatgctggctcctttcatggcccagtgccagatcttcatggaaaagagcaccagggatttctcagttgatcgtgtccgtgtctgcttcgtgacaagcatgatgaccggccgtgctgcccgttgggcctcagcaaagctggagcgctcccactacctgatgcacaactacccagctttcatgatggaaatgaagcatgtctttgaagaccctcagaggcgagaggttgccaaacgcaagatcagacgcctgcgccaaggcatggggtctgtcatcgactactccaatgctttccagatgattgcccaggacctggattggaacgagcctgcgctgattgaccagtaccacgagggcctcagcgaccacattcaggaggagctctcccacctcgaggtcgccaagtcgctgtctgctctgattgggcagtgcattcacattgagagaaggctggccagggctgctgcagctcgcaagccacgctcgccaccccgggcgctggtgttgcctcacattgcaagccaccaccaggtagatccaaccgagccggtgggaggtgcccgcatgcgcctgacgcaggaagaaaaagaaagacgcagaaagctgaacctgtgcctctactgtggaacaggaggtcactacgctgacaattgtcctgccaaggcctcaaagtcttcgccggggaaactccccggccccgctgtagagggaccttcagcgaccgggccagaaataataaggtccccacaagatgatgcctcatctccacacttgcaagtgatgctccagattcatcttccgggcagacacaccctgttcgtccgagccatgatcgattctggtgcttctggcaacttcattgatcacgaatatgttgctcaaaatggaattcctctaagaatcaaggactggccaatacttgtggaagcaattgatgggcgccccatagcatcgggcccagttgtccacgaaactcacgacctgatagttgacctgggagatcaccgagaggtgctgtcatttgatgtgactcagtctccattcttccctgtcgtcctaggggttcgctggctgagcacacatgatcccaatatcacatggagcactcgatctatcgtctttgattctgaatactgccgctaccactgccggatgtattctccaataccaccatcgctcccaccaccagcaccacaaccgccactctattatccagtagatggatacagagtttaccaaccagtgaggtattactatgtccagaatgtgtacactccagtagatgagcacgtctacccagatcaccgcctggttgaccctcacatagaaatgatacctggagcacacagtattcccagtggacatgtgtattcactgtccgaacctgaaatggcagctcttcgagattttgtggcaagaaatgtaaaagatgggctaattactccaacgattgcacctaatggagcccaagttctccaggtgaagagggggtggaaactgcaagtttcttatgattgccgagctccaaacaattttactatccagaatcagtatcctcgcctatctattccaaatttagaagaccaagcacacctggcaacgtacactgaattcgtacctcaaatacctggataccaaacataccccacatatgccgcgtacccgacctacccagtaggattcgcctggtacccagtgggacgagacggacaaggaagatcactatatgtacctgtgatgatcacttggaatccacactggtaccgccagcctccggtaccacagtacccgccgccacagccgccgcctccaccaccaccaccgccgccgcctccatcttacagtaccctgtaaatacctgtcatgtcct

SEQ ID NO: 163941 - DNA, 6392 bp, Homo sapiens; identical to SEQ ID NO: 163939
  Payload ID: 12279
  Gene Symbol: PEG10
  Gene Name: paternally expressed 10
  ENST ID: ENST00000617526
  CDS Start-End: 259-2382

SEQ ID NO: 163942 - DNA, 574 bp, Homo sapiens
  Payload ID: 12279
  Gene Symbol: PEG10
  Gene Name: paternally expressed 10
  ENST ID: ENST00000613043
  CDS Start-End: 481-574
ttcggttggtgtgtgtcgaagaaacctgactgcgccctgaggagaacagcggagaaggtccaccgagcctggcgaaaggtccgctgagcgggctgtcgtccggagccactccgggctgcggagcacccagtggagaccgcgcctggctcaggtgtgggaccccatccttcctgtcttcgcagaggagtcctcgcgtgataataaaaccatcagacctgggcttcaataaagccccacttagtggccgtgattgacaaaaataagcgggttttgaaaacaaaaaaaagaaggagtggaagagggggccaggatccaggcctccatccccacagaagtgaagctacagctgggaggtctcctcccaccccaaccgtcaccctgggtcccgactgcccacctcctcctcctccccctccccccaacaacaacaacaacaacaactccaagcacaccggccataagagtgcgtgtgtccccaacatgaccgaacgaagaagggacgagctctctgaagagatcaacaacttaagagagaaggtcatgaagcagtcggaggagaacaacaacctgcaga

SEQ ID NO: 163943 - DNA, 6394 bp, Homo sapiens
  Payload ID: 12279
  Gene Symbol: PEG10
  Gene Name: paternally expressed 10
  ENST ID: ENST00000615790
  CDS Start-End: 157-1236
catccttcctgtcttcgcagaggagtcctcgcgtgaaataagcgggttttgaaaacaaaaaaaagaaggagtggaagagggggccaggatccaggcctccatccccacagaagtgaagctacagctgggaggtctcctcccaccccaaccgtcaccctgggtcccgactgcccacctcctcctcctccccctccccccaacaacaacaacaacaacaactccaagcacaccggccataagagtgcgtgtgtccccaacatgaccgaacgaagaagggacgagctctctgaagagatcaacaacttaagagagaaggtcatgaagcagtcggaggagaacaacaacctgcagagccaggtgcagaagctcacagaggagaacaccacccttcgagagcaagtggaacccacccctgaggatgaggatgatgacatcgagctccgcggtgctgcagcagctgctgccccaccccctccaatagaggaagagtgcccagaagacctcccagagaagttcgatggcaacccagacatgctggctcctttcatggcccagtgccagatcttcatggaaaagagcaccagggatttctcagttgatcgtgtccgtgtctgcttcgtgacaagcatgatgaccggccgtgctgcccgttgggcctcagcaaagctggagcgctcccactacctgatgcacaactacccagctttcatgatggaaatgaagcatgtctttgaagaccctcagaggcgagaggttgccaaacgcaagatcagacgcctgcgccaaggcatggggtctgtcatcgactactccaatgctttccagatgattgcccaggacctggattggaacgagcctgcgctgattgaccagtaccacgagggcctcagcgaccacattcaggaggagctctcccacctcgaggtcgccaagtcgctgtctgctctgattgggcagtgcattcacattgagagaaggctggccagggctgctgcagctcgcaagccacgctcgccaccccgggcgctggtgttgcctcacattgcaagccaccaccaggtagatccaaccgagccggtgggaggtgcccgcatgcgcctgacgcaggaagaaaaagaaagacgcagaaagctgaacctgtgcctctactgtggaacaggaggtcactacgctgacaattgtcctgccaaggcctcaaagtcttcgccggcgggaaactccccggccccgctgtagagggaccttcagcgaccgggccagaaataataaggtccccacaagatgatgcctcatctccacacttgcaagtgatgctccagattcatcttccgggcagacacaccctgttcgtccgagccatgatcgattctggtgcttctggcaacttcattgatcacgaatatgttgctcaaaatggaattcctctaagaatcaaggactggccaatacttgtggaagcaattgatgggcgccccatagcatcgggcccagttgtccacgaaactcacgacctgatagttgacctgggagatcaccgagaggtgctgtcatttgatgtgactcagtctccattcttccctgtcgtcctaggggttcgctggctgagcacacatgatcccaatatcacatggagcactcgatctatcgtctttgattctgaatactgccgctaccactgccggatgtattctccaataccaccatcgctcccaccaccagcaccacaaccgccactctattatccagtagatggatacagagtttaccaaccagtgaggtattactatgtccagaatgtgtacactccagtagatgagcacgtctacccagatcaccgcctggttgaccctcacatagaaatgatacctggagcacacagtattcccagtggacatgtgtattcactgtccgaacctgaaatggcagctcttcgagattttgtggcaagaaatgtaaaagatgggctaattactccaacgattgcacctaatggagcccaagttctccaggtgaagagggggtggaaactgcaagtttcttatgattgccgagctccaaacaattttactatccagaatcagtatcctcgcctatctattccaaatttagaagaccaagcacacctggcaacgtacactgaattcgtacctcaaatacctggataccaaacataccccacatatgccgcgtacccgacctacccagtaggattcgcctggtacccagtgggacgagacggacaaggaagatcactatatgtacctgtgatgatcacttggaatccacactggtaccgccagcctccggtaccacagtacccgccgccacagccgccgcctccaccaccaccaccgccgccgcctccatcttacagtaccctgtaaatacctgtcatgtccttcaggatctctgccctcaaaatttattcctgttcagcttctcaatcagtgactgtgtgctaaattttaggctactgtatcttcaggccacctgaggcacatcctctctgaaacggctatggaaggttagggccactctggactggcacacatcctaaagcaccaaaagaccttcaacattttctgagagcaacagagtatttgccaataaatgatctctcatttttccaccttgactgccaatctaactaaaataattaataagtttactttccagccagtcctggaagtctgggttttacctgccaaaacctccatcaccatctaaattataggctgccaaatttgctgtttaacatttacagagaagctgatacaaacgcaggaaatgctgatttctttatggagggggagacgaggaggaggaggacatgacttttcttgcggtttcggtaccctctttttaaatcactggaggactgaggccttattaaggaagccaaaattatcggtgcagtgtggaaaggcttccgtgatcctctcgctgcacccttagaaacttcaccgtcttcaaactccatttccatggttctgttaattctcaaggagcagcaactcgactggttctcccaggagcaggaaaaacccttgtgacatgaaacatctcaggcctgaaaagaaagtgctctctcagatggactcttgcatgttaagactatgtcttcacatcatggtgcaaatcacatgtacccaatgactccggctttgacacaacaccttaccatcatcatgccatgatggcttccacaaagcattaaacctggtaaccagagattactggtggctccagcgttgttagatgttcatgaaatgtgaccacctctcaatcacctttgagggctaaagagtagcacatcaaaaggactccaaaatcccatacccaactcttaagagatttgtcctggtacttcagaaagaattttcatgagtgttcttaattggctggaaaagcaccagctgacgttttggaagaatctatccatgtgtctgcctccatatgcatctgggcatttcatcttcagtcccctcattagactgtagcattaggatgtgtggagagaggagaaatgatttagcacccagattcacactcctatgcctggaagggggacatctttgaagaagaggaattagggctgtggacactgtcttgaggatgtggacttccttagtgagctccacattacttgatggtaaccacttcaaaaggatcagaatccacgtaatgaaaaaggtccctctagaggatggagctgatgtgaagctgccaatggatgaaaagcctcagaaagcaactcaaaggactcaaagcaacggacaacacaagagttgtcttcagcccagtgacacctctgatgtcccctggaagctttgtgctaacctgggactgcctgacttcctttagcctggtcccttgctactaccttgaactgttttatctaacctctctttttctgtttaattctttgctactgccattgaccctgctgcaggatttgtgtcattttcctgcctggttgctgagactccattttgctgccacacacagagatgtaagaggcaggctttaattgccaaagcacagtttgagcagtagaaaacaacatggtgtatatctcaaattgcctgacatgaagaggagtctaacggtgaagtttcacttttcatcagcatcatctttcacatgttcattatcatctgctcttattcttgcatgtttaaacacttaaaatttttagtataatttttagtgtgttttgaagtggtgactaggctttcaaaaacttccattgaattacaaagcactatccagttcttattgttaaactaagtaaaaatgataagtaacatagtgtaaaatattcctttactgtgaacttcttacaatgctgtgaatgagaggctcctcagaactggagcatttgtataataattcatcctgttcatcttcaattttaacatcatatataatttcaattctatcaattgggcctttaaaaatcatataaaaggatataaaatttgaaaagagaaacctaattggctatttaatccaaaacaactttttttttccttcaatggaatcagaaagcttgtcaatcactcatgtgttttagagtaattacttttaaaatggtgcatttgtgcttctgaactattttgaagagtcacttctgtttacctcaagtatcaattcatcctccatacatttgaattcaagttgtttttttgtcaaatttacagttgtcaattgatcttcaagctgcagggtgcctagaaatgggccgttgtctgtagccctggcatgtgcacacggacatttgccaccactgcaagcaaaagtctggagaagttcaccaacgacaagaacgattagggaaaatatgctgctgtgggttaacaactcagaaagtccctgatccacatttggctgtttactaaagcttgtgattaactttttggcagtgtgtactatgctctattgctatatatgctatctataaatgtagatgttaaggataagtaattctaaatttattattctatagttttgaagtttggttaagtttcctttcactcaattgatttattttgttgttaatcaaatttatgttaattggatcctttaaattttttttggcattttccaacaaaaatggctttattcataagaaaggaaaaaaatcaatggaatttgatatctaaagaagttagaaagggagcaaaataaaaaacataaaggagatagatgaattagtaagcaaatcagtagtcgagtttttcaaactggcaaaattaattaattgacttttagcccaaatttacattgttaattaaatcaagaaggaagaagatctaagagctcccattgataggcaagcctagagagaactagctaaatttatcatgctaggatattgaaacacagaaagtttacatacatttatgaagggtcaatttagtttggacagtgaggtatttgtcttagtggaaaaaaggagaattagtctgatcaaatcgtgaagtaatacagtgaacttgcaggtgcacaaaataagagggccacatctatatggtgcagtctggaattctgtttaagtttgtaggtacctcttggacttctgaattgatccagttgtcatccaccacagacatctcacatcagatacagacagttccaagattgacaacagagaacaacctgctggaaagacctgggcagaaatggagagccctgcgggaaccatgctacattttcatctaaagagagaatgcacatctgatgagactgaaagttctttgttgttttagattgtagaatggtattgaattggtctgtggaaaattgcattgcttttatttctttgtgtaatcaagtttaagtaataggggatatataatcataagcattttagggtgggagggactattaagtaattttaagtgggtggggttatttagaatgttagaataatattatgtattagatatcgctataagtggacatgcgtacttacttgtaaccctttaccctataattgctatccttaaagatttcaaataaactcggagggaactgcagggagaccaacttatttagagcgaattggacatggataaaaaccccagtgggagaaagttcaaaggtgattagattaataatttaatagaggatgagtgacctctgataaattactgctagaatgaacttgtcaatgatggatggtaaattttcatggaagttataaaagtgataaataaaaacccttgcttttacccctgtcagtagccctcctcctaccactgaaccccattgcccctacccctccttctaactttattgctgtattctcttcactctatatttctctctatttgctaatattgcattgctgttacaataaaaattcaataaagatttagtggttaagtgc

SEQ ID NO: 163944 - DNA, 8723 bp, Homo sapiens
  Payload ID: 12280
  Gene Symbol: PEG3
  Gene Name: paternally expressed 3
  Uniprot ID: Q9GZU2
  ENST ID: ENST00000326441
  CDS Start-End: 365-5131
gtttgggaggcgcgggagatgtccaccctgggctggtggcgccgccgggcgccgggcgccatgagggtgcgctaggcggctgttcgtgcccgaggctgcgcagcactgaggtgagctttgccttcttgatcttccgtccttcttggagacgactggcgagaggaagagggactaggtccaaacgctaggtggctgggtccagatacctgtgttttgactctgttcctgtggatagctgcttggtctgaagttccagaaaggatcctgttcccagacaggtccctgagtactgacggtcacaggctgccgcgtctttcctgttgactcatgtttggttcctccagtgaaaattttacttagagaaatgctgcctccaaagcacttgtctgccaccaaacctaagaagtcctgggccccaaatctgtatgagctagacagtgacttgactaaggagccggatgtcatcataggagaaggtccaactgactctgagttttttcatcagaggtttcggaacctaatctatgtggaatttgttgggcctcggaagaccctgatcaaactccgaaacctctgcctcgattggttgcagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaagacgacaacaacagtgacgtgaccagcgacgacgacatgacccggaacagaagagagtcctcaccacctcactcagtccattctttcagtgaccgggactgggaccggaggggcagaagcagagacatggagccacgagaccgctggtcccacaccaggaacccaagaagcaggatgcctccgcgggatctttcccttcctgtggtggcgaaaacaagctttgaaatggacagagaggacgacagggactccagggcttatgagtcccgatctcaggatgctgaatcataccaaaatgtggtggacctcgctgaggacaggaaacctcacaacacaatccaggacaacatggaaaactacaggaagctgctctccctcgtgcagcttgctgaagacgatggccactcccacatgacgcagggccactcatcaagatccaagagaagtgcctacccaagcaccagtcgaggtctaaaaactatgcctgaagccaaaaaatcaacccaccggcgggggatttgtgaagatgaatcttcccacggagtgataatggaaaaattcatcaaggatgtgtcacgcagttccaaatcgggaagagcaagggagtcaagcgaccggtcacagagattccccagaatgtcagatgataactggaaggacatttcattgaacaagagggagtcagtgatccagcagcgggtttatgaagggaatgcatttaggggaggctttaggtttaattcaacccttgtttccagaaagagagttcttgaaagaaagaggcgctatcattttgacacagatgggaagggctcgattcacgatcaaaaaggctgtcccaggaagaagccctttgaatgtggtagtgagatgagaaaagccatgagcgtgagcagcctgagcagcctcagctccccctcctttaccgagtcacagccaattgattttggggcaatgccatatgtatgtgatgagtgtgggaggtcgttcagtgtcatctcagaatttgttgagcaccagatcatgcatactagagagaacctctatgagtatggtgagtcctttatccacagtgtggctgtcagtgaagttcagaaaagtcaggttggagggaaacgttttgaatgtaaggactgtggagagaccttcaataagagtgccgccttggctgaacatcggaagattcatgctagaggttatcttgtggaatgtaagaatcaggaatgtgaggaagccttcatgcctagccccacctttagtgagcttcagaaaatatatggcaaagacaaattctacgagtgcagggtgtgtaaggaaaccttccttcatagttctgccctgattgagcaccagaaaatccactttggggatgacaaagataatgagcgtgaacatgaacgtgaacgtgaacgtgagcgcggggaaacctttaggcccagcccagcccttaatgagtttcagaaaatgtatggtaaagagaaaatgtacgaatgtaaggtgtgtggggagactttccttcatagctcatccctgaaagaacatcagaaaatccatactagagggaacccatttgaaaacaagggtaaagtgtgtgaggaaacctttattcctggtcagtcccttaaaaggcgtcagaaaacttacaataaggagaagctctgtgactttacagatggccgggatgccttcatgcaaagctcagagctcagtgagcatcagaaaattcattctcgaaagaacctctttgaaggcagagggtatgagaaatctgtcattcatagtgggccattcactgaatctcagaagagtcatactataacaagacctcttgaaagtgatgaggacgaaaaggcgttcaccattagctctaacccctatgaaaaccagaagattcccactaaggaaaatgtctatgaggcaaaatcatatgagaggtctgttattcatagcttagcctctgtggaagctcagaaaagtcacagtgtagcagggcccagtaaaccaaaagtaatggcagagtctaccattcagagcttcgatgctatcaaccatcagagagttcgtgctggagggaacacctctgaaggaagggaatacagtaggtctgttatccatagcttagtggcttccaaacctccaagaagtcacaatggaaatgaattggtggaatctaatgagaagggagaatcctccatttatatctcagaccttaatgataagcgacagaagattcctgccagagagaacccttgtgaagggggcagtaagaatcgcaactatgaagactctgtcatacagagtgtattccgtgccaaacctcagaaaagtgttcctggagagggatctggtgagtttaagaaggatggcgaattctctgttcccagctcaaatgtccgtgaataccagaaggctcgtgctaaaaagaaatacattgagcataggagcaatgagacctctgtaattcactctctgccttttggtgaacaaacatttcgccctcgagggatgctctatgaatgtcaggagtgtggggagtgctttgctcatagctctgacctcactgagcaccagaagattcatgatagggagaagccctctggaagcagaaactatgaatggtctgtcattcgcagcttggcccctactgaccctcaaacaagttacgcccaagagcagtatgctaaagagcaagcgcggaacaaatgtaaggacttcagacaattttttgctaccagcgaagacctcaacacaaaccagaaaatctatgaccaagagaagtctcatggcgaggagtctcaaggcgagaatactgatggggaggagacccacagcgaggagacccatggtcaggagacaattgaagaccctgtcattcaaggctcagacatggaagaccctcagaaggatgaccctgatgacaaaatctatgaatgtgaggactgtggcctgggctttgtggatctcacagacctcacagaccatcagaaagtccacagcaggaagtgcctggttgacagtcgggagtacacacattctgtaattcacacccattccatcagcgagtatcagagagattacactggagagcagctgtatgaatgtccaaagtgtggggaatcttttattcatagctcattccttttcgagcatcagagaatccatgaacaagaccagttgtattccatgaaggggtgtgatgatggttttattgccctcttgcccatgaagccacggaggaatcgtgctgcagagaggaatcctgctcttgctgggtcggccattcgatgccttttgtgtggacaaggcttcattcatagctctgcccttaatgagcatatgagacttcatagggaagatgatttactggagcagagccagatggctgaggaagctatcattccaggcttagccctcactgagtttcagagaagtcagaccgaagagagactctttgaatgtgcagtctgtggagaatctttcgtcaacccagcagaacttgcagatcacgtaactgttcataagaatgagccctatgagtacgggtcctcctatactcacacctcatttcttactgagcccctcaaaggagctataccattctatgaatgcaaggattgtggtaagtcctttattcatagcacagtcctcactaaacataaggagcttcatctggaagaagaagaagaagatgaagcagcagcagctgcagcagcagcagcccaggaagttgaagccaatgtccatgttccacaagtagttctgaggattcagggcttaaacgtagaggctgctgagccagaagtggaggctgccgagccagaagtggaggctgctgagccagaagtggaggctgctgagccaaacggagaggctgaagggccagatggagaggctgcagagcccattggagaggctggacagccaaatggagaggccgagcagccaaatggggatgctgatgagccagatggtgcaggtattgaagacccagaagaaagagctgaagagccagagggaaaagctgaagagccagagggagatgccgacgagcctgacggtgtgggaattgaagacccagaagaaggtgaagatcaagagattcaggtagaagaaccatactatgactgccatgaatgcacagaaaccttcacttccagcacagcattcagtgaacacctgaaaactcatgccagcatgatcatatttgagcctgcaaatgcctttggggagtgctcaggctacatcgaacgtgccagcaccagcacaggtggtgccaatcaagctgatgagaagtacttcaaatgtgacgtctgtgggcagctcttcaatgaccgcctgtccctcgccagacaccagaatacccacactggctgagggcatggggtaaaggttagaaaaccttcacctaggacttgacccttaccaaaccacagagaatccaaaccaatccatgataatgtcagtaggagacttaaccttagtgtgttacacacctgacttaacatctctaaactcagattgaaaagagaccgaatgtgcagattccacagtcttaagctttccccttcagatgtcagtgtctgcatgtgggaaagccatagcacacatcttacctttccaagtaatcagattgagaaaaccctatgagtattccagactacagagtttgcccaaatcaactgtaaatgacacttgtgtaacgtatatatagtgtttcatgaggtgtatataaaatagcaaattatgacagaacagtgatcacatatatttggatttatatgatatacagttacagtttactctgcagaggtaccttacctggtattctttgaattttttttttttttggaggaggaagagagcaacaaatttgattatatttttaagtgtcttagatcctgagaaagatttattgtgcattatttgaaccctgtcaatatctttttgagtaattgttttgtttcttacccttaaatagtcttgtgaagctgtaggcatgatagataacatggcttttactccttactgtttgaaaagataagtactttagcttctttctgcagccatttcatctgcgccaacactttggaacctaatactgtgtaaggctttacaatatacggattggctttttgtgacccagattgattggttgccacatgttatgtttgttgaagtggttctcatgcaaaaatattacacatttgtgttctgggttttttttttttttaaccaactcaatatgtgtttgatgatagtgaattgataaaacccgaagcttttccctgtaaatcttacatctttgcctttaaagaatgggttacaaccatcactagatcacagtagtgcctaatgaaggttgagaaccgtaggagaggctctcatgctgtaaataatgttgcaggctaataacctttcatcacttcctttgtgcgcttcctgccttaagtgacaagtagcaacatggcttgggtcccctgtgcagcatcagcttatgctgccacaagtcagtttgcaccctaggtgcccaggagctagtatccttagatctttctatcgctaacttaattctcttcgttatttatctgaccctctaactccatgtctaacttgcattaaaaaaaaaaaaattctttacagtcaacccaagcttaacatggactcaggttccccagcagccttaatttgttttgttaacatctgttccttctttttcagctctcctagagtatttctgagtgttgtgttcatctaatcttagtattcttttaattacaaattgacctcacagcttgaggtttcttgtgtcctattctgtggactacctgtgctcctttgcttcccctcccctcgcataataactatattaagaaattttttttggccttgagttggctggaaaaaaaatataaaatttaaaaaatttaaaaaaaaagatttgcaaaatgtaagtgtagatcatttgaacaagcaaaattaaagtacccactgggggaaatgtgtctgaatcttactcttctggatctgcaggattagggcttggaagtatgtcaaagatgcagggagtgtcaaagtttaggaagattgtagagctgagagcaagaagcagaaatgagtgagtcaaagaagggagtcctaatatatcaccagatctaggaggggagaggagacagacagaagaaaacaccagaggcaagaactgtagaaggccaggtttctgagaatgaattgagcggggtgtcctgagcagtttggaaaaggagtttttgatggtatggtgtaggtgagggctggctgcataggaaggactgaggttggaacggacatcgggaaagctgaggggcagtgaggtttactacatgggaaaaggactcttgaaacgagaatcagtgttgatgtcggggtgaactttgtgggtacattacttggtgttaacattgttggcagtggtagccccttttcagaaagcaacttgctgtaagtcagggtgtccgttccaaccttcagctagtgaaaaggtagtaacaaatggtaaacaagagaatgattgtttaaacctatctgtggacacttaatgcaactgtttaaaaatgataatcacgagttatgtagcaacgtggaaatatatttacagaacattaagtggagaaagcaggacacgaaagtatatttatactacagttataactcaacagttcatttatatgctgttcatttaacagttcatttaaacagttcattataactgtttaaaaatatatatgcttatagtcaaaagctgttgtggtgttgttgttgtaggcttatagttgagcattattttcttaaatttcttgaatgttctttatggtagtgttactaaaaagtttatgatcacattttcattgtgaacataatttgaactcattatcacacacttggaaaatacagaaaagtggaggaaaaaaaatcatatccccaccatccaaagacatatactctcctcttatcttgttcattcttgtttctgtgcacaggtttatgattataactgtgtcaaaatgtatattcaaaatagctgttacattacctttgtggaattatggttaaatactttcactttaattttttcaaatgttccctataataatgtcctgataacagtgtattatgtgtgtctccattggtgtgcataatacatacccagaggaaaaattagaaaataaagtaaattattttaaaaaattacctatattcccaacacctaacaactactgctaacatcttgatctgtttcctctatcttgtttcagtgcacacgcttgtgataacagtgttaaatatgtgtgcataaagtcttaaatgaaaagatgtggaaaataactaaaatagtgttgtcattgtgggaatttggttaaatattttgtctcaaattccttaaataatctttggtgttttggtaataaattttatgtatgtattttccattacaaatataatacatactcatacaaaactttggaaattcagtaaagaaaattcacacatattcccaacacccaacaacaattaactgttaacatcttgatctgtgcactagtctgtgattattagggtgttagtgataagtatgcataaatgtcaaagatgggaagaaagatgaaaaacaagaaatagttgtgtggttgttgtgggattatggttattttgtttcggtttccttgaaaggtcatcattctagtgttttggtagtccacctttactacatatatttccattatatatgaaatgtgttcattatagaaactttgaagttacagaaatgtagaagagaaactcacccatgttttcaccatccaaagagtgtggttaacatcttgatatattttcttcatcttgtttctgtgcacaggtttttggtttgttaatatggttgtggtcattctatctgtaatagtgtcaacaataaaaataaagttaaaaataa

SEQ ID NO: 163945 - DNA, 411 bp, Homo sapiens
  Payload ID: 12280
  Gene Symbol: PEG3
  Gene Name: paternally expressed 3
  ENST ID: ENST00000594389
  CDS Start-End: 302-411
tgcgggaggagaggtttgggaggcgcgggagatgtccaccctgggctggtggcgccgccgggcgccgggcgccatgagggtgcgctaggcggctgttcgtgcccgaggctgcgcagcactgaggtgagctttgccttcttgatcttccgtccttcttggagacgactggcgagaggaagagggactaggtccaaacgctaggtggctgggtccaggtccctgagtactgacggtcacaggctgccgcgtctttcctgttgactcatgtttggttcctccagtgaaaattttacttagagaaatgctgcctccaaagcacttgtctgccaccaaacctaagaagtcctgggccccaaatctgtatgagctagacagtgacttgactaaggagccggatgtcatcataggaga

SEQ ID NO: 163946 - DNA, 5052 bp, Homo sapiens
  Payload ID: 12280
  Gene Symbol: PEG3
  Gene Name: paternally expressed 3
  Uniprot ID: Q9GZU2
  ENST ID: ENST00000599577
  CDS Start-End: 289-5052
gtttgggaggcgcgggagatgtccaccctgggctggtggcgccgccgggcgccgggcgccatgagggtgcgctaggcggctgttcgtgcccgaggctgcgcagcactgaggtgagctttgccttcttgatcttccgtccttcttggagacgactggcgagaggaagagggactaggtccaaacgctaggtggctgggtccaggtccctgagtactgacggtcacaggctgccgcgtctttcctgttgactcatgtttggttcctccagtgaaaattttacttagagaaatgctgcctccaaagcacttgtctgccaccaaacctaagaagtcctgggccccaaatctgtatgagctagacagtgacttgactaaggagccggatgtcatcataggagaaggtccaactgactctgagttttttcatcagaggtttcggaacctaatctatgtggaatttgttgggcctcggaagaccctgatcaaactccgaaacctctgcctcgattggttgcagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaagacgacaacaacagtgacgtgaccagcgacgacgacatgacccggaacagaagagagtcctcaccacctcactcagtccattctttcagtgaccgggactgggaccggaggggcagaagcagagacatggagccacgagaccgctggtcccacaccaggaacccaagaagcaggatgcctccgcgggatctttcccttcctgtggtggcgaaaacaagctttgaaatggacagagaggacgacagggactccagggcttatgagtcccgatctcaggatgctgaatcataccaaaatgtggtggacctcgctgaggacaggaaacctcacaacacaatccaggacaacatggaaaactacaggaagctgctctccctcgtgcagcttgctgaagacgatggccactcccacatgacgcagggccactcatcaagatccaagagaagtgcctacccaagcaccagtcgaggtctaaaaactatgcctgaagccaaaaaatcaacccaccggcgggggatttgtgaagatgaatcttcccacggagtgataatggaaaaattcatcaaggatgtgtcacgcagttccaaatcgggaagagcaagggagtcaagcgaccggtcacagagattccccagaatgtcagatgataactggaaggacatttcattgaacaagagggagtcagtgatccagcagcgggtttatgaagggaatgcatttaggggaggctttaggtttaattcaacccttgtttccagaaagagagttcttgaaagaaagaggcgctatcattttgacacagatgggaagggctcgattcacgatcaaaaaggctgtcccaggaagaagccctttgaatgtggtagtgagatgagaaaagccatgagcgtgagcagcctgagcagcctcagctccccctcctttaccgagtcacagccaattgattttggggcaatgccatatgtatgtgatgagtgtgggaggtcgttcagtgtcatctcagaatttgttgagcaccagatcatgcatactagagagaacctctatgagtatggtgagtcctttatccacagtgtggctgtcagtgaagttcagaaaagtcaggttggagggaaacgttttgaatgtaaggactgtggagagaccttcaataagagtgccgccttggctgaacatcggaagattcatgctagaggttatcttgtggaatgtaagaatcaggaatgtgaggaagccttcatgcctagccccacctttagtgagcttcagaaaatatatggcaaagacaaattctacgagtgcagggtgtgtaaggaaaccttccttcatagttctgccctgattgagcaccagaaaatccactttggggatgacaaagataatgagcgtgaacatgaacgtgaacgtgaacgtgagcgcggggaaacctttaggcccagcccagcccttaatgagtttcagaaaatgtatggtaaagagaaaatgtacgaatgtaaggtgtgtggggagactttccttcatagctcatccctgaaagaacatcagaaaatccatactagagggaacccatttgaaaacaagggtaaagtgtgtgaggaaacctttattcctggtcagtcccttaaaaggcgtcagaaaacttacaataaggagaagctctgtgactttacagatggccgggatgccttcatgcaaagctcagagctcagtgagcatcagaaaattcattctcgaaagaacctctttgaaggcagagggtatgagaaatctgtcattcatagtgggccattcactgaatctcagaagagtcatactataacaagacctcttgaaagtgatgaggacgaaaaggcgttcaccattagctctaacccctatgaaaaccagaagattcccactaaggaaaatgtctatgaggcaaaatcatatgagaggtctgttattcatagcttagcctctgtggaagctcagaaaagtcacagtgtagcagggcccagtaaaccaaaagtaatggcagagtctaccattcagagcttcgatgctatcaaccatcagagagttcgtgctggagggaacacctctgaaggaagggaatacagtaggtctgttatccatagcttagtggcttccaaacctccaagaagtcacaatggaaatgaattggtggaatctaatgagaagggagaatcctccatttatatctcagaccttaatgataagcgacagaagattcctgccagagagaacccttgtgaagggggcagtaagaatcgcaactatgaagactctgtcatacagagtgtattccgtgccaaacctcagaaaagtgttcctggagagggatctggtgagtttaagaaggatggcgaattctctgttcccagctcaaatgtccgtgaataccagaaggctcgtgctaaaaagaaatacattgagcataggagcaatgagacctctgtaattcactctctgccttttggtgaacaaacatttcgccctcgagggatgctctatgaatgtcaggagtgtggggagtgctttgctcatagctctgacctcactgagcaccagaagattcatgatagggagaagccctctggaagcagaaactatgaatggtctgtcattcgcagcttggcccctactgaccctcaaacaagttacgcccaagagcagtatgctaaagagcaagcgcggaacaaatgtaaggacttcagacaattttttgctaccagcgaagacctcaacacaaaccagaaaatctatgaccaagagaagtctcatggcgaggagtctcaaggcgagaatactgatggggaggagacccacagcgaggagacccatggtcaggagacaattgaagaccctgtcattcaaggctcagacatggaagaccctcagaaggatgaccctgatgacaaaatctatgaatgtgaggactgtggcctgggctttgtggatctcacagacctcacagaccatcagaaagtccacagcaggaagtgcctggttgacagtcgggagtacacacattctgtaattcacacccattccatcagcgagtatcagagagattacactggagagcagctgtatgaatgtccaaagtgtggggaatcttttattcatagctcattccttttcgagcatcagagaatccatgaacaagaccagttgtattccatgaaggggtgtgatgatggttttattgccctcttgcccatgaagccacggaggaatcgtgctgcagagaggaatcctgctcttgctgggtcggccattcgatgccttttgtgtggacaaggcttcattcatagctctgcccttaatgagcatatgagacttcatagggaagatgatttactggagcagagccagatggctgaggaagctatcattccaggcttagccctcactgagtttcagagaagtcagaccgaagagagactctttgaatgtgcagtctgtggagaatctttcgtcaacccagcagaacttgcagatcacgtaactgttcataagaatgagccctatgagtacgggtcctcctatactcacacctcatttcttactgagcccctcaaaggagctataccattctatgaatgcaaggattgtggtaagtcctttattcatagcacagtcctcactaaacataaggagcttcatctggaagaagaagaagaagatgaagcagcagcagctgcagcagcagcagcccaggaagttgaagccaatgtccatgttccacaagtagttctgaggattcagggcttaaacgtagaggctgctgagccagaagtggaggctgccgagccagaagtggaggctgctgagccagaagtggaggctgctgagccaaacggagaggctgaagggccagatggagaggctgcagagcccattggagaggctggacagccaaatggagaggccgagcagccaaatggggatgctgatgagccagatggtgcaggtattgaagacccagaagaaagagctgaagagccagagggaaaagctgaagagccagagggagatgccgacgagcctgacggtgtgggaattgaagacccagaagaaggtgaagatcaagagattcaggtagaagaaccatactatgactgccatgaatgcacagaaaccttcacttccagcacagcattcagtgaacacctgaaaactcatgccagcatgatcatatttgagcctgcaaatgcctttggggagtgctcaggctacatcgaacgtgccagcaccagcacaggtggtgccaatcaagctgatgagaagtacttcaaatgtgacgtctgtgggcagctcttcaatgaccgcctgtccctcgccagacaccagaatacccacactggc

SEQ ID NO: 163947 - DNA, 1558 bp, Homo sapiens
  Payload ID: 12280
  Gene Symbol: PEG3
  Gene Name: paternally expressed 3
  ENST ID: ENST00000600833
  CDS Start-End: 372-1558
ctccaaagcacttgtctgccaccaaacctaagaagtcctgggccccaaatctgtatgagctagacagtgacttgactaaggagccggatgtcatcataggagaaggtccaactgactctgagttttttcatcagaggtttcggaacctaatctatgtggaatttgttgggcctcggaagaccctgatcaaactccgaaacctctgcctcgattggttgcagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaagacgacaacaacagtgacgtgaccagcgacgacgacatgacccggaacagaagagagtcctcaccacctcactcagtccattctttcagtggtgaccgggactgggaccggaggggcagaagcagagacatggagccacgagaccgctggtcccacaccaggaacccaagaagcaggatgcctccgcgggatctttcccttcctgtggtggcgaaaacaagctttgaaatggacagagaggacgacagggactccagggcttatgagtcccgatctcaggatgctgaatcataccaaaatgtggtggacctcgctgaggacaggaaacctcacaacacaatccaggacaacatggaaaactacaggaagctgctctccctcggtctaaaaactatgcctgaagccaaaaaatcaacccaccggcgggggatttgtgaagatgaatcttcccacggagtgataatggaaaaattcatcaaggatgtgtcacgcagttccaaatcgggaagagcaagggagtcaagcgaccggtcacagagattccccagaatgtcagatgataactggaaggacatttcattgaacaagagggagtcagtgatccagcagcgggtttatgaagggaatgcatttaggggaggctttaggtttaattcaacccttgtttccagaaagagagttcttgaaagaaagaggcgctatcattttgacacagatgggaagggctcgattcacgatcaaaaaggctgtcccaggaagaagccctttgaatgtggtagtgagatgagaaaagccatgagcgtgagcagcctgagcagcctcagctccccctcctttaccgagtcacagccaattgattttggggcaatgccatatgtatgtgatgagtgtgggaggtcgttcagtgtcatctcagaatttgttgagcaccagatcatgcatactagagagaacctctatgagtatggtgagtcctttatccacagtgtggctgtcagtgaagttcagaaaagtcaggttggagggaaacgttttgaatgtaaggactgtggagagaccttcaataagagtgccgccttggctgaacatcggaagattcatgctagaggttatcttgtggaatgtaagaatcaggaatgtgaggaagccttcatgcctagccccacctttag

SEQ ID NO: 163948 - DNA, 5115 bp, Homo sapiens
  Payload ID: 12280
  Gene Symbol: PEG3
  Gene Name: paternally expressed 3
  Uniprot ID: Q9GZU2
  ENST ID: ENST00000599534
  CDS Start-End: 352-5115
acttctagggcattagacaagttgcccacagtcccaagttagtagcccaagttagtagccgagctaactcctcgagtaggtctctgtgaagcccagaggtcatgcttgtaactgctgtgctgaggccaactttgtgcggttgtttgcctatttactggggactcccatatcccaaaagcattgtcgatgcctctggtaaggtggcctccactgctgcctggtcttcaacttctgggacatgtgtatatctccttacgatccacaggtccctgagtactgacggtcacaggctgccgcgtctttcctgttgactcatgtttggttcctccagtgaaaattttacttagagaaatgctgcctccaaagcacttgtctgccaccaaacctaagaagtcctgggccccaaatctgtatgagctagacagtgacttgactaaggagccggatgtcatcataggagaaggtccaactgactctgagttttttcatcagaggtttcggaacctaatctatgtggaatttgttgggcctcggaagaccctgatcaaactccgaaacctctgcctcgattggttgcagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaagacgacaacaacagtgacgtgaccagcgacgacgacatgacccggaacagaagagagtcctcaccacctcactcagtccattctttcagtgaccgggactgggaccggaggggcagaagcagagacatggagccacgagaccgctggtcccacaccaggaacccaagaagcaggatgcctccgcgggatctttcccttcctgtggtggcgaaaacaagctttgaaatggacagagaggacgacagggactccagggcttatgagtcccgatctcaggatgctgaatcataccaaaatgtggtggacctcgctgaggacaggaaacctcacaacacaatccaggacaacatggaaaactacaggaagctgctctccctcgtgcagcttgctgaagacgatggccactcccacatgacgcagggccactcatcaagatccaagagaagtgcctacccaagcaccagtcgaggtctaaaaactatgcctgaagccaaaaaatcaacccaccggcgggggatttgtgaagatgaatcttcccacggagtgataatggaaaaattcatcaaggatgtgtcacgcagttccaaatcgggaagagcaagggagtcaagcgaccggtcacagagattccccagaatgtcagatgataactggaaggacatttcattgaacaagagggagtcagtgatccagcagcgggtttatgaagggaatgcatttaggggaggctttaggtttaattcaacccttgtttccagaaagagagttcttgaaagaaagaggcgctatcattttgacacagatgggaagggctcgattcacgatcaaaaaggctgtcccaggaagaagccctttgaatgtggtagtgagatgagaaaagccatgagcgtgagcagcctgagcagcctcagctccccctcctttaccgagtcacagccaattgattttggggcaatgccatatgtatgtgatgagtgtgggaggtcgttcagtgtcatctcagaatttgttgagcaccagatcatgcatactagagagaacctctatgagtatggtgagtcctttatccacagtgtggctgtcagtgaagttcagaaaagtcaggttggagggaaacgttttgaatgtaaggactgtggagagaccttcaataagagtgccgccttggctgaacatcggaagattcatgctagaggttatcttgtggaatgtaagaatcaggaatgtgaggaagccttcatgcctagccccacctttagtgagcttcagaaaatatatggcaaagacaaattctacgagtgcagggtgtgtaaggaaaccttccttcatagttctgccctgattgagcaccagaaaatccactttggggatgacaaagataatgagcgtgaacatgaacgtgaacgtgaacgtgagcgcggggaaacctttaggcccagcccagcccttaatgagtttcagaaaatgtatggtaaagagaaaatgtacgaatgtaaggtgtgtggggagactttccttcatagctcatccctgaaagaacatcagaaaatccatactagagggaacccatttgaaaacaagggtaaagtgtgtgaggaaacctttattcctggtcagtcccttaaaaggcgtcagaaaacttacaataaggagaagctctgtgactttacagatggccgggatgccttcatgcaaagctcagagctcagtgagcatcagaaaattcattctcgaaagaacctctttgaaggcagagggtatgagaaatctgtcattcatagtgggccattcactgaatctcagaagagtcatactataacaagacctcttgaaagtgatgaggacgaaaaggcgttcaccattagctctaacccctatgaaaaccagaagattcccactaaggaaaatgtctatgaggcaaaatcatatgagaggtctgttattcatagcttagcctctgtggaagctcagaaaagtcacagtgtagcagggcccagtaaaccaaaagtaatggcagagtctaccattcagagcttcgatgctatcaaccatcagagagttcgtgctggagggaacacctctgaaggaagggaatacagtaggtctgttatccatagcttagtggcttccaaacctccaagaagtcacaatggaaatgaattggtggaatctaatgagaagggagaatcctccatttatatctcagaccttaatgataagcgacagaagattcctgccagagagaacccttgtgaagggggcagtaagaatcgcaactatgaagactctgtcatacagagtgtattccgtgccaaacctcagaaaagtgttcctggagagggatctggtgagtttaagaaggatggcgaattctctgttcccagctcaaatgtccgtgaataccagaaggctcgtgctaaaaagaaatacattgagcataggagcaatgagacctctgtaattcactctctgccttttggtgaacaaacatttcgccctcgagggatgctctatgaatgtcaggagtgtggggagtgctttgctcatagctctgacctcactgagcaccagaagattcatgatagggagaagccctctggaagcagaaactatgaatggtctgtcattcgcagcttggcccctactgaccctcaaacaagttacgcccaagagcagtatgctaaagagcaagcgcggaacaaatgtaaggacttcagacaattttttgctaccagcgaagacctcaacacaaaccagaaaatctatgaccaagagaagtctcatggcgaggagtctcaaggcgagaatactgatggggaggagacccacagcgaggagacccatggtcaggagacaattgaagaccctgtcattcaaggctcagacatggaagaccctcagaaggatgaccctgatgacaaaatctatgaatgtgaggactgtggcctgggctttgtggatctcacagacctcacagaccatcagaaagtccacagcaggaagtgcctggttgacagtcgggagtacacacattctgtaattcacacccattccatcagcgagtatcagagagattacactggagagcagctgtatgaatgtccaaagtgtggggaatcttttattcatagctcattccttttcgagcatcagagaatccatgaacaagaccagttgtattccatgaaggggtgtgatgatggttttattgccctcttgcccatgaagccacggaggaatcgtgctgcagagaggaatcctgctcttgctgggtcggccattcgatgccttttgtgtggacaaggcttcattcatagctctgcccttaatgagcatatgagacttcatagggaagatgatttactggagcagagccagatggctgaggaagctatcattccaggcttagccctcactgagtttcagagaagtcagaccgaagagagactctttgaatgtgcagtctgtggagaatctttcgtcaacccagcagaacttgcagatcacgtaactgttcataagaatgagccctatgagtacgggtcctcctatactcacacctcatttcttactgagcccctcaaaggagctataccattctatgaatgcaaggattgtggtaagtcctttattcatagcacagtcctcactaaacataaggagcttcatctggaagaagaagaagaagatgaagcagcagcagctgcagcagcagcagcccaggaagttgaagccaatgtccatgttccacaagtagttctgaggattcagggcttaaacgtagaggctgctgagccagaagtggaggctgccgagccagaagtggaggctgctgagccagaagtggaggctgctgagccaaacggagaggctgaagggccagatggagaggctgcagagcccattggagaggctggacagccaaatggagaggccgagcagccaaatggggatgctgatgagccagatggtgcaggtattgaagacccagaagaaagagctgaagagccagagggaaaagctgaagagccagagggagatgccgacgagcctgacggtgtgggaattgaagacccagaagaaggtgaagatcaagagattcaggtagaagaaccatactatgactgccatgaatgcacagaaaccttcacttccagcacagcattcagtgaacacctgaaaactcatgccagcatgatcatatttgagcctgcaaatgcctttggggagtgctcaggctacatcgaacgtgccagcaccagcacaggtggtgccaatcaagctgatgagaagtacttcaaatgtgacgtctgtgggcagctcttcaatgaccgcctgtccctcgccagacaccagaatacccacactggc

SEQ ID NO: 163949 - DNA, 4741 bp, Homo sapiens
  Payload ID: 12280
  Gene Symbol: PEG3
  Gene Name: paternally expressed 3
  Uniprot ID: Q9GZU2
  ENST ID: ENST00000593695
  CDS Start-End: 353-4741
gtttgggaggcgcgggagatgtccaccctgggctggtggcgccgccgggcgccgggcgccatgagggtgcgctaggcggctgttcgtgcccgaggctgcgcagcactgaggtgagctttgccttcttgatcttccgtccttcttggagacgactggcgagaggaagagggactaggtccaaacgctaggtggctgggtccagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaagacgacaacaacagtgacgtgaccagcgacgacgacatgacccggaacagaagagagtcctcaccacctcactcagtccattctttcagtgaccgggactgggaccggaggggcagaagcagagacatggagccacgagaccgctggtcccacaccaggaacccaagaagcaggatgcctccgcgggatctttcccttcctgtggtggcgaaaacaagctttgaaatggacagagaggacgacagggactccagggcttatgagtcccgatctcaggatgctgaatcataccaaaatgtggtggacctcgctgaggacaggaaacctcacaacacaatccaggacaacatggaaaactacaggaagctgctctccctcgtgcagcttgctgaagacgatggccactcccacatgacgcagggccactcatcaagatccaagagaagtgcctacccaagcaccagtcgaggtctaaaaactatgcctgaagccaaaaaatcaacccaccggcgggggatttgtgaagatgaatcttcccacggagtgataatggaaaaattcatcaaggatgtgtcacgcagttccaaatcgggaagagcaagggagtcaagcgaccggtcacagagattccccagaatgtcagatgataactggaaggacatttcattgaacaagagggagtcagtgatccagcagcgggtttatgaagggaatgcatttaggggaggctttaggtttaattcaacccttgtttccagaaagagagttcttgaaagaaagaggcgctatcattttgacacagatgggaagggctcgattcacgatcaaaaaggctgtcccaggaagaagccctttgaatgtggtagtgagatgagaaaagccatgagcgtgagcagcctgagcagcctcagctccccctcctttaccgagtcacagccaattgattttggggcaatgccatatgtatgtgatgagtgtgggaggtcgttcagtgtcatctcagaatttgttgagcaccagatcatgcatactagagagaacctctatgagtatggtgagtcctttatccacagtgtggctgtcagtgaagttcagaaaagtcaggttggagggaaacgttttgaatgtaaggactgtggagagaccttcaataagagtgccgccttggctgaacatcggaagattcatgctagaggttatcttgtggaatgtaagaatcaggaatgtgaggaagccttcatgcctagccccacctttagtgagcttcagaaaatatatggcaaagacaaattctacgagtgcagggtgtgtaaggaaaccttccttcatagttctgccctgattgagcaccagaaaatccactttggggatgacaaagataatgagcgtgaacatgaacgtgaacgtgaacgtgagcgcggggaaacctttaggcccagcccagcccttaatgagtttcagaaaatgtatggtaaagagaaaatgtacgaatgtaaggtgtgtggggagactttccttcatagctcatccctgaaagaacatcagaaaatccatactagagggaacccatttgaaaacaagggtaaagtgtgtgaggaaacctttattcctggtcagtcccttaaaaggcgtcagaaaacttacaataaggagaagctctgtgactttacagatggccgggatgccttcatgcaaagctcagagctcagtgagcatcagaaaattcattctcgaaagaacctctttgaaggcagagggtatgagaaatctgtcattcatagtgggccattcactgaatctcagaagagtcatactataacaagacctcttgaaagtgatgaggacgaaaaggcgttcaccattagctctaacccctatgaaaaccagaagattcccactaaggaaaatgtctatgaggcaaaatcatatgagaggtctgttattcatagcttagcctctgtggaagctcagaaaagtcacagtgtagcagggcccagtaaaccaaaagtaatggcagagtctaccattcagagcttcgatgctatcaaccatcagagagttcgtgctggagggaacacctctgaaggaagggaatacagtaggtctgttatccatagcttagtggcttccaaacctccaagaagtcacaatggaaatgaattggtggaatctaatgagaagggagaatcctccatttatatctcagaccttaatgataagcgacagaagattcctgccagagagaacccttgtgaagggggcagtaagaatcgcaactatgaagactctgtcatacagagtgtattccgtgccaaacctcagaaaagtgttcctggagagggatctggtgagtttaagaaggatggcgaattctctgttcccagctcaaatgtccgtgaataccagaaggctcgtgctaaaaagaaatacattgagcataggagcaatgagacctctgtaattcactctctgccttttggtgaacaaacatttcgccctcgagggatgctctatgaatgtcaggagtgtggggagtgctttgctcatagctctgacctcactgagcaccagaagattcatgatagggagaagccctctggaagcagaaactatgaatggtctgtcattcgcagcttggcccctactgaccctcaaacaagttacgcccaagagcagtatgctaaagagcaagcgcggaacaaatgtaaggacttcagacaattttttgctaccagcgaagacctcaacacaaaccagaaaatctatgaccaagagaagtctcatggcgaggagtctcaaggcgagaatactgatggggaggagacccacagcgaggagacccatggtcaggagacaattgaagaccctgtcattcaaggctcagacatggaagaccctcagaaggatgaccctgatgacaaaatctatgaatgtgaggactgtggcctgggctttgtggatctcacagacctcacagaccatcagaaagtccacagcaggaagtgcctggttgacagtcgggagtacacacattctgtaattcacacccattccatcagcgagtatcagagagattacactggagagcagctgtatgaatgtccaaagtgtggggaatcttttattcatagctcattccttttcgagcatcagagaatccatgaacaagaccagttgtattccatgaaggggtgtgatgatggttttattgccctcttgcccatgaagccacggaggaatcgtgctgcagagaggaatcctgctcttgctgggtcggccattcgatgccttttgtgtggacaaggcttcattcatagctctgcccttaatgagcatatgagacttcatagggaagatgatttactggagcagagccagatggctgaggaagctatcattccaggcttagccctcactgagtttcagagaagtcagaccgaagagagactctttgaatgtgcagtctgtggagaatctttcgtcaacccagcagaacttgcagatcacgtaactgttcataagaatgagccctatgagtacgggtcctcctatactcacacctcatttcttactgagcccctcaaaggagctataccattctatgaatgcaaggattgtggtaagtcctttattcatagcacagtcctcactaaacataaggagcttcatctggaagaagaagaagaagatgaagcagcagcagctgcagcagcagcagcccaggaagttgaagccaatgtccatgttccacaagtagttctgaggattcagggcttaaacgtagaggctgctgagccagaagtggaggctgccgagccagaagtggaggctgctgagccagaagtggaggctgctgagccaaacggagaggctgaagggccagatggagaggctgcagagcccattggagaggctggacagccaaatggagaggccgagcagccaaatggggatgctgatgagccagatggtgcaggtattgaagacccagaagaaagagctgaagagccagagggaaaagctgaagagccagagggagatgccgacgagcctgacggtgtgggaattgaagacccagaagaaggtgaagatcaagagattcaggtagaagaaccatactatgactgccatgaatgcacagaaaccttcacttccagcacagcattcagtgaacacctgaaaactcatgccagcatgatcatatttgagcctgcaaatgcctttggggagtgctcaggctacatcgaacgtgccagcaccagcacaggtggtgccaatcaagctgatgagaagtacttcaaatgtgacgtctgtgggcagctcttcaatgaccgcctgtccctcgccagacaccagaatacccacactggctga

SEQ ID NO: 163950 - DNA, 5304 bp, Homo sapiens
  Payload ID: 12280
  Gene Symbol: PEG3
  Gene Name: paternally expressed 3
  Uniprot ID: Q9GZU2
  ENST ID: ENST00000598410
  CDS Start-End: 383-4777
gcagaagtctgggcagctgcgggaggagaggtttgggaggcgcgggagatgtccaccctgggctggtggcgccgccgggcgccgggcgccatgagggtgcgctaggcggctgttcgtgcccgaggctgcgcagcactgaggtgagctttgccttcttgatcttccgtccttcttggagacgactggcgagaggaagagggactaggtccaaacgctaggtggctgggtccagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaagacgacaacaacagtgacgtgaccagcgacgacgacatgacccggaacagaagagagtcctcaccacctcactcagtccattctttcagtggtgaccgggactgggaccggaggggcagaagcagagacatggagccacgagaccgctggtcccacaccaggaacccaagaagcaggatgcctccgcgggatctttcccttcctgtggtggcgaaaacaagctttgaaatggacagagaggacgacagggactccagggcttatgagtcccgatctcaggatgctgaatcataccaaaatgtggtggacctcgctgaggacaggaaacctcacaacacaatccaggacaacatggaaaactacaggaagctgctctccctcggagtgcagcttgctgaagacgatggccactcccacatgacgcagggccactcatcaagatccaagagaagtgcctacccaagcaccagtcgaggtctaaaaactatgcctgaagccaaaaaatcaacccaccggcgggggatttgtgaagatgaatcttcccacggagtgataatggaaaaattcatcaaggatgtgtcacgcagttccaaatcgggaagagcaagggagtcaagcgaccggtcacagagattccccagaatgtcagatgataactggaaggacatttcattgaacaagagggagtcagtgatccagcagcgggtttatgaagggaatgcatttaggggaggctttaggtttaattcaacccttgtttccagaaagagagttcttgaaagaaagaggcgctatcattttgacacagatgggaagggctcgattcacgatcaaaaaggctgtcccaggaagaagccctttgaatgtggtagtgagatgagaaaagccatgagcgtgagcagcctgagcagcctcagctccccctcctttaccgagtcacagccaattgattttggggcaatgccatatgtatgtgatgagtgtgggaggtcgttcagtgtcatctcagaatttgttgagcaccagatcatgcatactagagagaacctctatgagtatggtgagtcctttatccacagtgtggctgtcagtgaagttcagaaaagtcaggttggagggaaacgttttgaatgtaaggactgtggagagaccttcaataagagtgccgccttggctgaacatcggaagattcatgctagaggttatcttgtggaatgtaagaatcaggaatgtgaggaagccttcatgcctagccccacctttagtgagcttcagaaaatatatggcaaagacaaattctacgagtgcagggtgtgtaaggaaaccttccttcatagttctgccctgattgagcaccagaaaatccactttggggatgacaaagataatgagcgtgaacatgaacgtgaacgtgaacgtgagcgcggggaaacctttaggcccagcccagcccttaatgagtttcagaaaatgtatggtaaagagaaaatgtacgaatgtaaggtgtgtggggagactttccttcatagctcatccctgaaagaacatcagaaaatccatactagagggaacccatttgaaaacaagggtaaagtgtgtgaggaaacctttattcctggtcagtcccttaaaaggcgtcagaaaacttacaataaggagaagctctgtgactttacagatggccgggatgccttcatgcaaagctcagagctcagtgagcatcagaaaattcattctcgaaagaacctctttgaaggcagagggtatgagaaatctgtcattcatagtgggccattcactgaatctcagaagagtcatactataacaagacctcttgaaagtgatgaggacgaaaaggcgttcaccattagctctaacccctatgaaaaccagaagattcccactaaggaaaatgtctatgaggcaaaatcatatgagaggtctgttattcatagcttagcctctgtggaagctcagaaaagtcacagtgtagcagggcccagtaaaccaaaagtaatggcagagtctaccattcagagcttcgatgctatcaaccatcagagagttcgtgctggagggaacacctctgaaggaagggaatacagtaggtctgttatccatagcttagtggcttccaaacctccaagaagtcacaatggaaatgaattggtggaatctaatgagaagggagaatcctccatttatatctcagaccttaatgataagcgacagaagattcctgccagagagaacccttgtgaagggggcagtaagaatcgcaactatgaagactctgtcatacagagtgtattccgtgccaaacctcagaaaagtgttcctggagagggatctggtgagtttaagaaggatggcgaattctctgttcccagctcaaatgtccgtgaataccagaaggctcgtgctaaaaagaaatacattgagcataggagcaatgagacctctgtaattcactctctgccttttggtgaacaaacatttcgccctcgagggatgctctatgaatgtcaggagtgtggggagtgctttgctcatagctctgacctcactgagcaccagaagattcatgatagggagaagccctctggaagcagaaactatgaatggtctgtcattcgcagcttggcccctactgaccctcaaacaagttacgcccaagagcagtatgctaaagagcaagcgcggaacaaatgtaaggacttcagacaattttttgctaccagcgaagacctcaacacaaaccagaaaatctatgaccaagagaagtctcatggcgaggagtctcaaggcgagaatactgatggggaggagacccacagcgaggagacccatggtcaggagacaattgaagaccctgtcattcaaggctcagacatggaagaccctcagaaggatgaccctgatgacaaaatctatgaatgtgaggactgtggcctgggctttgtggatctcacagacctcacagaccatcagaaagtccacagcaggaagtgcctggttgacagtcgggagtacacacattctgtaattcacacccattccatcagcgagtatcagagagattacactggagagcagctgtatgaatgtccaaagtgtggggaatcttttattcatagctcattccttttcgagcatcagagaatccatgaacaagaccagttgtattccatgaaggggtgtgatgatggttttattgccctcttgcccatgaagccacggaggaatcgtgctgcagagaggaatcctgctcttgctgggtcggccattcgatgccttttgtgtggacaaggcttcattcatagctctgcccttaatgagcatatgagacttcatagggaagatgatttactggagcagagccagatggctgaggaagctatcattccaggcttagccctcactgagtttcagagaagtcagaccgaagagagactctttgaatgtgcagtctgtggagaatctttcgtcaacccagcagaacttgcagatcacgtaactgttcataagaatgagccctatgagtacgggtcctcctatactcacacctcatttcttactgagcccctcaaaggagctataccattctatgaatgcaaggattgtggtaagtcctttattcatagcacagtcctcactaaacataaggagcttcatctggaagaagaagaagaagatgaagcagcagcagctgcagcagcagcagcccaggaagttgaagccaatgtccatgttccacaagtagttctgaggattcagggcttaaacgtagaggctgctgagccagaagtggaggctgccgagccagaagtggaggctgctgagccagaagtggaggctgctgagccaaacggagaggctgaagggccagatggagaggctgcagagcccattggagaggctggacagccaaatggagaggccgagcagccaaatggggatgctgatgagccagatggtgcaggtattgaagacccagaagaaagagctgaagagccagagggaaaagctgaagagccagagggagatgccgacgagcctgacggtgtgggaattgaagacccagaagaaggtgaagatcaagagattcaggtagaagaaccatactatgactgccatgaatgcacagaaaccttcacttccagcacagcattcagtgaacacctgaaaactcatgccagcatgatcatatttgagcctgcaaatgcctttggggagtgctcaggctacatcgaacgtgccagcaccagcacaggtggtgccaatcaagctgatgagaagtacttcaaatgtgacgtctgtgggcagctcttcaatgaccgcctgtccctcgccagacaccagaatacccacactggctgagggcatggggtaaaggttagaaaaccttcacctaggacttgacccttaccaaaccacagagaatccaaaccaatccatgataatgtcagtaggagacttaaccttagtgtgttacacacctgacttaacatctctaaactcagattgaaaagagaccgaatgtgcagattccacagtcttaagctttccccttcagatgtcagtgtctgcatgtgggaaagccatagcacacatcttacctttccaagtaatcagattgagaaaaccctatgagtattccagactacagagtttgcccaaatcaactgtaaatgacacttgtgtaacgtatatatagtgtttcatgaggtgtatataaaatagcaaattatgacagaacagtgatcacatatatttggatttatatgatatacagttacagtttactctgcagaggtaccttacctggtattctttgaattttttttttttttggaggaggaagagagcaacaaatttgattatatttttaagtgtcttagatcctg

SEQ ID NO: 163951 - DNA, 3711 bp, Homo sapiens
  Payload ID: 12281
  Gene Symbol: PAXIP1
  Gene Name: PAX interacting (with transcription-activation domain) protein 1
  Uniprot ID: Q6ZW49
  ENST ID: ENST00000397192
  CDS Start-End: 44-3253
cggggccgggcgccgccgcggagcctcccgggccgccgcgatcatgtcggaccaggcgcccaaagttcctgaggagatgttcagggaggtcaagtattacgcggtgggcgacatcgacccgcaggttattcagcttctcaaggctggaaaagcgaaggaagtttcctacaatgcactagcctcacacataatctcagaggatggggacaatccagaggtgggagaagctcgggaagtctttgacttacctgttgtaaagccttcttgggtgattctgtccgttcagtgtggaactcttctgccagtaaatggtttttctccagaatcatgtcagattttttttggaatcactgcctgcctttctcaggtgtcatctgaagacagaagtgccctgtgggctttggttacgttctatgggggagattgccagctaaccctcaataagaaatgcacgcatttgattgttccagagccaaagggggagaaatacgaatgtgctttaaagcgagcaagtattaaaattgtgactcctgactgggttctggattgcgtatcagagaaaaccaaaaaggacgaagcattttatcatcctcgtctgattatttatgaagaggaagaagaggaagaggaagaggaggaggaagtagaaaatgaggaacaagattctcagaatgagggtagtacagatgagaagtcaagccctgccagctctcaagaagggtctccttcaggtgaccagcagttttcacctaaatccaacactgaaaaatctaaaggggaattaatgtttgatgattcttcagattcatcaccggaaaaacaggagagaaatttaaactggaccccggccgaagtcccacagttagctgcagcaaaacgcaggctgcctcagggaaaggagcctgggttgattaacttgtgtgccaatgtcccacccgtcccaggtaacattttgccccctgaggtccggggtaatttaatggctgctggacaaaacctccaaagttctgaaagatcagaaatgatagctacctggagtccagctgtacggacactgaggaatattactaataatgctgacattcagcagatgaaccggccatcaaatgtagcacatatcttacagactctttcagcacctacgaaaaatttagaacagcaggtgaatcacagccagcagggacatacaaatgccaatgcagtgctgtttagccaagtgaaagtgactccagagacacacatgctacagcagcagcagcaggcccagcagcagcagcagcagcacccggttttacaccttcagccccagcagataatgcagctccagcagcagcagcagcagcagatctctcagcaaccttacccccagcagccgccgcatccattttcacagcaacagcagcagcagcagcaagcccatccgcatcagttttcacagcaacagctacagtttccacagcaacagttgcatcctccacagcagctgcatcgccctcagcagcagctccagccctttcagcagcagcatgccctgcagcagcagttccatcagctgcagcagcaccagctccagcagcagcagcttgcccagctccagcagcagcacagcctgctccagcagcagcagcaacagcagattcagcagcagcagctccagcgcatgcaccagcagcagcagcagcagcagatgcaaagtcagacagcgccacacttgagtcagacgtcacaggcgctgcagcatcaggttccacctcagcagcccccgcagcagcagcagcaacagcagccaccaccatcgcctcagcagcatcagctttttggacatgatccagcagtggagattccagaagaaggcttcttattgggatgtgtgtttgcaattgcggattatccagagcagatgtctgataagcaactgctggccacctggaaaaggataatccaggcacatggcggcactgttgaccccaccttcacgagtcgatgcacgcaccttctctgtgagagtcaagtcagcagcgcgtatgcacaggcaataagagaaagaaagagatgtgttactgcacactggttaaacacagtcttaaagaagaagaaaatggtaccgccgcaccgagcccttcacttcccagtggccttcccaccaggaggaaagccatgttcacagcatattatttctgtgactggatttgttgatagtgacagagatgacctaaaattaatggcttatttggcaggtgccaaatatacgggttatctatgccgcagcaacacagtcctcatctgtaaagaaccaactggtttaaagtatgaaaaagccaaagagtggaggataccctgtgtcaacgcccagtggcttggcgacattcttctgggaaactttgaggcactgaggcagattcagtatagtcgctacacggcattcagtctgcaggatccatttgcccctacccagcatttagttttaaatcttttagatgcttggagagttcccttaaaagtgtctgcagagttgttgatgagtataagactacctcccaaactgaaacagaatgaagtagctaatgtccagccttcttccaaaagagccagaattgaagacgtaccacctcccactaaaaagctaactccagaattgaccccttttgtgcttttcactggattcgagcctgtccaggttcaacagtatattaagaagctctacattcttggtggagaggttgcggagtctgcacagaagtgcacacacctcattgccagcaaagtgactcgcaccgtgaagttcctgacggcgatttctgtcgtgaagcacatagtgacgccagagtggctggaagaatgcttcaggtgtcagaagttcattgatgagcagaactacattctccgagatgctgaggcagaagtacttttctctttcagcttggaagaatccttaaaacgggcacacgtttctccactctttaaggcaaaatatttttacatcacacctggaatctgcccaagtctttccactatgaaggcaatcgtagagtgtgcaggaggaaaggtgttatccaagcagccatctttccggaagctcatggagcacaagcagaactcgagtttgtcggaaataattttaatatcctgtgaaaatgaccttcatttatgccgagaatattttgccagaggcatagatgttcacaatgcagagttcgttctgactggagtgctcactcaaacgctggactatgaatcatataagtttaactgatggcgtctaggctgccgtgcatgtcgactcctgcggtgcggggctggctgtctggctggcgaggagctgctgcgcttccttcacatgctcttgttttccagctgctttcctgggggatcagactgtgaagcaggaagacagatataataaatatactgcatctttttaagatgtgcaattttattctgaggaaacataaattatgttttgtattatatgactttaagagcccacattaggttttatgattcatttgccaggtttttaaatgttttcacaaaactgttacgggacttcaactagaaataaaatggtgtaaataaagaccttgctatctctaaattatggatgttaaagatttgaaatgttttgtactttgattatttttatttcttatactctgttttcttttatattgatatcttgcccacattttaaataaatgtacttttgaactt

SEQ ID NO: 163952 - DNA, 3827 bp, Homo sapiens
  Payload ID: 12281
  Gene Symbol: PAXIP1
  Gene Name: PAX interacting (with transcription-activation domain) protein 1
  Uniprot ID: Q6ZW49
  ENST ID: ENST00000404141
  CDS Start-End: 156-3365
ggcgggggagcggaccccgattcgcaggaccgggcccgggctgcgcgggcagggccgttggcggggcgagtgggggcgccgggcgccgcgggggccgggggcggggggtgggcggggccgggcgccgccgcggagcctcccgggccgccgcgatcatgtcggaccaggcgcccaaagttcctgaggagatgttcagggaggtcaagtattacgcggtgggcgacatcgacccgcaggttattcagcttctcaaggctggaaaagcgaaggaagtttcctacaatgcactagcctcacacataatctcagaggatggggacaatccagaggtgggagaagctcgggaagtctttgacttacctgttgtaaagccttcttgggtgattctgtccgttcagtgtggaactcttctgccagtaaatggtttttctccagaatcatgtcagattttttttggaatcactgcctgcctttctcaggtgtcatctgaagacagaagtgccctgtgggctttggttacgttctatgggggagattgccagctaaccctcaataagaaatgcacgcatttgattgttccagagccaaagggggagaaatacgaatgtgctttaaagcgagcaagtattaaaattgtgactcctgactgggttctggattgcgtatcagagaaaaccaaaaaggacgaagcattttatcatcctcgtctgattatttatgaagaggaagaagaggaagaggaagaggaggaggaagtagaaaatgaggaacaagattctcagaatgagggtagtacagatgagaagtcaagccctgccagctctcaagaagggtctccttcaggtgaccagcagttttcacctaaatccaacactgaaaaatctaaaggggaattaatgtttgatgattcttcagattcatcaccggaaaaacaggagagaaatttaaactggaccccggccgaagtcccacagttagctgcagcaaaacgcaggctgcctcagggaaaggagcctgggttgattaacttgtgtgccaatgtcccacccgtcccaggtaacattttgccccctgaggtccggggtaatttaatggctgctggacaaaacctccaaagttctgaaagatcagaaatgatagctacctggagtccagctgtacggacactgaggaatattactaataatgctgacattcagcagatgaaccggccatcaaatgtagcacatatcttacagactctttcagcacctacgaaaaatttagaacagcaggtgaatcacagccagcagggacatacaaatgccaatgcagtgctgtttagccaagtgaaagtgactccagagacacacatgctacagcagcagcagcaggcccagcagcagcagcagcagcacccggttttacaccttcagccccagcagataatgcagctccagcagcagcagcagcagcagatctctcagcaaccttacccccagcagccgccgcatccattttcacagcaacagcagcagcagcagcaagcccatccgcatcagttttcacagcaacagctacagtttccacagcaacagttgcatcctccacagcagctgcatcgccctcagcagcagctccagccctttcagcagcagcatgccctgcagcagcagttccatcagctgcagcagcaccagctccagcagcagcagcttgcccagctccagcagcagcacagcctgctccagcagcagcagcaacagcagattcagcagcagcagctccagcgcatgcaccagcagcagcagcagcagcagatgcaaagtcagacagcgccacacttgagtcagacgtcacaggcgctgcagcatcaggttccacctcagcagcccccgcagcagcagcagcaacagcagccaccaccatcgcctcagcagcatcagctttttggacatgatccagcagtggagattccagaagaaggcttcttattgggatgtgtgtttgcaattgcggattatccagagcagatgtctgataagcaactgctggccacctggaaaaggataatccaggcacatggcggcactgttgaccccaccttcacgagtcgatgcacgcaccttctctgtgagagtcaagtcagcagcgcgtatgcacaggcaataagagaaagaaagagatgtgttactgcacactggttaaacacagtcttaaagaagaagaaaatggtaccgccgcaccgagcccttcacttcccagtggccttcccaccaggaggaaagccatgttcacagcatattatttctgtgactggatttgttgatagtgacagagatgacctaaaattaatggcttatttggcaggtgccaaatatacgggttatctatgccgcagcaacacagtcctcatctgtaaagaaccaactggtttaaagtatgaaaaagccaaagagtggaggataccctgtgtcaacgcccagtggcttggcgacattcttctgggaaactttgaggcactgaggcagattcagtatagtcgctacacggcattcagtctgcaggatccatttgcccctacccagcatttagttttaaatcttttagatgcttggagagttcccttaaaagtgtctgcagagttgttgatgagtataagactacctcccaaactgaaacagaatgaagtagctaatgtccagccttcttccaaaagagccagaattgaagacgtaccacctcccactaaaaagctaactccagaattgaccccttttgtgcttttcactggattcgagcctgtccaggttcaacagtatattaagaagctctacattcttggtggagaggttgcggagtctgcacagaagtgcacacacctcattgccagcaaagtgactcgcaccgtgaagttcctgacggcgatttctgtcgtgaagcacatagtgacgccagagtggctggaagaatgcttcaggtgtcagaagttcattgatgagcagaactacattctccgagatgctgaggcagaagtacttttctctttcagcttggaagaatccttaaaacgggcacacgtttctccactctttaaggcaaaatatttttacatcacacctggaatctgcccaagtctttccactatgaaggcaatcgtagagtgtgcaggaggaaaggtgttatccaagcagccatctttccggaagctcatggagcacaagcagaactcgagtttgtcggaaataattttaatatcctgtgaaaatgaccttcatttatgccgagaatattttgccagaggcatagatgttcacaatgcagagttcgttctgactggagtgctcactcaaacgctggactatgaatcatataagtttaactgatggcgtctaggctgccgtgcatgtcgactcctgcggtgcggggctggctgtctggctggcgaggagctgctgcgcttccttcacatgctcttgttttccagctgctttcctgggggatcagactgtgaagcaggaagacagatataataaatatactgcatctttttaagatgtgcaattttattctgaggaaacataaattatgttttgtattatatgactttaagagcccacattaggttttatgattcatttgccaggtttttaaatgttttcacaaaactgttacgggacttcaactagaaataaaatggtgtaaataaagaccttgctatctctaaattatggatgttaaagatttgaaatgttttgtactttgattatttttatttcttatactctgttttcttttatattgatatcttgcccacattttaaataaatgtacttttgaacttagaa

SEQ ID NO: 163953 - DNA, 521 bp, Homo sapiens
  Payload ID: 12281
  Gene Symbol: PAXIP1
  Gene Name: PAX interacting (with transcription-activation domain) protein 1
  ENST ID: ENST00000419436
  CDS Start-End: 1-521
aaagttcctgaggagatgttcagggaggtcaagtattacgcggtgggcgacatcgacccgcaggttattcagcttctcaaggctggaaaagcgaaggaagtttcctacaatgcactagcctcacacataatctcagaggatggggacaatccagaggtgggagaagctcgggaagtctttgacttacctgttgtaaaggtgtcatctgaagacagaagtgccctgtgggctttggttacgttctatgggggagattgccagctaaccctcaataagaaatgcacgcatttgattgttccagagccaaagggggagaaatacgaatgtgctttaaagcgagcaagtattaaaattgtgactcctgactgggttctggattgcgtatcagagaaaaccaaaaaggacgaagcattttatcatcctcgtctgattatttatgaagaggaagaagaggaagaggaagaggaggaggaagtagaaaatgaggaacaagattctcagaatgagggtagtacagatga

SEQ ID NO: 163954 - DNA, 3990 bp, Homo sapiens
  Payload ID: 12281
  Gene Symbol: PAXIP1
  Gene Name: PAX interacting (with transcription-activation domain) protein 1
  ENST ID: ENST00000457196
  CDS Start-End: 156-599
ggcgggggagcggaccccgattcgcaggaccgggcccgggctgcgcgggcagggccgttggcggggcgagtgggggcgccgggcgccgcgggggccgggggcggggggtgggcggggccgggcgccgccgcggagcctcccgggccgccgcgatcatgtcggaccaggcgcccaaagttcctgaggagatgttcagggaggtcaagtattacgcggtgggcgacatcgacccgcaggttattcagcttctcaaggctggaaaagcgaaggaagtttcctacaatgcactagcctcacacataatctcagaggatggggacaatccagaggtgggagaagctcgggaagtctttgacttacctgttgtaaagccttcttgggtgattctgtccgttcagtgtggaactcttctgccagtaaatggtttttctccagaatcatgtcagattttttttggaatcactgcctgcctttctcagggtgttgatacaagctggagctctttgttggagtcttccagagctctcccagggagaggtagggaagggagcttgtccagcagaagttgggaagcacagagatcatctgccttcttctgacccggtattgatgcaggctgaggcctctgttgtaatgtgctgggtgtcatctgaagacagaagtgccctgtgggctttggttacgttctatgggggagattgccagctaaccctcaataagaaatgcacgcatttgattgttccagagccaaagggggagaaatacgaatgtgctttaaagcgagcaagtattaaaattgtgactcctgactgggttctggattgcgtatcagagaaaaccaaaaaggacgaagcattttatcatcctcgtctgattatttatgaagaggaagaagaggaagaggaagaggaggaggaagtagaaaatgaggaacaagattctcagaatgagggtagtacagatgagaagtcaagccctgccagctctcaagaagggtctccttcaggtgaccagcagttttcacctaaatccaacactgaaaaatctaaaggggaattaatgtttgatgattcttcagattcatcaccggaaaaacaggagagaaatttaaactggaccccggccgaagtcccacagttagctgcagcaaaacgcaggctgcctcagggaaaggagcctgggttgattaacttgtgtgccaatgtcccacccgtcccaggtaacattttgccccctgaggtccggggtaatttaatggctgctggacaaaacctccaaagttctgaaagatcagaaatgatagctacctggagtccagctgtacggacactgaggaatattactaataatgctgacattcagcagatgaaccggccatcaaatgtagcacatatcttacagactctttcagcacctacgaaaaatttagaacagcaggtgaatcacagccagcagggacatacaaatgccaatgcagtgctgtttagccaagtgaaagtgactccagagacacacatgctacagcagcagcagcaggcccagcagcagcagcagcagcacccggttttacaccttcagccccagcagataatgcagctccagcagcagcagcagcagcagatctctcagcaaccttacccccagcagccgccgcatccattttcacagcaacagcagcagcagcagcaagcccatccgcatcagttttcacagcaacagctacagtttccacagcaacagttgcatcctccacagcagctgcatcgccctcagcagcagctccagccctttcagcagcagcatgccctgcagcagcagttccatcagctgcagcagcaccagctccagcagcagcagcttgcccagctccagcagcagcacagcctgctccagcagcagcagcaacagcagattcagcagcagcagctccagcgcatgcaccagcagcagcagcagcagcagatgcaaagtcagacagcgccacacttgagtcagacgtcacaggcgctgcagcatcaggttccacctcagcagcccccgcagcagcagcagcaacagcagccaccaccatcgcctcagcagcatcagctttttggacatgatccagcagtggagattccagaagaaggcttcttattgggatgtgtgtttgcaattgcggattatccagagcagatgtctgataagcaactgctggccacctggaaaaggataatccaggcacatggcggcactgttgaccccaccttcacgagtcgatgcacgcaccttctctgtgagagtcaagtcagcagcgcgtatgcacaggcaataagagaaagaaagagatgtgttactgcacactggttaaacacagtcttaaagaagaagaaaatggtaccgccgcaccgagcccttcacttcccagtggccttcccaccaggaggaaagccatgttcacagcatattatttctgtgactggatttgttgatagtgacagagatgacctaaaattaatggcttatttggcaggtgccaaatatacgggttatctatgccgcagcaacacagtcctcatctgtaaagaaccaactggtttaaagtatgaaaaagccaaagagtggaggataccctgtgtcaacgcccagtggcttggcgacattcttctgggaaactttgaggcactgaggcagattcagtatagtcgctacacggcattcagtctgcaggatccatttgcccctacccagcatttagttttaaatcttttagatgcttggagagttcccttaaaagtgtctgcagagttgttgatgagtataagactacctcccaaactgaaacagaatgaagtagctaatgtccagccttcttccaaaagagccagaattgaagacgtaccacctcccactaaaaagctaactccagaattgaccccttttgtgcttttcactggattcgagcctgtccaggttcaacagtatattaagaagctctacattcttggtggagaggttgcggagtctgcacagaagtgcacacacctcattgccagcaaagtgactcgcaccgtgaagttcctgacggcgatttctgtcgtgaagcacatagtgacgccagagtggctggaagaatgcttcaggtgtcagaagttcattgatgagcagaactacattctccgagatgctgaggcagaagtacttttctctttcagcttggaagaatccttaaaacgggcacacgtttctccactctttaaggcaaaatatttttacatcacacctggaatctgcccaagtctttccactatgaaggcaatcgtagagtgtgcaggaggaaaggtgttatccaagcagccatctttccggaagctcatggagcacaagcagaactcgagtttgtcggaaataattttaatatcctgtgaaaatgaccttcatttatgccgagaatattttgccagaggcatagatgttcacaatgcagagttcgttctgactggagtgctcactcaaacgctggactatgaatcatataagtttaactgatggcgtctaggctgccgtgcatgtcgactcctgcggtgcggggctggctgtctggctggcgaggagctgctgcgcttccttcacatgctcttgttttccagctgctttcctgggggatcagactgtgaagcaggaagacagatataataaatatactgcatctttttaagatgtgcaattttattctgaggaaacataaattatgttttgtattatatgactttaagagcccacattaggttttatgattcatttgccaggtttttaaatgttttcacaaaactgttacgggacttcaactagaaataaaatggtgtaaataaagaccttgctatctctaaattatggatgttaaagatttgaaatgttttgtactttgattatttttatttcttatactctgttttcttttatattgatatcttgcccacattttaaataaatgtacttttgaacttagaa

SEQ ID NO: 163955 - DNA, 2564 bp, Homo sapiens
  Payload ID: 12282
  Gene Symbol: PAXBP1
  Gene Name: PAX3 and PAX7 binding protein 1
  Uniprot ID: Q9Y5B6
  ENST ID: ENST00000290178
  CDS Start-End: 1-2448
atgttccgaaaggcccggcgggtgaacgtgcgcaagcggaacgactccgaagaggaagagcgggaacgcgatgaggagcaggagccgccgccgttgttgccgccgccgggcacgggcgaagaggcgggccccggtggcggcgacagggcccctggcggggagtcgctgctgggcccggggccgtcgccgccttccgcgctgaccccgggcctcggggctgaggccgggggcggcttccccggcggcgcggagcccggcaacgggctgaagccgcgcaagaggcctcgcgagaacaaagaggtgccccgggccagcctgctcagcttccaggacgaggaggaagaaaatgaagaagttttcaaagtgaagaaatcaagttatagcaaaaagatagtaaaattgctcaagaaggaatataaagaagatcttgaaaaatcgaagattaagacagaactcaactcatcagctgaaagtgaacaacctttggacaaaacaggacatgttaaggatacaaatcaagaagatggagttatcatcagtgaacatggtgaagatgaaatggatatggaaagtgaaaaagaggaagaaaagccaaagactggtggagctttttcaaatgctttatcttcattgaatgttcttcgtccaggagaaattccagatgcagcttttatacatgctgcaaggaaaaagcgccaaatggcccgagaattgggagatttcactcctcatgataatgagcctggtaaaggccgccttgttagagaagatgagaatgatgccagtgatgatgaagatgacgatgagaaacgccggatagttttttctgtgaaagaaaagtcacaaagacaaaaaattgctgaggaaataggaattgaggggagtgatgatgatgctttagtaactggagaacaggatgaagagctcagccgatgggaacaggagcagataaggaaaggaattaatatccctcaggttcaagccagtcaacccgcagaagtgaatatgtactaccagaacacttaccagacaatgccttacggctcatcctatggcattccttatagttatacggcctatggatcatcagatgccaaatctcaaaaaacagataatacagtccctttcaaaactcccagtaatgagatgactcccgttactattgatttggtaaagaaacagcttaaagacaggttggactccatgaaagaattgcacaaaacaaatcgacagcagcatgagaaacatctgcaaagccgagtggactctaccagggctattgaaagattagaagggtcttctgggggtattggtgaacggtataaatttttgcaagaaatgcgagggtatgtccaagacttgcttgagtgtttcagtgaaaaggtgccactgattaatgaacttgaatcagcaatacatcagctgtacaaacagcgagcttcccgccttgtccaaagacgacaagatgatattaaagatgaatcttcggagttttcaagccattcaaacaaagctctgatggcaccaaatcttgactcctttggacgcgatcgggcactgtatcaagagcatgcaaaacgtcgcattgcagagcgggaggccaggaggactcgtcgtagacaagccagagaacaaaccggtaagatggcagatcaccttgaaggcctttccagtgatgatgaagaaacttctacagatattactaatttcaatctggaaaaagatcgaatttcaaaagaatccggcaaagtttttgaagatgtccttgaaagtttctattcaattgactgtattaaatcacagtttgaagcatggcgttcaaaatactacacatcctacaaagatgcttacattggcctttgtttgccaaaattattcaaccccctcatacgacttcagctcctcacttggactcctcttgaggcaaaatgtcgtgactttgagaatatgctgtggtttgaatctttgctgttttatggttgtgaagaacgagagcaagaaaaagatgatgtagatgttgccctactacctaccattgtggaaaaggtgattcttcctaaactaacagtgatagctgaaaatatgtgggaccctttttctacaacacagacttcaagaatggtgggaattacactaaaattaatcaatggatatccttcagtagtgaatgcagaaaataaaaatacacaggtatacctaaaggcacttttattgagaatgagaagaactttagatgatgatgtatttatgcccttatatcccaaaaatgtcttagaaaataaaaattctgggccttacttgttttttcaacgacagttttggtcttcagttaaggtcataaaacccccattccagagagggtcctgccccatacccagaaggaaagaatgctgctcagagaggccaagaagaatctggacggacaggccttgtgttgtcttctcttgagcagtagatcatacctttttgtccagtcatgtttctgcatgcctgtacatatttcgttaaacctaaacatagtagacaatttctcctccatctttgggtcttcattctgaaggctg

SEQ ID NO: 163956 - DNA, 3995 bp, Homo sapiens
  Payload ID: 12282
  Gene Symbol: PAXBP1
  Gene Name: PAX3 and PAX7 binding protein 1
  Uniprot ID: Q9Y5B6
  ENST ID: ENST00000331923
  CDS Start-End: 191-2944
ctctctctctttctccaagtattgagagcgcgtgggagcataggcgcatgcgcgctcgtggggtgcgcggtagcaacagaggactcgacccggctggagctccggagagcgcgcgtgcgccgtcacgagctcggcgctgccggggccgcggtgtggaagcgagtattcgaccgccgtgcgggccgcggggatgttccgaaaggcccggcgggtgaacgtgcgcaagcggaacgactccgaagaggaagagcgggaacgcgatgaggagcaggagccgccgccgttgttgccgccgccgggcacgggcgaagaggcgggccccggtggcggcgacagggcccctggcggggagtcgctgctgggcccggggccgtcgccgccttccgcgctgaccccgggcctcggggctgaggccgggggcggcttccccggcggcgcggagcccggcaacgggctgaagccgcgcaagaggcctcgcgagaacaaagaggtgccccgggccagcctgctcagcttccaggacgaggaggaagaaaatgaagaagttttcaaagtgaagaaatcaagttatagcaaaaagatagtaaaattgctcaagaaggaatataaagaagatcttgaaaaatcgaagattaagacagaactcaactcatcagctgaaagtgaacaacctttggacaaaacaggacatgttaaggatacaaatcaagaagatggagttatcatcagtgaacatggtgaagatgaaatggatatggaaagtgaaaaagaggaagaaaagccaaagactggtggagctttttcaaatgctttatcttcattgaatgttcttcgtccaggagaaattccagatgcagcttttatacatgctgcaaggaaaaagcgccaaatggcccgagaattgggagatttcactcctcatgataatgagcctggtaaaggccgccttgttagagaagatgagaatgatgccagtgatgatgaagatgacgatgagaaacgccggatagttttttctgtgaaagaaaagtcacaaagacaaaaaattgctgaggaaataggaattgaggggagtgatgatgatgctttagtaactggagaacaggatgaagagctcagccgatgggaacaggagcagataaggaaaggaattaatatccctcaggttcaagccagtcaacccgcagaagtgaatatgtactaccagaacacttaccagacaatgccttacggctcatcctatggcattccttatagttatacggcctatggatcatcagatgccaaatctcaaaaaacagataatacagtccctttcaaaactcccagtaatgagatgactcccgttactattgatttggtaaagaaacagcttaaagacaggttggactccatgaaagaattgcacaaaacaaatcgacagcagcatgagaaacatctgcaaagccgagtggactctaccagggctattgaaagattagaagggtcttctgggggtattggtgaacggtataaatttttgcaagaaatgcgagggtatgtccaagacttgcttgagtgtttcagtgaaaaggtgccactgattaatgaacttgaatcagcaatacatcagctgtacaaacagcgagcttcccgccttgtccaaagacgacaagatgatattaaagatgaatcttcggagttttcaagccattcaaacaaagctctgatggcaccaaatcttgactcctttggacgcgatcgggcactgtatcaagagcatgcaaaacgtcgcattgcagagcgggaggccaggaggactcgtcgtagacaagccagagaacaaaccggtaagatggcagatcaccttgaaggcctttccagtgatgatgaagaaacttctacagatattactaatttcaatctggaaaaagatcgaatttcaaaagaatccggcaaagtttttgaagatgtccttgaaagtttctattcaattgactgtattaaatcacagtttgaagcatggcgttcaaaatactacacatcctacaaagatgcttacattggcctttgtttgccaaaattattcaaccccctcatacgacttcagctcctcacttggactcctcttgaggcaaaatgtcgtgactttgagaatatgctgtggtttgaatctttgctgttttatggttgtgaagaacgagagcaagaaaaagatgatgtagatgttgccctactacctaccattgtggaaaaggtgattcttcctaaactaacagtgatagctgaaaatatgtgggaccctttttctacaacacagacttcaagaatggtgggaattacactaaaattaatcaatggatatccttcagtagtgaatgcagaaaataaaaatacacaggtatacctaaaggcacttttattgagaatgagaagaactttagatgatgatgtatttatgcccttatatcccaaaaatgtcttagaaaataaaaattctgggccttacttgttttttcaacgacagttttggtcttcagttaagctgttaggcaattttcttcagtggtatggcattttctcaaataaaactctgcaagagttatcaatagatggtttattaaatcgatatattctcatggcttttcagaattcagaatatggagatgacagcatcaaaaaagcccaaaatgtaatcaattgtttccccaaacaatggttcatgaatctgaaaggagaaaggactatttctcagttagaaaacttttgccgataccttgtacacttagcggatacaatttatagaaatagtatcgggtgttctgatgtggaaaaaagaaatgcaagggaaaacataaaacagatagtaaaactccttgcaagtgttcgagctttggatcatgctatgtctgttgcaagtgaccacaatgtgaaagaatttaagtctttgatcgaaggaaaatagatctatgagactgaaaaacctatttgcttgattaccattcccaatgtgtaaattttgtatatatgtaaagtttcttaaactgtaaaatagcaattcttgttttaatacaaaaaacattatattcaatactgtgtccttaaatgatatttcttcagaatgaaaggaattcagattatttctaggagtctatgaatgttttctttactgcctgtcatactttgtttactgaagtattttgtatggtcatttaaattaaccctctcagttaattgtcccctgtaaacgatgtgtgcagtgtaaattgtgtaattatgcatatatatatttataccaccatggacttactttcacactggaaatttgtggtgtttttccacagaggaagccttttaacagcagaaaattatccggtagcaaattgtcttagggaaattactacactgttgtaacaaaagggctggcaagtgactaaatgttcattaccttttggttagcgttgctatcactgtagctgtgctgccttaacattgagagttgagttgtggacttagtcattgagtgaatgttgaactttcttccttgaatcagcgttagagtcaaatgtgggtttaatgtgaatgctaaatgaatatgcaacatagtttcaaatggaacatagaaatttcacttttgaaaataataaacccacaacctaattgcatggttttgggctgaccgtcctgtctcattcatgattttactccctgcccagcttgcagatacatgcatttgaattttagtagtctgtcatatttaaaatcccacatatgtgagttaaatatgcaataaagaatacgccttgctgattagccacacccaggcaatttaatatccatggtcttctataatgtttataccacattgtaaatattcagagaacttgttttaaagtttatgctttctgattctgtgattttcaaaagaggaatttttttggaaattaaggactatcgtttgataattatatatgtaattaagatttagccaagcattaaattaatttttaaatata

SEQ ID NO: 163957 - DNA, 339 bp, Homo sapiens
  Payload ID: 12282
  Gene Symbol: PAXBP1
  Gene Name: PAX3 and PAX7 binding protein 1
  ENST ID: ENST00000421049
  CDS Start-End: 1-111
tacaaacagcgagcttcccgccttgtccaaagacgacaagatgatattaaagatgaatcttcggagttttcaagccattcaagtcagtccatcttgaagacaaagctctgatggcaccaaatcttgactcctttggacgcgatcgggcactgtatcaagagcatgcaaaacgtcgcattgcagagcgggaggccaggagatcgaatttcaaaagaatccggcaaagtttttgaagatgtccttgaaagtttctattcaattgactgtattaaatcacagtttgaagcatggcgttcaaaatactacacatcctacaaagatgcttacattggcctttgt

SEQ ID NO: 163958 - DNA, 2920 bp, Homo sapiens
  Payload ID: 12282
  Gene Symbol: PAXBP1
  Gene Name: PAX3 and PAX7 binding protein 1
  Uniprot ID: Q9Y5B6
  ENST ID: ENST00000443785
  CDS Start-End: 20-1555
cgccgtgcgggccgcggggatgttccgaaaggcccggcgggtgaacgtgcgcaagcggaacgactccgaagaggaagagcgggaacgcgatgaggagcaggagccgccgccgttgttgccgccgccgggcacgggcgaagaggcgggccccggtggcggcgacagggcccctggcggggagtcgctgctgggcccggggccgtcgccgccttccgcgctgaccccgggcctcggggctgaggccgggggcggcttccccggcggcgcggagcccggcaacgggctgaagccgcgcaagaggcctcgcgagaacaaagaggtgccccgggccagcctgctcagcttccaggacgaggaggaagaaaatgaagaagttttcaaagtgaagaaatcaagttatagcaaaaagatagtaaaattgctcaagaaggaatataaagaagatcttgaaaaatcgaagattaagacagaactcaactcatcagctgaaagtgaacaacctttggacaaaacaggacatgttaaggatacaaatcaagaagatggagttatcatcagtgaacatggtgaagatgaaatggatatggaaagtgaaaaagaggaagaaaagccaaagactggtggagctttttcaaatgctttatcttcattgaatgttcttcgtccaggagaaattccagatgcagcttttatacatgctgcaaggaaaaagcgccaaatggcccgagaattgggagatttcactcctcatgataatgagcctggtaaaggccgccttgttagagaagatgagaatgatgccagtgatgatgaagatgacgatgagaaacgccggatagttttttctgtgaaagaaaagtcacaaagacaaaaaattgctgaggaaataggaattgaggggagtgatgatgatgctttagtaactggagaacaggatgaagagctcagccgatgggaacaggagcagataaggaaaggaattaatatccctcaggttcaagccagtcaacccgcagaagtgaatatgtactaccagaacacttaccagacaatgccttacggctcatcctatggcattccttatagttatacggcctatggatcatcagatgccaaatctcaaaaaacagataatacagtccctttcaaaactcccagtaatgagatgactcccgttactattgatttggtaaagaaacagcttaaagacaggttggactccatgaaagaattgcacaaaacaaatcgacagcagcatgagaaacatctgcaaagccgagtggactctaccagggctattgaaagattagaagggtcttctgggggtattggtgaacggtataaatttttgcaagaaatgcgagggtatgtccaagacttgcttgagtgtttcagtgaaaaggtgccactgattaatgaacttgaatcagcaatacatcagctgtacaaacagcgagcttcccgccttgtccaaagacgacaagatgatattaaagatgaatcttcggagttttcaagccattcaagtcagtccatcttgaagacaaagctctgatggcaccaaatcttgactcctttggacgcgatcgggcactgtatcaagagcatgcaaaacgtcgcattgcagagcgggaggccaggaggactcgtcgtagacaagccagagaacaaaccggtaagatggcagatcaccttgaaggcctttccagtgatgatgaagaaacttctacagatattactaatttcaatctggaaaaagatcgaatttcaaaagaatccggcaaagtttttgaagatgtccttgaaagtttctattcaattgactgtattaaatcacagtttgaagcatggcgttcaaaatactacacatcctacaaagatgcttacattggcctttgtttgccaaaattattcaaccccctcatacgacttcagctcctcacttggactcctcttgaggcaaaatgtcgtgactttgagaatatgctgtggtttgaatctttgctgttttatggttgtgaagaacgagagcaagaaaaagatgatgtagatgttgccctactacctaccattgtggaaaaggtgattcttcctaaactaacagtgatagctgaaaatatgtgggaccctttttctacaacacagacttcaagaatggtgggaattacactaaaattaatcaatggatatccttcagtagtgaatgcagaaaataaaaatacacaggtatacctaaaggcacttttattgagaatgagaagaactttagatgatgatgtatttatgcccttatatcccaaaaatgtcttagaaaataaaaattctgggccttacttgttttttcaacgacagttttggtcttcagttaagctgttaggcaattttcttcagtggtatggcattttctcaaataaaactctgcaagagttatcaatagatggtttattaaatcgatatattctcatggcttttcagaattcagaatatggagatgacagcatcaaaaaagcccaaaatgtaatcaattgtttccccaaacaatggttcatgaatctgaaaggagaaaggactatttctcagttagaaaacttttgccgataccttgtacacttagcggatacaatttatagaaatagtatcgggtgttctgatgtggaaaaaagaaatgcaagggaaaacataaaacagatagtaaaactccttgcaagtgttcgagctttggatcatgctatgtctgttgcaagtgaccacaatgtgaaagaatttaagtctttgatcgaaggaaaatagatctatgagactgaaaaacctatttgcttgattaccattcccaatgtgtaaattttgtatatatgtaaagtttcttaaactgtaaaatagcaattcttgttttaatacaaaaaacattatattcaatact

SEQ ID NO: 163959 - DNA, 473 bp, Homo sapiens
  Payload ID: 12282
  Gene Symbol: PAXBP1
  Gene Name: PAX3 and PAX7 binding protein 1
  ENST ID: ENST00000445049
  CDS Start-End: 1-78
cagttttggtcttcagttaaggagaaagtgatttctgagttccaaagtaaggtccatcgtactcaacgaaatgcctgactaagccacaattaattttttcagcaagtagactacagtagtcctcccttcccagaagatttccttccaccctgaggaagtgatatttagatcattcgacctggagaaaaaatagaagttagccctgaggtgaaagagagcaggctacactggaggcgctgaagaaagcataggacagctggagtgagcaagtcataaaacccccattccagagagggtcctgccccatacccagaaggaaagaatgctgctcagagaggccaagaagaatctggacggacaggccttgtgttgtcttctcttgagcagtagatcatacctttttgtccagtcatgtttctgcatgcctgtacatatttcgttaaacctaaacatagtagacaatttctcctcca

SEQ ID NO: 163960 - DNA, 662 bp, Homo sapiens
  Payload ID: 12282
  Gene Symbol: PAXBP1
  Gene Name: PAX3 and PAX7 binding protein 1
  Uniprot ID: Q9Y5B6
  ENST ID: ENST00000574159
  CDS Start-End: 191-662
ctctctctctttctccaagtattgagagcgcgtgggagcataggcgcatgcgcgctcgtggggtgcgcggtagcaacagaggactcgacccggctggagctccggagagcgcgcgtgcgccgtcacgagctcggcgctgccggggccgcggtgtggaagcgagtattcgaccgccgtgcgggccgcggggatgttccgaaaggcccggcgggtgaacgtgcgcaagcggaacgactccgaagaggaagagcgggaacgcgatgaggagcaggagccgccgccgttgttgccgccgccgggcacgggcgaagaggcgggccccggtggcggcgacagggcccctggcggggagtcgctgctgggcccggggccgtcgccgccttccgcgctgaccccgggcctcggggctgaggccgggggcggcttccccggcggcgcggagcccggcaacgggctgaagccgcgcaagaggcctcgcgagaacaaagaggtgccccgggccagcctgctcagcttccaggacgaggaggaagaaaatgaagaagttttcaaagtgaagaaatcaagttatagcaaaaagatagtaaaattgctcaagaaggaatataaagaagatcttgaaaaatcgaagattaagacagaactcaactcatcagctgaaa

SEQ ID NO: 163961 - DNA, 472 bp, Homo sapiens
  Payload ID: 12282
  Gene Symbol: PAXBP1
  Gene Name: PAX3 and PAX7 binding protein 1
  Uniprot ID: Q9Y5B6
  ENST ID: ENST00000573680
  CDS Start-End: 1-472
atgttccgaaaggcccggcgggtgaacgtgcgcaagcggaacgactccgaagaggaagagcgggaacgcgatgaggagcaggagccgccgccgttgttgccgccgccgggcacgggcgaagaggcgggccccggtggcggcgacagggcccctggcggggagtcgctgctgggcccggggccgtcgccgccttccgcgctgaccccgggcctcggggctgaggccgggggcggcttccccggcggcgcggagcccggcaacgggctgaagccgcgcaagaggcctcgcgagaacaaagaggtgccccgggccagcctgctcagcttccaggacgaggaggaagaaaatgaagaagttttcaaagtgaagaaatcaagttatagcaaaaagatagtaaaattgctcaagaaggaatataaagaagatcttgaaaaatcgaagattaagacagaactcaactcatcagctgaaa

SEQ ID NO: 163962 - DNA, 3785 bp, Homo sapiens
  Payload ID: 12283
  Gene Symbol: PXN
  Gene Name: paxillin
  Uniprot ID: P49023
  ENST ID: ENST00000228307
  CDS Start-End: 143-1918
ggcgggcgcgggcgcgggcgcgcgcggcggcggcgcgttccgttccgggccgaggctcgcggcggaaaagttgcggggcatagacgagcggccccgggacgggcagctagcgcgaccctgagccggcgcccgtggtccggccatggacgacctcgacgccctgctggcggacttggagtctaccacctcccacatctccaaacggcctgtgttcttgtcggaggagaccccctactcatacccaactggaaaccacacataccaggagattgccgtgccaccccccgtccccccacccccgtccagcgaggccctcaatggcacaatccttgaccccttagaccagtggcagcccagcagctcccgattcatccaccagcagcctcagtcctcatcacctgtgtacggctccagtgccaaaacttccagtgtctccaaccctcaggacagtgttggctctccgtgctcccgagtgggtgaggaggagcacgtctacagcttccccaacaagcagaaatcagctgagccttcacccaccgtaatgagcacgtccctgggcagcaacctttctgaactcgaccgcctgctgctggaactgaacgctgtacagcataacccgccaggcttccctgcagatgaggccaactcaagccccccgcttcctggggccctgagccccctctatggtgtcccagagactaacagccccttgggaggcaaagctgggcccctgacgaaagagaagcctaagcggaatgggggccggggcctggaggacgtgcggcccagtgtggagagtctcttggatgaactggagagctccgtgcccagccccgtccctgccatcactgtgaaccagggcgagatgagcagcccgcagcgcgtcacctccacccaacagcagacacgcatctcggcctcctctgccaccagggagctggacgagctgatggcttcgctgtcggatttcaagatccagggcctggagcaaagagcggatggggagcggtgctgggcggccggctggcctcgggacggcgggcggagcagccccggagggcaggacgagggagggttcatggcccaggggaagacagggagcagctcaccccctggggggcccccgaagcccgggagccagctggacagcatgctggggagcctgcagtctgacctgaacaagctgggggtcgccacagtcgccaaaggagtctgcggggcctgcaagaagcccatcgccgggcaggttgtgaccgccatggggaagacgtggcaccccgagcacttcgtctgcacccactgccaggaggagatcggatcccggaacttcttcgagcgggatggacagccctactgtgaaaaggactaccacaacctcttctccccgcgctgctactactgcaacggccccatcctggataaagtggtgacagcccttgaccggacgtggcaccctgaacacttcttctgtgcacagtgtggagccttctttggtcccgaagggttccacgagaaggacggcaaggcctactgtcgcaaggactacttcgacatgttcgcacccaagtgtggcggctgcgcccgggccatcctggagaactatatctcagccctcaacacgctgtggcatcctgagtgctttgtgtgccgggaatgcttcacgccattcgtgaacggcagcttcttcgagcacgacgggcagccctactgtgaggtgcactaccacgagcggcgcggctcgctgtgttctggctgccagaagcccatcaccggccgctgcatcaccgccatggccaagaagttccaccccgagcacttcgtctgtgccttctgcctcaagcagctcaacaagggcaccttcaaggagcagaacgacaagccttactgtcagaactgcttcctcaagctcttctgctaggtgccctgcccctgtctctgccccccttccccagccagcatccccaactgcgactgtgacctagagacttcacccgggggtgaaggggtaaacccgactgaaactggaacccttgtcctccgctggtgcgggatggacagagggccgtgaggggtccccctgcttgtcttcacccctgccagagcctctgggccccctcctccctcctgtagctctccctaggctgcccactctccatcctccccaggggtagaggctgggggctccaccccagcccatgtacgtccccacgaactggcctggccagcaccccacactggagccatctcttcctcatatttcagcagtgcagccggggggcagggaagggcaggcagggtctgttggggtctctttttatccttattcctcccccgacctaattgtctttgttctgtgattattgggggacacccggctccctccagacaatgccagcataaatccatccatccaaaggcagagaaccaaaggggccatggaaggttctctgtgctcctcctacccttccagtgccctaggcctggcgactgcccctgccttttagacccgccctccccttttatacctgctcttgttctactgagaaaagcctctccagcaataatgttttctagtcacttcctccgtctccgggacggcgtgcctggacactgtaccgactttgatagatttctacactgaggtttgaattcatatcgcctgagttgcttttacttctctatacaaaatgattttgaagagattttaaagacgttcccttttgtattctcttcctcatccaccgccactgggcctgtcactgatggtggctctggtgtgaagtttgctttgtactgagggttggggtggggaagcaatttgtattttattgtttcttagcacaagcaggtgaactgggagcagctctgtgactccccctctttcacttcatagctcaccaggactgttttataaactgctgtatttggaaaccccttctttacttcccaggccagcaagctcttcactgaaactggttgaagggtgttgcacccttttgggcctagaattctgaactttatctgttctgtttctgtgggaggagaaggggaagtatgttttggggggctgcttcctgtctgagtaagccctcaggagcctctgctcccctgtgaacccactgaaccttctgagcccccactgcttctatggggctctctcttctgccttctcaggaaagctggtgtctgattttggccatcaggactctgacgtctctttggtcttgttgatttcctctgggcatatcccttccccagatctgctcctcccctttcacaggtgggatcggcactcagggggtctggaaagaaggtcataagggagcatgataggatttggggcagagggacaggctcctctggggaaaccccccagagctctttaccaaggatgaaagaggagccaggccttgggctcctgatgaggagaaaggggccccaccggggtctaatggtgacagtccaaaccactccactggcctcctggcagaagccgagtgtgctggggtctccgaagagggtccctcctttttgggggaaggtcagcccagcccctccaaaggtctgatgtctccactttcacccgcaggccttaccgctctgtttatagtgacccaccctagatcttccccaagagggactggggtttctggggtccattctctgagtcagtggttatttgaaaatttgattttgattttattttttctctgtaaacttccaagctggcttttcccatttcaattcctgtgatttatgccaataaagtttgcccatgattttca

SEQ ID NO: 163963 - DNA, 3835 bp, Homo sapiens
  Payload ID: 12283
  Gene Symbol: PXN
  Gene Name: paxillin
  Uniprot ID: P49023
  ENST ID: ENST00000267257
  CDS Start-End: 143-1960
ggcgggcgcgggcgcgggcgcgcgcggcggcggcgcgttccgttccgggccgaggctcgcggcggaaaagttgcggggcatagacgagcggccccgggacgggcagctagcgcgaccctgagccggcgcccgtggtccggccatggacgacctcgacgccctgctggcggacttggagtctaccacctcccacatctccaaacggcctgtgttcttgtcggaggagaccccctactcatacccaactggaaaccacacataccaggagattgccgtgccaccccccgtccccccacccccgtccagcgaggccctcaatggcacaatccttgaccccttagaccagtggcagcccagcagctcccgattcatccaccagcagcctcagtcctcatcacctgtgtacggctccagtgccaaaacttccagtgtctccaaccctcaggacagtgttggctctccgtgctcccgagtgggtgaggaggagcacgtctacagcttccccaacaagcagaaatcagctgagccttcacccaccgtaatgagcacgtccctgggcagcaacctttctgaactcgaccgcctgctgctggaactgaacgctgtacagcataacccgccaggcttccctgcagatgaggccaactcaagccccccgcttcctggggccctgagccccctctatggtgtcccagagactaacagccccttgggaggcaaagctgggcccctgacgaaagagaagcctaagcggaatgggggccggggcctggaggacgtgcggcccagtgtggagagtctcttggatgaactggagagctccgtgcccagccccgtccctgccatcactgtgaaccagggcgagatgagcagcccgcagcgcgtcacctccacccaacagcagacacgcatctcggcctcctctgccaccagggagctggacgagctgatggcttcgctgtcggatttcaagggctcctggcccctggaggaggttgtacttcttgtctccatcagctcatctgtccaggagggagaaaagtacccccatccctgtgctgccagacaccgtaccccgagcctcaggagtcctgaccagccccctccgtgtccacagttcatggcccaggggaagacagggagcagctcaccccctggggggcccccgaagcccgggagccagctggacagcatgctggggagcctgcagtctgacctgaacaagctgggggtcgccacagtcgccaaaggagtctgcggggcctgcaagaagcccatcgccgggcaggttgtgaccgccatggggaagacgtggcaccccgagcacttcgtctgcacccactgccaggaggagatcggatcccggaacttcttcgagcgggatggacagccctactgtgaaaaggactaccacaacctcttctccccgcgctgctactactgcaacggccccatcctggataaagtggtgacagcccttgaccggacgtggcaccctgaacacttcttctgtgcacagtgtggagccttctttggtcccgaagggttccacgagaaggacggcaaggcctactgtcgcaaggactacttcgacatgttcgcacccaagtgtggcggctgcgcccgggccatcctggagaactatatctcagccctcaacacgctgtggcatcctgagtgctttgtgtgccgggaatgcttcacgccattcgtgaacggcagcttcttcgagcacgacgggcagccctactgtgaggtgcactaccacgagcggcgcggctcgctgtgttctggctgccagaagcccatcaccggccgctgcatcaccgccatggccaagaagttccaccccgagcacttcgtctgtgccttctgcctcaagcagctcaacaagggcaccttcaaggagcagaacgacaagccttactgtcagaactgcttcctcaagctcttctgctaggtgccctgcccctgtctctgccccccttccccagccagcatccccaactgcgactgtgacctagagacttcacccgggggtgaaggggtaaacccgactgaaactggaacccttgtcctccgctggtgcgggatggacagagggccgtgaggggtccccctgcttgtcttcacccctgccagagcctctgggccccctcctccctcctgtagctctccctaggctgcccactctccatcctccccaggggtagaggctgggggctccaccccagcccatgtacgtccccacgaactggcctggccagcaccccacactggagccatctcttcctcatatttcagcagtgcagccggggggcagggaagggcaggcagggtctgttggggtctctttttatccttattcctcccccgacctaattgtctttgttctgtgattattgggggacacccggctccctccagacaatgccagcataaatccatccatccaaaggcagagaaccaaaggggccatggaaggttctctgtgctcctcctacccttccagtgccctaggcctggcgactgcccctgccttttagacccgccctccccttttatacctgctcttgttctactgagaaaagcctctccagcaataatgttttctagtcacttcctccgtctccgggacggcgtgcctggacactgtaccgactttgatagatttctacactgaggtttgaattcatatcgcctgagttgcttttacttctctatacaaaatgattttgaagagattttaaagacgttcccttttgtattctcttcctcatccaccgccactgggcctgtcactgatggtggctctggtgtgaagtttgctttgtactgagggttggggtggggaagcaatttgtattttattgtttcttagcacaagcaggtgaactgggagcagctctgtgactccccctctttcacttcatagctcaccaggactgttttataaactgctgtatttggaaaccccttctttacttcccaggccagcaagctcttcactgaaactggttgaagggtgttgcacccttttgggcctagaattctgaactttatctgttctgtttctgtgggaggagaaggggaagtatgttttggggggctgcttcctgtctgagtaagccctcaggagcctctgctcccctgtgaacccactgaaccttctgagcccccactgcttctatggggctctctcttctgccttctcaggaaagctggtgtctgattttggccatcaggactctgacgtctctttggtcttgttgatttcctctgggcatatcccttccccagatctgctcctcccctttcacaggtgggatcggcactcagggggtctggaaagaaggtcataagggagcatgataggatttggggcagagggacaggctcctctggggaaaccccccagagctctttaccaaggatgaaagaggagccaggccttgggctcctgatgaggagaaaggggccccaccggggtctaatggtgacagtccaaaccactccactggcctcctggcagaagccgagtgtgctggggtctccgaagagggtccctcctttttgggggaaggtcagcccagcccctccaaaggtctgatgtctccactttcacccgcaggccttaccgctctgtttatagtgacccaccctagatcttccccaagagggactggggtttctggggtccattctctgagtcagtggttatttgaaaatttgattttgattttattttttctctgtaaacttccaagctggcttttcccatttcaattcctgtgatttatgccaataaagtttgcccatgattttcacctgtgct

SEQ ID NO: 163964 - DNA, 3683 bp, Homo sapiens
  Payload ID: 12283
  Gene Symbol: PXN
  Gene Name: paxillin
  Uniprot ID: P49023
  ENST ID: ENST00000424649
  CDS Start-End: 143-1816
ggcgggcgcgggcgcgggcgcgcgcggcggcggcgcgttccgttccgggccgaggctcgcggcggaaaagttgcggggcatagacgagcggccccgggacgggcagctagcgcgaccctgagccggcgcccgtggtccggccatggacgacctcgacgccctgctggcggacttggagtctaccacctcccacatctccaaacggcctgtgttcttgtcggaggagaccccctactcatacccaactggaaaccacacataccaggagattgccgtgccaccccccgtccccccacccccgtccagcgaggccctcaatggcacaatccttgaccccttagaccagtggcagcccagcagctcccgattcatccaccagcagcctcagtcctcatcacctgtgtacggctccagtgccaaaacttccagtgtctccaaccctcaggacagtgttggctctccgtgctcccgagtgggtgaggaggagcacgtctacagcttccccaacaagcagaaatcagctgagccttcacccaccgtaatgagcacgtccctgggcagcaacctttctgaactcgaccgcctgctgctggaactgaacgctgtacagcataacccgccaggcttccctgcagatgaggccaactcaagccccccgcttcctggggccctgagccccctctatggtgtcccagagactaacagccccttgggaggcaaagctgggcccctgacgaaagagaagcctaagcggaatgggggccggggcctggaggacgtgcggcccagtgtggagagtctcttggatgaactggagagctccgtgcccagccccgtccctgccatcactgtgaaccagggcgagatgagcagcccgcagcgcgtcacctccacccaacagcagacacgcatctcggcctcctctgccaccagggagctggacgagctgatggcttcgctgtcggatttcaagttcatggcccaggggaagacagggagcagctcaccccctggggggcccccgaagcccgggagccagctggacagcatgctggggagcctgcagtctgacctgaacaagctgggggtcgccacagtcgccaaaggagtctgcggggcctgcaagaagcccatcgccgggcaggttgtgaccgccatggggaagacgtggcaccccgagcacttcgtctgcacccactgccaggaggagatcggatcccggaacttcttcgagcgggatggacagccctactgtgaaaaggactaccacaacctcttctccccgcgctgctactactgcaacggccccatcctggataaagtggtgacagcccttgaccggacgtggcaccctgaacacttcttctgtgcacagtgtggagccttctttggtcccgaagggttccacgagaaggacggcaaggcctactgtcgcaaggactacttcgacatgttcgcacccaagtgtggcggctgcgcccgggccatcctggagaactatatctcagccctcaacacgctgtggcatcctgagtgctttgtgtgccgggaatgcttcacgccattcgtgaacggcagcttcttcgagcacgacgggcagccctactgtgaggtgcactaccacgagcggcgcggctcgctgtgttctggctgccagaagcccatcaccggccgctgcatcaccgccatggccaagaagttccaccccgagcacttcgtctgtgccttctgcctcaagcagctcaacaagggcaccttcaaggagcagaacgacaagccttactgtcagaactgcttcctcaagctcttctgctaggtgccctgcccctgtctctgccccccttccccagccagcatccccaactgcgactgtgacctagagacttcacccgggggtgaaggggtaaacccgactgaaactggaacccttgtcctccgctggtgcgggatggacagagggccgtgaggggtccccctgcttgtcttcacccctgccagagcctctgggccccctcctccctcctgtagctctccctaggctgcccactctccatcctccccaggggtagaggctgggggctccaccccagcccatgtacgtccccacgaactggcctggccagcaccccacactggagccatctcttcctcatatttcagcagtgcagccggggggcagggaagggcaggcagggtctgttggggtctctttttatccttattcctcccccgacctaattgtctttgttctgtgattattgggggacacccggctccctccagacaatgccagcataaatccatccatccaaaggcagagaaccaaaggggccatggaaggttctctgtgctcctcctacccttccagtgccctaggcctggcgactgcccctgccttttagacccgccctccccttttatacctgctcttgttctactgagaaaagcctctccagcaataatgttttctagtcacttcctccgtctccgggacggcgtgcctggacactgtaccgactttgatagatttctacactgaggtttgaattcatatcgcctgagttgcttttacttctctatacaaaatgattttgaagagattttaaagacgttcccttttgtattctcttcctcatccaccgccactgggcctgtcactgatggtggctctggtgtgaagtttgctttgtactgagggttggggtggggaagcaatttgtattttattgtttcttagcacaagcaggtgaactgggagcagctctgtgactccccctctttcacttcatagctcaccaggactgttttataaactgctgtatttggaaaccccttctttacttcccaggccagcaagctcttcactgaaactggttgaagggtgttgcacccttttgggcctagaattctgaactttatctgttctgtttctgtgggaggagaaggggaagtatgttttggggggctgcttcctgtctgagtaagccctcaggagcctctgctcccctgtgaacccactgaaccttctgagcccccactgcttctatggggctctctcttctgccttctcaggaaagctggtgtctgattttggccatcaggactctgacgtctctttggtcttgttgatttcctctgggcatatcccttccccagatctgctcctcccctttcacaggtgggatcggcactcagggggtctggaaagaaggtcataagggagcatgataggatttggggcagagggacaggctcctctggggaaaccccccagagctctttaccaaggatgaaagaggagccaggccttgggctcctgatgaggagaaaggggccccaccggggtctaatggtgacagtccaaaccactccactggcctcctggcagaagccgagtgtgctggggtctccgaagagggtccctcctttttgggggaaggtcagcccagcccctccaaaggtctgatgtctccactttcacccgcaggccttaccgctctgtttatagtgacccaccctagatcttccccaagagggactggggtttctggggtccattctctgagtcagtggttatttgaaaatttgattttgattttattttttctctgtaaacttccaagctggcttttcccatttcaattcctgtgatttatgccaataaagtttgcccatgattttca

SEQ ID NO: 163965 - DNA, 3807 bp, Homo sapiens
  Payload ID: 12283
  Gene Symbol: PXN
  Gene Name: paxillin
  Uniprot ID: P49023
  ENST ID: ENST00000458477
  CDS Start-End: 666-1940
ttcccctgtgtactcctggctcggctggccggctaaggcagtttctcatcactgatgtgctctgggacagctgagtgggatgggctcctctggggtgggtgtggaggagtggtcgtgatgcctggaacactgcagtcactcctcagagacacgacttggcagccctcctgagcctgcctggtcacatgctgcctgtcttggaaggtcctctgtcccaagcagtggatgtgcagtttcttcacccctgcttagcttcatcaggcacaatgcgtctttgagacgccctgctggcggacttggagtctaccacctcccacatctccaaacggcctgtgttcttgtcggaggagaccccctactcatacccaactggaaaccacacataccaggagattgccgtgccaccccccgtccccccacccccgtccagcgaggccctcaatggcacaatccttgaccccttagaccagtggcagcccagcagctcccgattcatccaccagcagcctcagtcctcatcacctgtgtacggctccagtgccaaaacttccagtgtctccaaccctcaggacagtgttggctctccgtgctcccgagtgggtgaggaggagcacgtctacagcttccccaacaagcagaaatcagctgagccttcacccaccgtaatgagcacgtccctgggcagcaacctttctgaactcgaccgcctgctgctggaactgaacgctgtacagcataacccgccaggcttccctgcagatgaggccaactcaagccccccgcttcctggggccctgagccccctctatggtgtcccagagactaacagccccttgggaggcaaagctgggcccctgacgaaagagaagcctaagcggaatgggggccggggcctggaggacgtgcggcccagtgtggagagtctcttggatgaactggagagctccgtgcccagccccgtccctgccatcactgtgaaccagggcgagatgagcagcccgcagcgcgtcacctccacccaacagcagacacgcatctcggcctcctctgccaccagggagctggacgagctgatggcttcgctgtcggatttcaagttcatggcccaggggaagacagggagcagctcaccccctggggggcccccgaagcccgggagccagctggacagcatgctggggagcctgcagtctgacctgaacaagctgggggtcgccacagtcgccaaaggagtctgcggggcctgcaagaagcccatcgccgggcaggttgtgaccgccatggggaagacgtggcaccccgagcacttcgtctgcacccactgccaggaggagatcggatcccggaacttcttcgagcgggatggacagccctactgtgaaaaggactaccacaacctcttctccccgcgctgctactactgcaacggccccatcctggataaagtggtgacagcccttgaccggacgtggcaccctgaacacttcttctgtgcacagtgtggagccttctttggtcccgaagggttccacgagaaggacggcaaggcctactgtcgcaaggactacttcgacatgttcgcacccaagtgtggcggctgcgcccgggccatcctggagaactatatctcagccctcaacacgctgtggcatcctgagtgctttgtgtgccgggaatgcttcacgccattcgtgaacggcagcttcttcgagcacgacgggcagccctactgtgaggtgcactaccacgagcggcgcggctcgctgtgttctggctgccagaagcccatcaccggccgctgcatcaccgccatggccaagaagttccaccccgagcacttcgtctgtgccttctgcctcaagcagctcaacaagggcaccttcaaggagcagaacgacaagccttactgtcagaactgcttcctcaagctcttctgctaggtgccctgcccctgtctctgccccccttccccagccagcatccccaactgcgactgtgacctagagacttcacccgggggtgaaggggtaaacccgactgaaactggaacccttgtcctccgctggtgcgggatggacagagggccgtgaggggtccccctgcttgtcttcacccctgccagagcctctgggccccctcctccctcctgtagctctccctaggctgcccactctccatcctccccaggggtagaggctgggggctccaccccagcccatgtacgtccccacgaactggcctggccagcaccccacactggagccatctcttcctcatatttcagcagtgcagccggggggcagggaagggcaggcagggtctgttggggtctctttttatccttattcctcccccgacctaattgtctttgttctgtgattattgggggacacccggctccctccagacaatgccagcataaatccatccatccaaaggcagagaaccaaaggggccatggaaggttctctgtgctcctcctacccttccagtgccctaggcctggcgactgcccctgccttttagacccgccctccccttttatacctgctcttgttctactgagaaaagcctctccagcaataatgttttctagtcacttcctccgtctccgggacggcgtgcctggacactgtaccgactttgatagatttctacactgaggtttgaattcatatcgcctgagttgcttttacttctctatacaaaatgattttgaagagattttaaagacgttcccttttgtattctcttcctcatccaccgccactgggcctgtcactgatggtggctctggtgtgaagtttgctttgtactgagggttggggtggggaagcaatttgtattttattgtttcttagcacaagcaggtgaactgggagcagctctgtgactccccctctttcacttcatagctcaccaggactgttttataaactgctgtatttggaaaccccttctttacttcccaggccagcaagctcttcactgaaactggttgaagggtgttgcacccttttgggcctagaattctgaactttatctgttctgtttctgtgggaggagaaggggaagtatgttttggggggctgcttcctgtctgagtaagccctcaggagcctctgctcccctgtgaacccactgaaccttctgagcccccactgcttctatggggctctctcttctgccttctcaggaaagctggtgtctgattttggccatcaggactctgacgtctctttggtcttgttgatttcctctgggcatatcccttccccagatctgctcctcccctttcacaggtgggatcggcactcagggggtctggaaagaaggtcataagggagcatgataggatttggggcagagggacaggctcctctggggaaaccccccagagctctttaccaaggatgaaagaggagccaggccttgggctcctgatgaggagaaaggggccccaccggggtctaatggtgacagtccaaaccactccactggcctcctggcagaagccgagtgtgctggggtctccgaagagggtccctcctttttgggggaaggtcagcccagcccctccaaaggtctgatgtctccactttcacccgcaggccttaccgctctgtttatagtgacccaccctagatcttccccaagagggactggggtttctggggtccattctctgagtcagtggttatttgaaaatttgattttgattttattttttctctgtaaacttccaagctggcttttcccatttcaattcctgtgatttatgccaataaagtttgcccatgattttca

SEQ ID NO: 163966 - DNA, 957 bp, Homo sapiens
  Payload ID: 12283
  Gene Symbol: PXN
  Gene Name: paxillin
  ENST ID: ENST00000543331
  CDS Start-End: 428-957
agctaagcgatttgccctgtggcatggatggtagagaggggagctggcacttgaactcaggtctggctcgacctcagaatgagtgatcttgtgtctctgtgccccaggactgcatcctctcaccaatacttcaccagcctagggatctgtgctcccaagagcctgttgacattgtaaacctgaatccaatccataaaccaaaagcccaggcttagaatcacattgtggtggagcgggtgtttggtggagtccctgattcaaaatgtttgacaaggaagcctgaccatttgtcttctgttgggtgtttggagtccaagagacctgagatcagagtccagcattgtcacttcatccagccttggcagtgtgggatgtgactctgcctctgaaccgcagttataccatctgtgctggtggcgttgtgaggatggcaggtaacaaagacgccctgctggcggacttggagtctaccacctcccacatctccaaacggcctgtgttcttgtcggaggagaccccctactcatacccaactggaaaccacacataccaggagattgccgtgccaccccccgtccccccacccccgtccagcgaggccctcaatggcacaatccttgaccccttagaccagtggcagcccagcagctcccgattcatccaccagcagcctcagtcctcatcacctgtgtacggctccagtgccaaaacttccagtgtctccaaccctcaggacagtgttggctctccgtgctcccgagtgggtgaggaggagcacgtctacagcttccccaacaagcagaaatcagctgagccttcacccaccgtaatgagcacgtccctgggcagcaacctttctgaactcgaccgcctgctgctggaactgaacgctgtacagcataacccgccaggcttccctgcagatgaggccaactcaagccccccgcttcctggggc

SEQ ID NO: 163967 - DNA, 4112 bp, Homo sapiens
  Payload ID: 12283
  Gene Symbol: PXN
  Gene Name: paxillin
  ENST ID: ENST00000536957
  CDS Start-End: 477-2246
tttgaggtcagagttattcaagagcttactgagacaacaggccctgagaagctaagcgatttgccctgtggcatggatggtagagaggggagctggcacttgaactcaggtctggctcgacctcagaatgagtgatcttgtgtctctgtgccccaggactgcatcctctcaccaatacttcaccagcctagggatctgtgctcccaagagcctgttgacattgtaaacctgaatccaatccataaaccaaaagcccaggcttagaatcacattgtggtggagcgggtgtttggtggagtccctgattcaaaatgtttgacaaggaagcctgaccatttgtcttctgttgggtgtttggagtccaagagacctgagatcagagtccagcattgtcacttcatccagccttggcagtgtgggatgtgactctgcctctgaaccgcagttataccatctgtgctggtggcgttgtgaggatggcagacgccctgctggcggacttggagtctaccacctcccacatctccaaacggcctgtgttcttgtcggaggagaccccctactcatacccaactggaaaccacacataccaggagattgccgtgccaccccccgtccccccacccccgtccagcgaggccctcaatggcacaatccttgaccccttagaccagtggcagcccagcagctcccgattcatccaccagcagcctcagtcctcatcacctgtgtacggctccagtgccaaaacttccagtgtctccaaccctcaggacagtgttggctctccgtgctcccgagtgggtgaggaggagcacgtctacagcttccccaacaagcagaaatcagctgagccttcacccaccgtaatgagcacgtccctgggcagcaacctttctgaactcgaccgcctgctgctggaactgaacgctgtacagcataacccgccaggcttccctgcagatgaggccaactcaagccccccgcttcctggggccctgagccccctctatggtgtcccagagactaacagccccttgggaggcaaagctgggcccctgacgaaagagaagcctaagcggaatgggggccggggcctggaggacgtgcggcccagtgtggagagtctcttggatgaactggagagctccgtgcccagccccgtccctgccatcactgtgaaccagggcgagatgagcagcccgcagcgcgtcacctccacccaacagcagacacgcatctcggcctcctctgccaccagggagctggacgagctgatggcttcgctgtcggatttcaagatccagggcctggagcaaagagcggatggggagcggtgctgggcggccggctggcctcgggacggcgggcggagcagccccggagggcaggacgagggagggttcatggcccaggggaagacagggagcagctcaccccctggggggcccccgaagcccgggagccagctggacagcatgctggggagcctgcagtctgacctgaacaagctgggggtcgccacagtcgccaaaggagtctgcggggcctgcaagaagcccatcgccgggcaggttgtgaccgccatggggaagacgtggcaccccgagcacttcgtctgcacccactgccaggaggagatcggatcccggaacttcttcgagcgggatggacagccctactgtgaaaaggactaccacaacctcttctccccgcgctgctactactgcaacggccccatcctggataaagtggtgacagcccttgaccggacgtggcaccctgaacacttcttctgtgcacagtgtggagccttctttggtcccgaagggttccacgagaaggacggcaaggcctactgtcgcaaggactacttcgacatgttcgcacccaagtgtggcggctgcgcccgggccatcctggagaactatatctcagccctcaacacgctgtggcatcctgagtgctttgtgtgccgggaatgcttcacgccattcgtgaacggcagcttcttcgagcacgacgggcagccctactgtgaggtgcactaccacgagcggcgcggctcgctgtgttctggctgccagaagcccatcaccggccgctgcatcaccgccatggccaagaagttccaccccgagcacttcgtctgtgccttctgcctcaagcagctcaacaagggcaccttcaaggagcagaacgacaagccttactgtcagaactgcttcctcaagctcttctgctaggtgccctgcccctgtctctgccccccttccccagccagcatccccaactgcgactgtgacctagagacttcacccgggggtgaaggggtaaacccgactgaaactggaacccttgtcctccgctggtgcgggatggacagagggccgtgaggggtccccctgcttgtcttcacccctgccagagcctctgggccccctcctccctcctgtagctctccctaggctgcccactctccatcctccccaggggtagaggctgggggctccaccccagcccatgtacgtccccacgaactggcctggccagcaccccacactggagccatctcttcctcatatttcagcagtgcagccggggggcagggaagggcaggcagggtctgttggggtctctttttatccttattcctcccccgacctaattgtctttgttctgtgattattgggggacacccggctccctccagacaatgccagcataaatccatccatccaaaggcagagaaccaaaggggccatggaaggttctctgtgctcctcctacccttccagtgccctaggcctggcgactgcccctgccttttagacccgccctccccttttatacctgctcttgttctactgagaaaagcctctccagcaataatgttttctagtcacttcctccgtctccgggacggcgtgcctggacactgtaccgactttgatagatttctacactgaggtttgaattcatatcgcctgagttgcttttacttctctatacaaaatgattttgaagagattttaaagacgttcccttttgtattctcttcctcatccaccgccactgggcctgtcactgatggtggctctggtgtgaagtttgctttgtactgagggttggggtggggaagcaatttgtattttattgtttcttagcacaagcaggtgaactgggagcagctctgtgactccccctctttcacttcatagctcaccaggactgttttataaactgctgtatttggaaaccccttctttacttcccaggccagcaagctcttcactgaaactggttgaagggtgttgcacccttttgggcctagaattctgaactttatctgttctgtttctgtgggaggagaaggggaagtatgttttggggggctgcttcctgtctgagtaagccctcaggagcctctgctcccctgtgaacccactgaaccttctgagcccccactgcttctatggggctctctcttctgccttctcaggaaagctggtgtctgattttggccatcaggactctgacgtctctttggtcttgttgatttcctctgggcatatcccttccccagatctgctcctcccctttcacaggtgggatcggcactcagggggtctggaaagaaggtcataagggagcatgataggatttggggcagagggacaggctcctctggggaaaccccccagagctctttaccaaggatgaaagaggagccaggccttgggctcctgatgaggagaaaggggccccaccggggtctaatggtgacagtccaaaccactccactggcctcctggcagaagccgagtgtgctggggtctccgaagagggtccctcctttttgggggaaggtcagcccagcccctccaaaggtctgatgtctccactttcacccgcaggccttaccgctctgtttatagtgacccaccctagatcttccccaagagggactggggtttctggggtccattctctgagtcagtggttatttgaaaatttgattttgattttattttttctctgtaaacttccaagctggcttttcccatttcaattcctgtgatttatgccaataaagtttgcccatgattttc

SEQ ID NO: 163968 - DNA, 655 bp, Homo sapiens
  Payload ID: 12283
  Gene Symbol: PXN
  Gene Name: paxillin
  ENST ID: ENST00000548912
  CDS Start-End: 548-655
agttccggtttgctagagacaggaagccaggcctcctccatgggacccggagggcggggcgggctgtaggacctgaacttccttggaggtcaggcgaccagacccggggtcctgggccttggaacagacatcccctctgtccatctgggcaggagcatgggacgccctgctggcggacttggagtctaccacctcccacatctccaaacggcctgtgttcttgtcggaggagaccccctactcatacccaactggaaaccacacataccaggagattgccgtgccaccccccgtccccccacccccgtccagcgaggccctcaatggcacaatccttgaccccttagaccagtggcagcccagcagctcccgattcatccaccagcagcctcagtcctcatcacctgtgtacggctccagtgccaaaacttccagtgtctccaaccctcaggacagtgttggctctccgtgctcccgagtgggtgaggaggagcacgtctacagcttccccaacaagcagaaatcagctgagccttcacccaccgtaatgagcacgtccctgggcagcaacctttctgaactcgaccgcctgctgctggaactgaacgctgtacagcataacccgccaggcttccctgcagatgaggccaactca

SEQ ID NO: 163969 - DNA, 588 bp, Homo sapiens
  Payload ID: 12283
  Gene Symbol: PXN
  Gene Name: paxillin
  ENST ID: ENST00000552550
  CDS Start-End: 495-588
attctctccgcgttgccctgcagattcagagttccagacaggcacttcactcgcggctgcgcggccctgtcaggagggaacgcagtgccaggtgcctgactcccagagacgccctgctggcggacttggagtctaccacctcccacatctccaaacggcctgtgttcttgtcggaggagaccccctactcatacccaactggaaaccacacataccaggagattgccgtgccaccccccgtccccccacccccgtccagcgaggccctcaatggcacaatccttgaccccttagaccagtggcagcccagcagctcccgattcatccaccagcagcctcagtcctcatcacctgtgtacggctccagtgccaaaacttccagtgtctccaaccctcaggacagtgttggctctccgtgctcccgagtgggtgaggaggagcacgtctacagcttccccaacaagcagaaatcagctgagccttcacccaccgtaatgagcacgtccctgggcagcaacctttctgaactcgaccgcctgctgctggaactgaacgctgtacagcataacccgccaggcttccctgcag

SEQ ID NO: 163970 - DNA, 1004 bp, Homo sapiens
  Payload ID: 12283
  Gene Symbol: PXN
  Gene Name: paxillin
  ENST ID: ENST00000547983
  CDS Start-End: 109-384
gcgttccgttccgggccgaggctcgcggcggaaaagttgcggggcatagacgagcggccccgggacgggcagctagcgcgaccctgagccggcgcccgtggtccggccatggacgacctcgattcagagttccagacaggcacttcactcgcggctgcgcggccctgtcaggagggaacgcagtgccaggtgcctgactcccagagacgccctgctggcggacttggagtctaccacctcccacatctccaaacggcctgtgttcttgtcggaggagaccccctactcatacccaactggaaaccacacataccaggagattgccgtgccaccccccgtccccccacccccgtccagcgaggccctcaatggcacaatccttgaccccttagaccagtggcagcccagcagctcccgattcatccaccagcagcctcagtcctcatcacctgtgtacggctccagtgccaaaacttccagtgtctccaaccctcaggacagtgttggctctccgtgctcccgagtgggtgaggaggagcacgtctacagcttccccaacaagcagaaatcagctgagccttcacccaccgtaatgagcacgtccctgggcagcaacctttctgaactcgaccgcctgctgctggaactgaacgctgtacagcataacccgccaggcttccctgcagatgaggccaactcaagccccccgcttcctggggccctgagccccctctatggtgtcccagagactaacagccccttgggaggcaaagctgggcccctgacgaaagagaagcctaagcggaatgggggccggggcctggaggacgtgcggcccagtgtggagagtctcttggatgaactggagagctccgtgcccagccccgtccctgccatcactgtgaaccagggcgagatgagcagcccgcagcgcgtcacctccacccaacagcagacacgcatctcggcctcctctgccaccagggagctggacgagctgatgg

SEQ ID NO: 163971 - DNA, 729 bp, Homo sapiens
  Payload ID: 12283
  Gene Symbol: PXN
  Gene Name: paxillin
  ENST ID: ENST00000546532
  CDS Start-End: 619-729
agagacaggaagccaggcctcctccatgggacccggagggcggggcgggctgtaggacctgaacttccttggaggtcaggcgaccagacccggggtcctgggccttggaacagacatcccctctgtccatctgggcaggagcatgggattcagagttccagacaggcacttcactcgcggctgcgcggccctgtcaggagggaacgcagtgccaggtgcctgactcccagagacgccctgctggcggacttggagtctaccacctcccacatctccaaacggcctgtgttcttgtcggaggagaccccctactcatacccaactggaaaccacacataccaggagattgccgtgccaccccccgtccccccacccccgtccagcgaggccctcaatggcacaatccttgaccccttagaccagtggcagcccagcagctcccgattcatccaccagcagcctcagtcctcatcacctgtgtacggctccagtgccaaaacttccagtgtctccaaccctcaggacagtgttggctctccgtgctcccgagtgggtgaggaggagcacgtctacagcttccccaacaagcagaaatcagctgagccttcacccaccgtaatgagcacgtccctgggcagcaacctttctgaactcgaccgcctgctgctggaactgaacgctgtacagcataacccgccaggcttccctgcagatgaggccaactcaagc

SEQ ID NO: 163972 - DNA, 513 bp, Homo sapiens
  Payload ID: 12283
  Gene Symbol: PXN
  Gene Name: paxillin
  ENST ID: ENST00000550795
  CDS Start-End: 1-513
catcgaggaaagaagccactccagaagggagaccagaaacctgtctcctcccttccagcccccaggcccagcgcccgatccagggcctggagcaaagagcggatggggagcggtgctgggcggccggctggcctcgggacggcgggcggagcagccccggagggcaggacgagggagggttcatggcccaggggaagacagggagcagctcaccccctggggggcccccgaagcccgggagccagctggacagcatgctggggagcctgcagtctgacctgaacaagctgggggtcgccacagtcgccaaaggagtctgcggggcctgcaagaagcccatcgccgggcaggttgtgaccgccatggggaagacgtggcaccccgagcacttcgtctgcacccactgccaggaggagatcggatcccggaacttcttcgagcgggatggacagccctactgtgaaaaggactaccacaacctcttctccccgcgctgctactactgcaacggcc

SEQ ID NO: 163973 - DNA, 1702 bp, Homo sapiens
  Payload ID: 12284
  Gene Symbol: PAGR1
  Gene Name: PAXIP1 associated glutamate-rich protein 1
  Uniprot ID: Q9BTK6
  ENST ID: ENST00000320330
  CDS Start-End: 575-1339
cttactgggtggtatacgcatgcgacttcccggtggccatctttactgtgggctgaagcctgtgcgcttactcgcgcatgtgcaagccttccctcgctttcctcttccaagtagccttgcctagagcggagcctcccgcgccatttctgtgcgcctgcgtagcgtgaccctgcgcagcctgggaggcgggtcttagctccaggtgcgtacggcatctgacttgacgtggcccacaactgaaaggtctggggagaaggcgccgtgtccgggtgtggagaggggcgtcgtggaagcgagaagagtggcccgtccctctcctccccctttccctctttcggaaagtggtttctgcggggcccgggagcctcggagtaccgaacctcgatctccggggcggggtccttggtggggactgagcgccccctcccggggacgggcggtctggccgcggagtcccctgcgggagcgtgattggctggaaacggtcccgaacccccaggggagcccgatccctgggggaccctggcttcggactccagtatctgtcgtcgcagggtccctgccctagtggcctatgtcccttgctcggggccatggagacactgcggccagtacggcggcgcctctgtctgaagaaggggaagtgacctccggcctccaggctctggccgtggaggataccggaggcccctctgcctcggccggtaaggccgaggacgagggggaaggaggccgagaggagaccgagcgtgaggggtccgggggcgaggaggcgcagggagaagtccccagcgctgggggagaagagcctgccgaggaggactccgaggactggtgcgtgccctgcagcgacgaggaggtggagctgcctgcggatgggcagccctggatgcccccgccctccgaaatccagcggctctatgaactgctggctgcccacggtactctggagctgcaagccgagatcctgccccgccggcctcccacgccggaggcccagagcgaagaggagagatccgatgaggagccggaggccaaagaagaggaagaggaaaaaccacacatgcccacggaatttgattttgatgatgagccagtgacaccaaaggactccctgattgaccggagacgcaccccaggaagctcagcccggagccagaaacgggaggcccgcctggacaaggtgctgtcggacatgaagagacacaagaagctggaggagcagatccttcgtaccgggagggacctcttcagcctggactcggaggaccccagccccgccagccccccactccgatcctccgggagtagtctcttccctcggcagcggaaatactgattcccactgctcctgcctctagggtgcagtgtccgtacctgctggagcctgggccctccttccccagcccagacattgagaaacttgggaagaagagagaaacctcaagctcccaaacagcacgttgcgggaaagaggaagagagagtgtgagtgtgtgtgtgtgttttttctattgaacacctgtagagtgtgtgtgtgtgttttctattgaacacctatagagagagtgtgtgtgttttctattgaacatctatatagagagagtgtgtgagtgtgtgttttctattgaacacctattcagagacctggactgaattttctgagtctgaaataaaagatgcagagctatcatctcttaaaa

SEQ ID NO: 163974 - DNA, 5003 bp, Homo sapiens
  Payload ID: 12285
  Gene Symbol: PKNOX1
  Gene Name: PBX/knotted 1 homeobox 1
  Uniprot ID: P55347
  ENST ID: ENST00000291547
  CDS Start-End: 212-1522
gaatattgatgcggcgcgcgtcggcgtcgccctcctcccattgagcgaggctgtgtcgcgtggcccagcgtcggcgtgacggttggacgcgggcgcggcactgcgggtcccgattgctgcagccgcttgtcagtgtgatgaagattggcacccagacaccattcgcttttcacccaagatgatttgatgtcttataaaactctgatgaaccatgatggctacacagacattaagtatagacagctatcaagatgggcaacagatgcaagtagtaacagagttaaagacagaacaagatccaaactgctctgaacccgatgcagaaggagtgagccctccccctgtggagtctcagaccccgatggatgtggacaagcaggccatttataggcatccactatttccattattagctttgttgtttgaaaaatgtgaacaatctacacagggctctgaaggcacaacttctgccagttttgatgtagacatcgaaaattttgtaagaaagcaagagaaggaagggaaacctttcttttgtgaagatccagaaactgataatttaatggtaaaagcaatccaggttttgcgcattcatcttcttgagctggaaaaggttaacgaactctgcaaagatttctgcagtcgatacattgcttgtctgaaaacaaaaatgaacagtgaaactctgttgagtggagagcctggaagcccgtactcaccagtgcagtcccagcagattcaaagtgccatcacaggcaccatcagccctcagggaattgtggtgccggcgtccgcgctgcagcagggaaacgtagccatggcgacggtggcaggtggcacagtgtatcagcctgtcacggtcgtcactccccaaggccaagtggtcacacagacattgtcgcctgggacaattaggatccagaactcccagcttcagttacagttaaaccaagatctcagcatcttgcatcaagatgatggttcatctaagaacaagaggggcgtcctgccaaagcatgccacgaacgtgatgcggtcctggctcttccagcacatcgggcatccctacccaacagaggatgagaaaaaacagattgctgctcagacaaatttgacactactccaagtcaacaactggttcatcaatgccagaagacgaattcttcagccaatgttggattcaagttgttcagagacccccaaaacaaagaaaaaaactgctcagaaccggccagttcagaggttttggcctgattctattgcatcaggagtcgcacagccaccgccgagcgagctcaccatgtcggaaggagctgttgtcaccatcaccacgcccgtgaacatgaacgtggacagccttcagtctctgtcctcggacggggccaccctggcggtgcagcaggtcatgatggcagggcagagcgaggacgagtctgtggacagcacagaggaggatgcgggtgccctggcccctgcccacatcagcgggctggtcttggagaacagtgactccctgcagtaggggcaggagcagacgcacctgactttttggagtttgcacagcaaacattttacacagttttatttctaatatgttttatatgtagatatagaagagtgcacttttgtatttcatagtaagcttaaagcgcgtctttgccggtgcagcgacttctttcaagtgtgtgtgtgtgtgtgtgtgtgtgtgtgtgtgcgtgtgtgcgtgtgtgtggatttttaaagaaattctttaaaggtttaacgctagattgtgaggaatgacacaccactccctccccaccttgaatccctaattagattaaggaatagcgctgccattttctaaaccgtgatgcggttgtcacttagttctgtggttccagcagatctcagtgggctggttgatttgtgtggcccatggatttgaaagaagctgctgcacccgaaactgccagtgtgcggtgacaacggcacacgcctagactgagtgtggtttcgtcgtgagtggatggacggcaagcttagcaagcctaagtcccctcatgttcagtgagcctgtttcatttgctatatagaaaaagaaactcctatttttaccttgctggaattattggataaaaaagctatttttataaattcgttatgaattggatgatgactatattgaggataaaatttctagagaagaaacaatacatgcttgctattaatatttcaatttggaatgttctgaattgaccaaatttaatgaacctgcccaaagttagctaccgttccatggttctttgctctccccgggtagtgatgaacatttactactataaaagaaacagctatttaatgaaattttgatatctgcaaatttttgttgatatgtaatgctcagattgcattttacacttgatctaaacatatatcgaaagatatctgctaaacaggacttcaggtaagtgaggtgaaatggtagccagtgacccgttaggagctctcaccgtacatactccagtctaatttaaatctgaccacagttgcatggtcgctttaccatgttagctgtgtattgttttaaaagttttaacttcaaaatatgttatgcacagaatgtttattataaactaatataaaatgtgctctaccccattggctcagagctagggcaaacagcagatattcagactttattacttaactagcggacatccctggagtcccagcagcgagctggtctggcgagggcacctcggcagcccccacgggttggctcctacgtttgcgtttgtggctggtctcctggtgtcagtgttctcttgtacgttgttgctttcgacttttcagagccctcctgctcacttgaccacgtgagatttggaataactgtaggacttctgtttcctggtaacaagatgaaccgagagagtgggctgggttctgttttctttggttttgatttgttttcattgtttacttaggagtggtgctttttctcagaaaacaggccacggtgtttcatacagaatgtcttcatatcatctgaaatggtatggctgaagttcatttgtttacagggtcgggaatgtcttcagttcttgagagtcaacagtaatgattggttgtaagccaagggacattttaagctagtgaagagttttttctggaattgatttttcccaaaagaatatattaattgaggttaagaagtcagtgggaaacacacagaaatttgttttaaaatctttcaggagctttactgaaagacttggttatcaagtcttttggggagagaatgacattttttttttgagacagagttttgctcttgttgcccaggctggagggcaatggtgcaatctcagctcactgcaacctccacctcttatgttcaagcaattctccttccttagcctcctgagtagctgggattacaggcatgcgccaccacacccggctaattttgtatttttagtagagatgggtttctccatgttggtcgggctggtctcgaactcccgacctcaggtgatctgcctgcctcagcctcccaaagtgctgggattacaggtgtgagccaccgcgcccggccgagaatgacatcttaaagccaccattgcgttcctcatttgtgaactgtcttctcatattttaagtcaagtctataagatcatttttaacctaagttccaactttgttggactccttaaaataagcacccatgaaagccagccagcccttcctccttccctcaccaccctccgtctcttcggctgcttgctctttagtgtagattagtggaagccattcacagaatgtagactcatgtataggtcaccgtttctttcccccactagaaatcacattcactaagcagtggattgaatttaagagtgctgcccctgcccggcgcagtagggcgtgcctctagttccagctactcgggagtctgaggcagaggatggcatgtgccaggagtttgaggctgcagtgcactatgcttgcacctgtgaatagccactgcactccatcttgggcaacacagtgagacccccatctataaaaagagagcactgcctgaacctcggtggcactgggaagctctggcctgagagttaaacacccatgctgaatgatacagtgtgcattctctccagctgcaaactttcttcaactttcctaaattcttactaaattcagaggaataggataaagatcacttagagaaagggtgcttatggacatagcctgagtttcctttaacctctctgcaatgggtgcttttaactagcttctacatggcaagctgtttcagtttgcaaaatcactgcccagcatgtttgaggtcagttggcaccttaaaacacctgttctccagcccttggacagtggagagaatctgtaaaagtgtgaccccctctaagatttcgttttaaatgatcagattcggttccagttttattcttgttgagtttttccctatgaaggctccttttgaatgtgtcttgagacccaaattgagcatgttgctgttattcctgccctgcacctgtggagcaggagtggcagggctggctgtgctgggttccagctcgctcccaccgagggactagcttggcctttgcgctttgattccagatagtaagatgagtggaagtgtttatcgagcatgcaaaagaaaccctcacggctaagggctctgggagttgtgtctgtgtgacctgagagtgatccatctcctgcctgtgtgaggtagcagtgggcacttttcattgagacaaactccagggtgtccagagggggttctgccccttgtgaaggcccattcctggcacttagagacagaaagaactcagcaatctttcgttctagttatattcggtctttgaaactgacaatctttgaaatgtgaatactgtaacaatatgttttcttggattgttgtctttaaaaaggatttttgtgaagcaattgatttatcaaagcaaaaaaattaaaaatagaaacttgcttta

SEQ ID NO: 163975 - DNA, 5180 bp, Homo sapiens
  Payload ID: 12285
  Gene Symbol: PKNOX1
  Gene Name: PBX/knotted 1 homeobox 1
  ENST ID: ENST00000432907
  CDS Start-End: 391-1350
gaatattgatgcggcgcgcgtcggcgtcgccctcctcccattgagcgaggctgtgtcgcgtggcccagcgtcggcgtgacggttggacgcgggcgcggcactgcgggtcccgattgctgcagccgcttgtcagtgtgatgaagattggcacccagacaccattcgcttttcacccaagatgatttgatgtcttataaaactctgatgaaccatgatggctacacagacattaagtatagacagctatcaagatgggcaacagatgcaagtagtaacagagttaaagacagaacaagatccaaactgctctgaacccgatgcagaaggagtgagccctccccctgtggagtctcagaccccgatggatgtggacaagcaggccatttatagatggtaaaagcaatccaggttttgcgcattcatcttcttgagctggaaaaggttaacgaactctgcaaagatttctgcagtcgatacattgcttgtctgaaaacaaaaatgaacagtgaaactctgttgagtggagagcctggaagcccgtactcaccagtgcagtcccagcagattcaaagtgccatcacaggcaccatcagccctcagggaattgtggtgccggcgtccgcgctgcagcagggaaacgtagccatggcgacggtggcaggtggcacagtgtatcagcctgtcacggtcgtcactccccaaggccaagtggtcacacagacattgtcgcctgggacaattaggatccagaactcccagcttcagttacagttaaaccaagatctcagcatcttgcatcaagatgatggttcatctaagaacaagaggggcgtcctgccaaagcatgccacgaacgtgatgcggtcctggctcttccagcacatcgggcatccctacccaacagaggatgagaaaaaacagattgctgctcagacaaatttgacactactccaagtcaacaactggttcatcaatgccagaagacgaattcttcagccaatgttggattcaagttgttcagagacccccaaaacaaagaaaaaaactgctcagaaccggccagttcagaggttttggcctgattctattgcatcaggagtcgcacagccaccgccgagcgagctcaccatgtcggaaggagctgttgtcaccatcaccacgcccgtgaacatgaacgtggacagccttcagtctctgtcctcggacggggccaccctggcggtgcagcaggtcatgatggcagggcagagcgaggacgagtctgtggacagcacagaggaggatgcgggtgccctggcccctgcccacatcagcgggctggtcttggagaacagtgactccctgcagtaggggcaggagcagacgcacctgactttttggagtttgcacagcaaacattttacacagttttatttctaatatgttttatatgtagatatagaagagtgcacttttgtatttcatagtaagcttaaagcgcgtctttgccggtgcagcgacttctttcaagtgtgtgtgtgtgtgtgtgtgtgtgtgtgtgtgcgtgtgtgcgtgtgtgtggatttttaaagaaattctttaaaggtttaacgctagattgtgaggaatgacacaccactccctccccaccttgaatccctaattagattaaggaatagcgctgccattttctaaaccgtgatgcggttgtcacttagttctgtggttccagcagatctcagtgggctggttgatttgtgtggcccatggatttgaaagaagctgctgcacccgaaactgccagtgtgcggtgacaacggcacacgcctagactgagtgtggtttcgtcgtgagtggatggacggcaagcttagcaagcctaagtcccctcatgttcagtgagcctgtttcatttgctatatagaaaaagaaactcctatttttaccttgctggaattattggataaaaaagctatttttataaattcgttatgaattggatgatgactatattgaggataaaatttctagagaagaaacaatacatgcttgctattaatatttcaatttggaatgttctgaattgaccaaatttaatgaacctgcccaaagttagctaccgttccatggttctttgctctccccgggtagtgatgaacatttactactataaaagaaacagctatttaatgaaattttgatatctgcaaatttttgttgatatgtaatgctcagattgcattttacacttgatctaaacatatatcgaaagatatctgctaaacaggacttcaggtaagtgaggtgaaatggtagccagtgacccgttaggagctctcaccgtacatactccagtctaatttaaatctgaccacagttgcatggtcgctttaccatgttagctgtgtattgttttaaaagttttaacttcaaaatatgttatgcacagaatgtttattataaactaatataaaatgtgctctaccccattggctcagagctagggcaaacagcagatattcagactttattacttaactagcggacatccctggagtcccagcagcgagctggtctggcgagggcacctcggcagcccccacgggttggctcctacgtttgcgtttgtggctggtctcctggtgtcagtgttctcttgtacgttgttgctttcgacttttcagagccctcctgctcacttgaccacgtgagatttggaataactgtaggacttctgtttcctggtaacaagatgaaccgagagagtgggctgggttctgttttctttggttttgatttgttttcattgtttacttaggagtggtgctttttctcagaaaacaggccacggtgtttcatacagaatgtcttcatatcatctgaaatggtatggctgaagttcatttgtttacagggtcgggaatgtcttcagttcttgagagtcaacagtaatgattggttgtaagccaagggacattttaagctagtgaagagttttttctggaattgatttttcccaaaagaatatattaattgaggttaagaagtcagtgggaaacacacagaaatttgttttaaaatctttcaggagctttactgaaagacttggttatcaagtcttttggggagagaatgacattttttttttgagacagagttttgctcttgttgcccaggctggagggcaatggtgcaatctcagctcactgcaacctccacctcttatgttcaagcaattctccttccttagcctcctgagtagctgggattacaggcatgcgccaccacacccggctaattttgtatttttagtagagatgggtttctccatgttggtcgggctggtctcgaactcccgacctcaggtgatctgcctgcctcagcctcccaaagtgctgggattacaggtgtgagccaccgcgcccggccgagaatgacatcttaaagccaccattgcgttcctcatttgtgaactgtcttctcatattttaagtcaagtctataagatcatttttaacctaagttccaactttgttggactccttaaaataagcacccatgaaagccagccagcccttcctccttccctcaccaccctccgtctcttcggctgcttgctctttagtgtagattagtggaagccattcacagaatgtagactcatgtataggtcaccgtttctttcccccactagaaatcacattcactaagcagtggattgaatttaagagtgctgcccctgcccggcgcagtagggcgtgcctctagttccagctactcgggagtctgaggcagaggatggcatgtgccaggagtttgaggctgcagtgcactatgcttgcacctgtgaatagccactgcactccatcttgggcaacacagtgagacccccatctataaaaagagagcactgcctgaacctcggtggcactgggaagctctggcctgagagttaaacacccatgctgaatgatacagtgtgcattctctccagctgcaaactttcttcaactttcctaaattcttactaaattcagaggaataggataaagatcacttagagaaagggtgcttatggacatagcctgagtttcctttaacctctctgcaatgggtgcttttaactagcttctacatggcaagctgtttcagtttgcaaaatcactgcccagcatgtttgaggtcagttggcaccttaaaacacctgttctccagcccttggacagtggagagaatctgtaaaagtgtgaccccctctaagatttcgttttaaatgatcagattcggttccagttttattcttgttgagtttttccctatgaaggctccttttgaatgtgtcttgagacccaaattgagcatgttgctgttattcctgccctgcacctgtggagcaggagtggcagggctggctgtgctgggttccagctcgctcccaccgagggactagcttggcctttgcgctttgattccagatagtaagatgagtggaagtgtttatcgagcatgcaaaagaaaccctcacggctaagggctctgggagttgtgtctgtgtgacctgagagtgatccatctcctgcctgtgtgaggtagcagtgggcacttttcattgagacaaactccagggtgtccagagggggttctgccccttgtgaaggcccattcctggcacttagagacagaaagaactcagcaatctttcgttctagttatattcggtctttgaaactgacaatctttgaaatgtgaatactgtaacaatatgttttcttggattgttgtctttaaaaaggatttttgtgaagcaattgatttatcaaagcaaaaaaattaaaaatagaaacttgctttatggatgttttattttataaagctcatgtcaccaaaagctgcttctccattttatgtaaaacattgagaatgttttcatgttttctggtgacatgtagggtctgtagtcacccctgcatattgagaaactaggaccacactgcatcggactagtcaggtccatttacatgtccaagaatcttttcttaaattccttactttgttcattcattggctgttcaggcagaaaatggaaacaggtagcttttatgttttttattatagttttccacaaatctaattattttgatagttacaagaagataatgattcatcagtaagctaacataatccctttcatagttcatatt

SEQ ID NO: 163976 - DNA, 1429 bp, Homo sapiens
  Payload ID: 12285
  Gene Symbol: PKNOX1
  Gene Name: PBX/knotted 1 homeobox 1
  ENST ID: ENST00000560448
  CDS Start-End: 61-246
ccagacaccattcgcttttcacccaagatgatttgatgtcttataaaactctgatgaaccatgatggctacacagacattaagtatagacagctatcaagatgggcaacagatgcaagtagtaacagagttaaagacagaacaagatccaaactgctctgaacccgatgcagaaggagtgagccctccccctgtggagtctcagaccccgatggatgtggacaagcaggccatttatagatggtaaaagcaatccaggttttgcgcattcatcttcttgagctggaaaaggttaacgaactctgcaaagatttctgcagtcgatacattgcttgtctgaaaacaaaaatgaacagtgaaactctgttgagtggagagcctggaagcccgtactcaccagtgcagtcccagcagattcaaagtgccatcacaggcaccatcagccctcagggaattgtggtgccggcgtccgcgctgcagcagggaaacgtagccatggcgacggtggcaggtggcacagtgtatcagcctgtcacggtcgtcactccccaaggccaagtggtcacacagacattgtcgcctgggacaattaggatccagaactcccagcttcagttacagttaaaccaagatctcagcatcttgcatcaagatgatggttcatctaagaacaagaggggcgtcctgccaaagcatgccacgaacgtgatgcggtcctggctcttccagcacatcgggcatccctacccaacagaggatgagaaaaaacagattgctgctcagacaaatttgacactactccaagtcaacaactggttcatcaatgccagaagacgaattcttcagccaatgttggattcaagttgttcagagacccccaaaacaaagaaaaaaactgctcagaaccggccagttcagaggttttggcctgattctattgcatcaggagtcgcacagccaccgccgagcgagctcaccatgtcggaaggagctgttgtcaccatcaccacgcccgtgaacatgaacgtggacagccttcagtctctgtcctcggacggggccaccctggcggtgcagcaggtcatgatggcagggcagagcgaggacgagtctgtggacagcacagaggaggatgcgggtgccctggcccctgcccacatcagcgggctggtcttggagaacagtgactccctgcagtaggggcaggagcagacgcacctgactttttggagtttgcacagcaaacattttacacagttttatttctaatatgttttatatgtagatatagaagagtgcacttttgtatttcatagtaagcttaaagcgcgtctttgccggtgcagcgacttctttcaagtgtgtgtgtgtgtgtgtgtgtgtgtgtgtgtgcgtgtgtgcgtgtgtgtggatttttaaagaaattcttt

SEQ ID NO: 163977 - DNA, 3687 bp, Homo sapiens
  Payload ID: 12286
  Gene Symbol: PKNOX2
  Gene Name: PBX/knotted 1 homeobox 2
  Uniprot ID: Q96KN3
  ENST ID: ENST00000298282
  CDS Start-End: 272-1690
gtcccgagcagtgctgggaagtataggctgtgttgtcacgccggtgtcagtctgatgaagattggcatcaggtgaagtctggagcaggacttctgaggctttctatcctccatgctgctcactagaaaaggggctgtgaactgtgctttggctctagcagacaggaagaaattctggcccagctggaagtagaaagaggggagtgagtctcctgaggaccatctcagaggccccgggatcacccgaacagtcctccatgtgaatcaatcccatgatgcaacatgcctccccagcccccgctctgacgatgatggccacgcagaatgtcccgcccccaccctaccaggacagcccacagatgacggcaaccgcccagccaccctccaaggcccaggctgtccacatctctgccccctcagctgctgccagcacacctgtgcccagtgcccccatcgacccccaggcccagctggaggctgacaagcgagctgtatacaggcaccctcttttcccgctcctgacgctgctgtttgagaaatgtgaacaggccacccagggctctgagtgcatcacctccgccagctttgatgtggacatcgagaactttgtccaccagcaggaacaggagcacaaacccttcttcagcgatgacccagaactggacaatctgatggtgaaggcaatccaggtcctgagaatccacctgctggagctggagaaagtcaatgaactctgcaaggacttttgtaaccgttacatcacctgcctcaaaaccaagatgcacagcgacaacctgctcaggaatgatctaggggggccctactcccccaaccagccctccatcaaccttcactcacaggacctcctgcagaattcccccaattccatgtccggagtctccaataacccccaggggattgtggtcccagcctcagcgctccagcagggcaacatcgccatgacaaccgtcaactcacaagttgtgtcaggtggagccttataccaaccggttaccatggtaacctcccagggtcaggtggtcacccaagcaatcccccagggagccatccagatccagaacacacaggttaaccttgacctcacctccctcctggacaatgaggataagaagtccaagaacaaacgaggagtcttgcccaagcatgccaccaatataatgcgttcttggctcttccagcatctcatgcacccctaccccacggaggatgagaagaggcagatcgcagcccagaccaacctcaccctcctgcaagtaaacaactggttcatcaatgcccggaggcgcatcctgcagcccatgcttgatgccagcaacccagatcctgcccccaaagccaagaagatcaagtctcagcaccggcccacccaaagattctggcccaactccatcgctgcgggggtgctgcagcagcagggcggtgccccagggacaaaccccgatggttccatcaacttggacaacctgcagtccctgtcctcagacagtgccaccatggccatgcagcaggctatgatggctgcacacgatgactcattggatgggacagaagaagaggatgaggatgagatggaagaggaggaggaggaggagctggaggaggaggtcgacgagctgcagacgacaaatgtcagcgacctgggcttggaacacagtgactccctggagtagtcgggcagcccagatggcactgatcactgagcaggagaggagtgtcgccgggaggccttcagggtgggggggaaggggacatgggcaggaagcaccgagggagttgggccctagcttccccaaatcagtagcttgaagaaaggcaaaggagacacctgttccttcccaaccaccgagcttcaatgaggaccccagccccacttccctggaactgccgaggactctgtttggcggggccagtcgagcagcctgtgtggaaagacaggagtgagatctggactcaccaaatccctgaggatagatggcacccatggcccccacccacggaaggacttgagttgtttacaagccctgcactgaggcagattggtgctgttcgcagagtaggcctttgcccgggggcagacttagaaggaaggggagagacaaagggggactgagtttcatccccagaagtttctcagctcctttgacagacattcaagggcaggagggagccccaaagcataaccagtggccagaggagtgggagggcctgaggcatcacatcttgcagatcagaatgggatggaatccaccaggctccagctcatccctccaaggccctgtctctgcgcacagcaaccatggacatgggagaaagggatgggagccacagtgcccttcactctctcctggaaaccaactgtaagctggtgggctcaacctgtgggaggttaagaggagtcccttctgggttgactccaagagccaaggagatggcagaccctgggctaggaaccatatggaggtgactttgaggccacagctgtccctaggtgatcacagaacttagctcctttaacaacaggacaatggttttttaccctagatgttcccaccttcagtgctccacgccctccatagaccttcagagaaggtgaaaccaggttatctgggaatctttccagcccgcaggtcgccacggccatccctttgctcccagcctggctccatcagcctccagcttcctttcttcattctgtccttcagggaaggcagaagaaacattggaaagcatctagtccagtgggaagccaggggttggagaaggtgctacatccctcttcccatcaatatcctaaatgtgggggagggcccagagaatggcacccaagagcctgcggggatgcccatcccacacaccccacccagctgttctaaccctgctatccacagccctggaggaactggggctcctggaaggaggaggaggctctccactgtccaccctaacacataccctcccacccaccttccagacccccttggttggcaccctctcctccggttccctctcaccccatggctgtgaatgacaggacaggtcacacgtgtgttttccattgggtttaatttaatggacgtgcagtttcatttgtaaattgtgcattggccacctccttcagtggcaggatgtgagtggctacctggctcaactggaggggaccccttgggccctctggggcttcccctcccccacctggttggggtagagcaaaaggatggtcactcttccgaggtctccctgaaatgaatgtatttctcccccaaaagagctgatatttaatgttttaataaggatttttgagaaacaaataaccttatttataatctgggtgatccaatcattttttactcccttttgatgccatacatagaggaaagtctagcttttttggcgtgagacttttgcaatgtgcagtgggataaaatgcatttccttttctggttcgtttttcttgttaacacgcgcacacagacacacacacacaccgttccactcaccacctggacaggcgtcccccagcacggacacactggcacacaggtgcccacatctcttcctctcagcccctccacctgcctaatgttatgcaacctccttctgatgtatccaccaaaccagtactgaatgtggccgagacgttttcagtaaatcttattacctaccgtaa

SEQ ID NO: 163978 - DNA, 545 bp, Homo sapiens
  Payload ID: 12286
  Gene Symbol: PKNOX2
  Gene Name: PBX/knotted 1 homeobox 2
  ENST ID: ENST00000527238
  CDS Start-End: 429-545
gtgttgtcacgccggtgtcagtctgatgaagattggcatcaggtgaagtctggagcaggacttctgaggctttctatcctccatgctgctcactagaaaaggggctgtgaactattgcatctacagacagtcagagtgcccgcaagaaatcaggcaatgagcgtaaaaacaacagactcgatccaccccgctcgaccagatcttgatgggaacctatgctcgaagggtgctttggctctagcagacaggaagaaattctggcccagctggaagtagaaagaggggagtgagtctcctgaggaccatctcagaggccccgggatcacccgaacatatgccatgataagggctggatctgttatggtgagattgggccccaactccaaaggaccttgcccaggattttgtcctccatgtgaatcaatcccatgatgcaacatgcctccccagcccccgctctgacgatgatggccacgcagaatgtcccgcccccaccctaccaggacagcccacagatgacggcaaccgcccagccaccctccaag

SEQ ID NO: 163979 - DNA, 521 bp, Homo sapiens
  Payload ID: 12286
  Gene Symbol: PKNOX2
  Gene Name: PBX/knotted 1 homeobox 2
  ENST ID: ENST00000531212
  CDS Start-End: 400-521
attgccaaatgagcgacactaacaagagtgatgctctcagaggaaggacagactgagtggactgcaaggataggggagacttctggaagaggtggatggtgtggcagacccttgacactcattccccttcagcaggcttggaatgtggggatgactatccccattttcacatatggcaaaggcccaagccacacagctggtgaagtctggagcaggacttctgaggctttctatcctccatgctgctcactagaaaaggggctgtgaactgtgctttggctctagcagacaggaagaaattctggcccagctggaagtagaaagaggggagtgagtctcctgaggaccatctcagaggccccgggatcacccgaacagtcctccatgtgaatcaatcccatgatgcaacatgcctccccagcccccgctctgacgatgatggccacgcagaatgtcccgcccccaccctaccaggacagcccacagatgacggcaaccgcccagccaccctccaaggccca

SEQ ID NO: 163980 - DNA, 1654 bp, Homo sapiens
  Payload ID: 12286
  Gene Symbol: PKNOX2
  Gene Name: PBX/knotted 1 homeobox 2
  ENST ID: ENST00000532623
  CDS Start-End: 224-346
agtctgatgaagattggcatcaggtgaagtctggagcaggacttctgaggctttctatcctccatgctgctcactagaaaaggggctgtgaactgtgctttggctctagcagacaggaagaaattctggcccagctggaagtagaaagaggggagtgagtctcctgaggaccatctcagaggccccgggatcacccgaacagtcctccatgtgaatcaatcccatgatgcaacatgcctccccagcccccgctctgacgatgatggccacgcagaatgtcccgcccccaccctaccaggacagcccacaggcaccctcttttcccgctcctgacgctgctgtttgagaaatgtgaacaggccacccagggctctgagtgcatcacctccgccagctttgatgtggacatcgagaactttgtccaccagcaggaacaggagcacaaacccttcttcagcgatgacccagaactggacaatctgatggtgaaggcaatccaggtcctgagaatccacctgctggagctggagaaagtcaatgaactctgcaaggacttttgtaaccgttacatcacctgcctcaaaaccaagatgcacagcgacaacctgctcaggaatgatctaggggggccctactcccccaaccagccctccatcaaccttcactcacaggacctcctgcagaattcccccaattccatgtccggagtctccaataacccccaggggattgtggtcccagcctcagcgctccagcagggcaacatcgccatgacaaccgtcaactcacaagttgtgtcaggtggagccttataccaaccggttaccatggtaacctcccagggtcaggtggtcacccaagcaatcccccagggagccatccagatccagaacacacaggttaaccttgacctcacctccctcctggacaatgaggataagaagtccaagaacaaacgaggagtcttgcccaagcatgccaccaatataatgcgttcttggctcttccagcatctcatgcacccctaccccacggaggatgagaagaggcagatcgcagcccagaccaacctcaccctcctgcaagtaaacaactggttcatcaatgcccggaggcgcatcctgcagcccatgcttgatgccagcaacccagatcctgcccccaaagccaagaagatcaagtctcagcaccggcccacccaaagattctggcccaactccatcgctgcgggggtgctgcagcagcagggcggtgccccagggacaaaccccgatggttccatcaacttggacaacctgcagtccctgtcctcagacagtgccaccatggccatgcagcaggctatgatggctgcacacgatgactcattggatgggacagaagaagaggatgaggatgagatggaagaggaggaggaggaggagctggaggaggaggtcgacgagctgcagacgacaaatgtcagcgacctgggcttggaacacagtgactccctggagtagtcgggcagcccagatggcactgatcactgagcaggagaggagtgtcgccgggaggccttcagggtgggggggaaggggacatgggcaggaagcaccgagggagttgggccctagcttccccaaatcagtagcttgaagaaaggcaaaggaga

SEQ ID NO: 163981 - DNA, 554 bp, Homo sapiens
  Payload ID: 12286
  Gene Symbol: PKNOX2
  Gene Name: PBX/knotted 1 homeobox 2
  ENST ID: ENST00000558705
  CDS Start-End: 260-554
tatctcccaggtttgctgctggggtggccgcagaaccgggagtcggtcacagagttcacagacgaggtcacatggaggagaagcctggtgccaggaacaagctaggagtaactggaccacgatgacgcctgtgctttggctctagcagacaggaagaaattctggcccagctggaagtagaaagaggggagtgagtctcctgaggaccatctcagaggccccgggatcacccgaacagtcctccatgtgaatcaatcccatgatgcaacatgcctccccagcccccgctctgacgatgatggccacgcagaatgtcccgcccccaccctaccaggacagcccacagatgacggcaaccgcccagccaccctccaaggcccaggctgtccacatctctgccccctcagctgctgccagcacacctgtgcccagtgcccccatcgacccccaggcccagctggaggctgacaagcgagctgtatacaggcaccctcttttcccgctcctgacgctgctgtttgagaaatgtgaacaggccacccagggctctgagt

SEQ ID NO: 163982 - DNA, 1966 bp, Homo sapiens
  Payload ID: 12287
  Gene Symbol: PSIP1
  Gene Name: PC4 and SFRS1 interacting protein 1
  Uniprot ID: O75475
  ENST ID: ENST00000380715
  CDS Start-End: 314-1303
gccgagcgggagccgcgcgggagcagcgcagctacggcggcggcagcggcggcgcggttgcgattccgagccgttgagacgcctctgcggcagctggtggcgcaggtggcttgcgtggacgcgggtagaggcgaccggccagcaaccgcagcgtcggcgcccgcggccccggcaggcgcgtcgggacgccccgaggcatcctcccccgcccgcgggcccggtagctgggcccgcgtccgccgcccgcatccccgcgccgccgcatctcctcgccgcctcccgggcttcggacccccggtctcgcccccgaaacatgactcgcgatttcaaacctggagacctcatcttcgccaagatgaaaggttatccccattggccagctcgagtagacgaagttcctgatggagctgtaaagccacccacaaacaaactacccattttcttttttggaactcatgagactgcttttttaggaccaaaggatatatttccttactcagaaaataaggaaaagtatggcaaaccaaataaaagaaaaggttttaatgaaggtttatgggagatagataacaatccaaaagtgaaattttcaagtcaacaggcagcaactaaacaatcaaatgcatcatctgatgttgaagttgaagaaaaggaaactagtgtttcaaaggaagataccgaccatgaagaaaaagccagcaatgaggatgtgactaaagcagttgacataactactccaaaagctgccagaagggggagaaagagaaaggcagaaaaacaagtagaaactgaggaggcaggagtagtgacaacagcaacagcatctgttaatctaaaagtgagtcctaaaagaggacgacctgcagctacagaagtcaagattccaaaaccaagaggcagacccaaaatggtaaaacagccctgtccttcagagagtgacatcattactgaagaggacaaaagtaagaaaaaggggcaagaggaaaaacaacctaaaaagcagcctaagaaggatgaagagggccagaaggaagaagataagccaagaaaagagccggataaaaaagaggggaagaaagaagttgaatcaaaaaggaaaaatttagctaaaacaggggttacttcaacctccgattctgaagaagaaggagatgatcaagaaggtgaaaagaagagaaaaggtgggaggaactttcagactgctcacagaaggaatatgctgaaaggccaacatgagaaagaagcagcagatcgaaaacgcaagcaagaggaacaaatggaaactgagcattttgctctgtaaagcatttcagatgcagcttgtgtgaaatgcattatgcaaaataaagtttattgtattgtattcccagccaaacaacatgtaatctacagtaataaaaaatatatctcattttgggctcaaagcattaatccagttactgaaaagagaatacaagtggagcaaacaagagatgaagatcttgatacagactcattggactgaatttcccccttccccccattgatggaagaatgttccagattctaaattgaggacttcattattaatggcattactgtgttatgattaacaaatttcctgtaaggtacacactacatactaaggtcggccatcattcctgttttttttttttttttttttttttaaccaagcttaaaatgaagctttgtgtttgaaagtaataacaagctcagacgaagatggtggttgtacattattcatctagaaaatataaaaattcattttgttttgaagctagttattaaactggaatagcagttatatccctgagaatggggcccttctcttgacattcctttgttgtttaattctttagaatcttaataaatgtttttttaatcctgagagattaaacagtagtagacttgttaagaatgaaactgtaaccaaaattttaaaataaagttttttttaaaaaaaaaa

SEQ ID NO: 163983 - DNA, 1889 bp, Homo sapiens
  Payload ID: 12287
  Gene Symbol: PSIP1
  Gene Name: PC4 and SFRS1 interacting protein 1
  Uniprot ID: O75475
  ENST ID: ENST00000380716
  CDS Start-End: 317-1318
ggcgccgagcgggagccgcgcgggagcagcgcagctacggcggcggcagcggcggcgcggttgcgattccgagccgttgagacgcctctgcggcagctggtggcgcaggtggcttgcgtggacgcgggtagaggcgaccggccagcaaccgcagcgtcggcgcccgcggccccggcaggcgcgtcgggacgccccgaggcatcctcccccgcccgcgggcccggtagctgggcccgcgtccgccgcccgcatccccgcgccgccgcatctcctcgccgcctcccgggcttcggacccccggtctcgcccccgaaacatgactcgcgatttcaaacctggagacctcatcttcgccaagatgaaaggttatccccattggccagctcgagtagacgaagttcctgatggagctgtaaagccacccacaaacaaactacccattttcttttttggaactcatgagactgcttttttaggaccaaaggatatatttccttactcagaaaataaggaaaagtatggcaaaccaaataaaagaaaaggttttaatgaaggtttatgggagatagataacaatccaaaagtgaaattttcaagtcaacaggcagcaactaaacaatcaaatgcatcatctgatgttgaagttgaagaaaaggaaactagtgtttcaaaggaagataccgaccatgaagaaaaagccagcaatgaggatgtgactaaagcagttgacataactactccaaaagctgccagaagggggagaaagagaaaggcagaaaaacaagtagaaactgaggaggcaggagtagtgacaacagcaacagcatctgttaatctaaaagtgagtcctaaaagaggacgacctgcagctacagaagtcaagattccaaaaccaagaggcagacccaaaatggtaaaacagccctgtccttcagagagtgacatcattactgaagaggacaaaagtaagaaaaaggggcaagaggaaaaacaacctaaaaagcagcctaagaaggatgaagagggccagaaggaagaagataagccaagaaaagagccggataaaaaagaggggaagaaagaagttgaatcaaaaaggaaaaatttagctaaaacaggggttacttcaacctccgattctgaagaagaaggagatgatcaagaaggtgaaaagaagagaaaaggtgggaggaactttcagactgctcacagaaggaatatgctgaaaggccaacatgagaaagaagcagcagatcgaaaacgcaagcaagaggaacaaatggaaactgagcaccaaacaacatgtaatctacagtaataaaaaatatatctcattttgggctcaaagcattaatccagttactgaaaagagaatacaagtggagcaaacaagagatgaagatcttgatacagactcattggactgaatttcccccttccccccattgatggaagaatgttccagattctaaattgaggacttcattattaatggcattactgtgttatgattaacaaatttcctgtaaggtacacactacatactaaggtcggccatcattcctgttttttttttttttttttttttttaaccaagcttaaaatgaagctttgtgtttgaaagtaataacaagctcagacgaagatggtggttgtacattattcatctagaaaatataaaaattcattttgttttgaagctagttattaaactggaatagcagttatatccctgagaatggggcccttctcttgacattcctttgttgtttaattctttagaatcttaataaatgtttttttaatcctgagagattaaacagtagtagacttgttaagaatgaaactgtaaccaaaattttaaaataaagttttttttaaaaaaaaaa

SEQ ID NO: 163984 - DNA, 3391 bp, Homo sapiens
  Payload ID: 12287
  Gene Symbol: PSIP1
  Gene Name: PC4 and SFRS1 interacting protein 1
  Uniprot ID: O75475
  ENST ID: ENST00000380733
  CDS Start-End: 345-1937
agttggtcgcgccccagtgctagcgggcgccgagcgggagccgcgcgggagcagcgcagctacggcggcggcagcggcggcgcggttgcgattccgagccgttgagacgcctctgcggcagctggtggcgcaggtggcttgcgtggacgcgggtagaggcgaccggccagcaaccgcagcgtcggcgcccgcggccccggcagcaggcgcgtcgggacgccccgaggcatcctcccccgcccgcgggcccggtagctgggcccgcgtccgccgcccgcatccccgcgccgccgcatctcctcgccgcctcccgggcttcggacccccggtctcgcccccgaaacatgactcgcgatttcaaacctggagacctcatcttcgccaagatgaaaggttatccccattggccagctcgagtagacgaagttcctgatggagctgtaaagccacccacaaacaaactacccattttcttttttggaactcatgagactgcttttttaggaccaaaggatatatttccttactcagaaaataaggaaaagtatggcaaaccaaataaaagaaaaggttttaatgaaggtttatgggagatagataacaatccaaaagtgaaattttcaagtcaacaggcagcaactaaacaatcaaatgcatcatctgatgttgaagttgaagaaaaggaaactagtgtttcaaaggaagataccgaccatgaagaaaaagccagcaatgaggatgtgactaaagcagttgacataactactccaaaagctgccagaagggggagaaagagaaaggcagaaaaacaagtagaaactgaggaggcaggagtagtgacaacagcaacagcatctgttaatctaaaagtgagtcctaaaagaggacgacctgcagctacagaagtcaagattccaaaaccaagaggcagacccaaaatggtaaaacagccctgtccttcagagagtgacatcattactgaagaggacaaaagtaagaaaaaggggcaagaggaaaaacaacctaaaaagcagcctaagaaggatgaagagggccagaaggaagaagataagccaagaaaagagccggataaaaaagaggggaagaaagaagttgaatcaaaaaggaaaaatttagctaaaacaggggttacttcaacctccgattctgaagaagaaggagatgatcaagaaggtgaaaagaagagaaaaggtgggaggaactttcagactgctcacagaaggaatatgctgaaaggccaacatgagaaagaagcagcagatcgaaaacgcaagcaagaggaacaaatggaaactgagcagcagaataaagatgaaggaaagaagccagaagttaagaaagtggagaagaagcgagaaacatcaatggattctcgacttcaaaggatacatgctgagattaaaaattcactcaaaattgataatcttgatgtgaacagatgcattgaggccttggatgaacttgcttcacttcaggtcacaatgcaacaagctcagaaacacacagagatgattactacactgaaaaaaatacggcgattcaaagttagtcaggtaatcatggaaaagtctacaatgttgtataacaagtttaagaacatgttcttggttggtgaaggagattccgtgatcacccaagtgctgaataaatctcttgctgaacaaagacagcatgaggaagcgaataaaaccaaagatcaagggaagaaagggccaaacaaaaagctagagaaggaacaaacagggtcaaagactctaaatggaggatctgatgctcaagatggtaatcagccacaacataacggggagagcaatgaagacagcaaagacaaccatgaagccagcacgaagaaaaagccatccagtgaagagagagagactgaaatatctctgaaggattctacactagataactaggttgacatacctggaatatagagaacacttgagaagtttgtaatggttttcatttgaaatagactgctgaaagttttaaatttttataagcataggtttgatgttgaaaacttgttttgagggagaaaatccctttgttttaaagtaaagtaaacattatcgctaagtgtacttgtgcagtattaacagctacattatacagtaaatgtgggataaaatccatttagaaaatgttaaactgcttttccagacatggttgtagcatattttcaattagtgtgtgtatgttaatgtgtaattgatagtagaacaaagttacatttttaaaactgctacttgtataaaccttgcctcttttcccaaatactgtgggttttgtgcatagtttttacaaaccttggatttaccagactgtcttttcactgtttgtgggttttgtagaagttacacatttttatggtagataaaatgttacttctatacaagtactcactccctttttatcaaaagttaattttaatctcacagtctacattgtgctacattatccagcttctttggaacaatgtgtgctctgtatggttttttttggtatgacaactaattaagcaactgacatggaactgagaattctacaaactataaaacattaatttttgaaggtaatttagttttgtggctgggcattcagtgaagtcttaggacttctttgcagacaactgactgggtatatataggaatgaatctggctttagggttaaatcatttaaggtccttttataggcaggcactagtaactaaaactgaaaactaagtaagtttatttttgaggaatgttgttaaaaatgtctttaggaagtcactaaaacttaattggaagaaaaaatcatgatgcttatacaataaatatgaataaatgttatataaggaaactcacctatttgaaatcatggctatattgtttttattttctagattccaaaaatacaaacactagttgttccagcattgtactttgataagtctgtacattgacgtgtatggactaaatccagggtaaaatcaatgttacaaaatttaagggtatgttaactaaaggatagcatttctaagatattttgaatattagggtcatttggcacttctcagcaagtaggatacttctcatgttttgaaattatatgaatatggaaaaaaatggcttaagaccagcgtctctgtatgacattgtgtggttgaccctctgagataactgttttcatctacagaattgcatttttgcttttaaagaggtcttataatggaactaggaatcaccgttttgagagaacctgcatatataccagtcattatctgtttggtccttatacagttttaacttacttagatttattctagttaagccataagttcaacgtgtaaacttgttttcattaaagaatttttctatcaaa

SEQ ID NO: 163985 - DNA, 3364 bp, Homo sapiens
  Payload ID: 12287
  Gene Symbol: PSIP1
  Gene Name: PC4 and SFRS1 interacting protein 1
  Uniprot ID: O75475
  ENST ID: ENST00000380738
  CDS Start-End: 318-1910
gggcgccgagcgggagccgcgcgggagcagcgcagctacggcggcggcagcggcggcgcggttgcgattccgagccgttgagacgcctctgcggcagctggtggcgcaggtggcttgcgtggacgcgggtagaggcgaccggccagcaaccgcagcgtcggcgcccgcggccccggcaggcgcgtcgggacgccccgaggcatcctcccccgcccgcgggcccggtagctgggcccgcgtccgccgcccgcatccccgcgccgccgcatctcctcgccgcctcccgggcttcggacccccggtctcgcccccgaaacatgactcgcgatttcaaacctggagacctcatcttcgccaagatgaaaggttatccccattggccagctcgagtagacgaagttcctgatggagctgtaaagccacccacaaacaaactacccattttcttttttggaactcatgagactgcttttttaggaccaaaggatatatttccttactcagaaaataaggaaaagtatggcaaaccaaataaaagaaaaggttttaatgaaggtttatgggagatagataacaatccaaaagtgaaattttcaagtcaacaggcagcaactaaacaatcaaatgcatcatctgatgttgaagttgaagaaaaggaaactagtgtttcaaaggaagataccgaccatgaagaaaaagccagcaatgaggatgtgactaaagcagttgacataactactccaaaagctgccagaagggggagaaagagaaaggcagaaaaacaagtagaaactgaggaggcaggagtagtgacaacagcaacagcatctgttaatctaaaagtgagtcctaaaagaggacgacctgcagctacagaagtcaagattccaaaaccaagaggcagacccaaaatggtaaaacagccctgtccttcagagagtgacatcattactgaagaggacaaaagtaagaaaaaggggcaagaggaaaaacaacctaaaaagcagcctaagaaggatgaagagggccagaaggaagaagataagccaagaaaagagccggataaaaaagaggggaagaaagaagttgaatcaaaaaggaaaaatttagctaaaacaggggttacttcaacctccgattctgaagaagaaggagatgatcaagaaggtgaaaagaagagaaaaggtgggaggaactttcagactgctcacagaaggaatatgctgaaaggccaacatgagaaagaagcagcagatcgaaaacgcaagcaagaggaacaaatggaaactgagcagcagaataaagatgaaggaaagaagccagaagttaagaaagtggagaagaagcgagaaacatcaatggattctcgacttcaaaggatacatgctgagattaaaaattcactcaaaattgataatcttgatgtgaacagatgcattgaggccttggatgaacttgcttcacttcaggtcacaatgcaacaagctcagaaacacacagagatgattactacactgaaaaaaatacggcgattcaaagttagtcaggtaatcatggaaaagtctacaatgttgtataacaagtttaagaacatgttcttggttggtgaaggagattccgtgatcacccaagtgctgaataaatctcttgctgaacaaagacagcatgaggaagcgaataaaaccaaagatcaagggaagaaagggccaaacaaaaagctagagaaggaacaaacagggtcaaagactctaaatggaggatctgatgctcaagatggtaatcagccacaacataacggggagagcaatgaagacagcaaagacaaccatgaagccagcacgaagaaaaagccatccagtgaagagagagagactgaaatatctctgaaggattctacactagataactaggttgacatacctggaatatagagaacacttgagaagtttgtaatggttttcatttgaaatagactgctgaaagttttaaatttttataagcataggtttgatgttgaaaacttgttttgagggagaaaatccctttgttttaaagtaaagtaaacattatcgctaagtgtacttgtgcagtattaacagctacattatacagtaaatgtgggataaaatccatttagaaaatgttaaactgcttttccagacatggttgtagcatattttcaattagtgtgtgtatgttaatgtgtaattgatagtagaacaaagttacatttttaaaactgctacttgtataaaccttgcctcttttcccaaatactgtgggttttgtgcatagtttttacaaaccttggatttaccagactgtcttttcactgtttgtgggttttgtagaagttacacatttttatggtagataaaatgttacttctatacaagtactcactccctttttatcaaaagttaattttaatctcacagtctacattgtgctacattatccagcttctttggaacaatgtgtgctctgtatggttttttttggtatgacaactaattaagcaactgacatggaactgagaattctacaaactataaaacattaatttttgaaggtaatttagttttgtggctgggcattcagtgaagtcttaggacttctttgcagacaactgactgggtatatataggaatgaatctggctttagggttaaatcatttaaggtccttttataggcaggcactagtaactaaaactgaaaactaagtaagtttatttttgaggaatgttgttaaaaatgtctttaggaagtcactaaaacttaattggaagaaaaaatcatgatgcttatacaataaatatgaataaatgttatataaggaaactcacctatttgaaatcatggctatattgtttttattttctagattccaaaaatacaaacactagttgttccagcattgtactttgataagtctgtacattgacgtgtatggactaaatccagggtaaaatcaatgttacaaaatttaagggtatgttaactaaaggatagcatttctaagatattttgaatattagggtcatttggcacttctcagcaagtaggatacttctcatgttttgaaattatatgaatatggaaaaaaatggcttaagaccagcgtctctgtatgacattgtgtggttgaccctctgagataactgttttcatctacagaattgcatttttgcttttaaagaggtcttataatggaactaggaatcaccgttttgagagaacctgcatatataccagtcattatctgtttggtccttatacagttttaacttacttagatttattctagttaagccataagttcaacgtgtaaacttgttttcattaaagaatttttctatcaaa

SEQ ID NO: 163986 - DNA, 1664 bp, Homo sapiens
  Payload ID: 12287
  Gene Symbol: PSIP1
  Gene Name: PC4 and SFRS1 interacting protein 1
  Uniprot ID: O75475
  ENST ID: ENST00000397519
  CDS Start-End: 102-1103
cgggcccggtagctgggcccgcgtccgccgcccgcatccccgcgccgccgcatctcctcgccgcctcccgggcttcggacccccggtctcgcccccgaaacatgactcgcgatttcaaacctggagacctcatcttcgccaagatgaaaggttatccccattggccagctcgagtagacgaagttcctgatggagctgtaaagccacccacaaacaaactacccattttcttttttggaactcatgagactgcttttttaggaccaaaggatatatttccttactcagaaaataaggaaaagtatggcaaaccaaataaaagaaaaggttttaatgaaggtttatgggagatagataacaatccaaaagtgaaattttcaagtcaacaggcagcaactaaacaatcaaatgcatcatctgatgttgaagttgaagaaaaggaaactagtgtttcaaaggaagataccgaccatgaagaaaaagccagcaatgaggatgtgactaaagcagttgacataactactccaaaagctgccagaagggggagaaagagaaaggcagaaaaacaagtagaaactgaggaggcaggagtagtgacaacagcaacagcatctgttaatctaaaagtgagtcctaaaagaggacgacctgcagctacagaagtcaagattccaaaaccaagaggcagacccaaaatggtaaaacagccctgtccttcagagagtgacatcattactgaagaggacaaaagtaagaaaaaggggcaagaggaaaaacaacctaaaaagcagcctaagaaggatgaagagggccagaaggaagaagataagccaagaaaagagccggataaaaaagaggggaagaaagaagttgaatcaaaaaggaaaaatttagctaaaacaggggttacttcaacctccgattctgaagaagaaggagatgatcaagaaggtgaaaagaagagaaaaggtgggaggaactttcagactgctcacagaaggaatatgctgaaaggccaacatgagaaagaagcagcagatcgaaaacgcaagcaagaggaacaaatggaaactgagcaccaaacaacatgtaatctacagtaataaaaaatatatctcattttgggctcaaagcattaatccagttactgaaaagagaatacaagtggagcaaacaagagatgaagatcttgatacagactcattggactgaatttcccccttccccccattgatggaagaatgttccagattctaaattgaggacttcattattaatggcattactgtgttatgattaacaaatttcctgtaaggtacacactacatactaaggtcggccatcattcctgttttttttttttttttttttttttaaccaagcttaaaatgaagctttgtgtttgaaagtaataacaagctcagacgaagatggtggttgtacattattcatctagaaaatataaaaattcattttgttttgaagctagttattaaactggaatagcagttatatccctgagaatggggcccttctcttgacattcctttgttgtttaattctttagaatcttaataaatgtttttttaatcctgagagattaaacagtagtagacttgttaagaatgaaactgtaaccaaaattttaaaataaagtttttttt

SEQ ID NO: 163987 - DNA, 306 bp, Homo sapiens
  Payload ID: 12287
  Gene Symbol: PSIP1
  Gene Name: PC4 and SFRS1 interacting protein 1
  ENST ID: ENST00000481862
  CDS Start-End: 1-198
aagagaaaaggtgggaggaactttcagactgctcacagaaggaatatgctgaaaggccaacatgagaaagaagcagcagatcgaaaacgcaagcaagaggaacaaatggaaactgagcacattaatccagttactgaaaagagaatacaagtggagcaaacaagagatgaagatcttgatacagactcattggactgaatttcccccttccccccattgatggaagaatgttccagattctaaattgaggacttcattattaatggcattactgtgttatgattaacaaatttcctgtaaggtaca

SEQ ID NO: 163988 - DNA, 1706 bp, Homo sapiens
  Payload ID: 12288
  Gene Symbol: PCED1A
  Gene Name: PC-esterase domain containing 1A
  Uniprot ID: Q9H1Q7
  ENST ID: ENST00000356872
  CDS Start-End: 347-1558
gatcccgcccccctcggagcgcccctgtggtctgacttcagcagcactttccggcaggagactgggcactcgctgtcacccgcgagctgcctccctcagcgagatctgagcatctttccggaggctaacagacctgggcttcggggtgaccactgtgcttgcctcagtttccttttctggagcaggggaaggcccggctccctgcccaaaggcggctgtgcgctaagtggcagacgctcggggagagccggcgcggggcggaccccagcgccagtagtgacaggggcgaacgccgccgggagactccagccggcgggcgagcaggcctgtcgttgctggtggcggcatggtcttctgtctgtcgagcgaggagccgcgccgcccgctgcgaagcgacatggtccacttccaggcctcggaagtccagcagctgctacacaacaagttcgtggtcatcttgggggactccattcagagggctgtgtacaaggacctggtgctcttgctccagaaagactcactgctcacagctgcccagctgaaagccaagtaccttgaggatgttctggaagagctgacatatggacctgccccggacctggtgatcatcaactcctgcctctgggatctctccagatatggtcgctgctcaatggagagctaccgggagaacctggagcgggtgtttgtgcgcatggaccaagtattgccagactcctgcctgctggtgtggaacatggcgatgcccctcggggaacgtatcactgggggtttcctcctgccagagctccagcccctggcaggctccctgcggcgggatgtggttgaagggaacttctacagtgctacgctggccggggaccactgctttgatgtcctagacctccactttcacttccggcatgcagtacagcaccgtcatcgggatggtgtccactgggaccagcatgcacaccgccacctctcacacctgcttctgacccatgtggctgacgcctggggcgtggagctgcccaagcgtggctatccccctgacccgtggattgaggactgggcagagatgaatcatccattccagggaagccataggcagaccccagacttcggggagcacctggccttgctcccacccccaccttcttctttgcctcctcccatgccttttccctacccgcttcctcagccctcgccacctcccctcttcccacccctgccccaggataccccttttttcccaggccagcccttcccaccccatgaattcttcaactataatccagtggaggacttctcgatgccaccccacttaggatgtggccctggagtgaactttgtgcctggccctctgccacctccaatccctggccctaatccccatggtcagcactggggcccagtggtccaccgggggatgccacgctatgttcctaacagcccctaccatgtgcggagaatgggggggccctgcaggcagcggctcagacactcagagagactgatccacacatacaaactggacagacggcctcctgcccattcggggacatggcctgggtagactggatcttgggctgggactggatgtgccaatggcccttcagggcctgcctggcacctcaggtactgggctagggtgtctgctatgcctggtattgttcttgtccattgctgtcaccaataaaggcatggaagaacagagtgacaaa

SEQ ID NO: 163989 - DNA, 2016 bp, Homo sapiens
  Payload ID: 12288
  Gene Symbol: PCED1A
  Gene Name: PC-esterase domain containing 1A
  Uniprot ID: Q9H1Q7
  ENST ID: ENST00000360652
  CDS Start-End: 504-1868
gtccgggtcacgtggcgaggccgccgccgcggccatcaccactgtgggcagcctcacttggctgccgccccgagaccccagcccgtacctgggcttcgcgcccgccaagtgggcccagccctggctcctgcgccctgtggcggccacctccatcgccttgctttcccttcgggcactgggggtcgctcagggcgggacatgggtgaacggaagtggaagctgtgagcgtcgcagcccgaggcgccgaggcctgaggcgccgtcggggccacagcgacgctcgcatggagagcgctgggcgctgggctgtgcaccgacggctaacctggacccacggtctctgcggggcgggagctttgcagaaccgactggccgactggggcgcgggaacatgaggcttggctaggagcccgctgcgggccaggcgcgcggtgcgcaggcatacccgggtcgcgggtgaacaccgcggagccccgggacttgcctgtcgttgctggtggcggcatggtcttctgtctgtcgagcgaggagccgcgccgcccgctgcgaagcgacatggtccacttccaggcctcggaagtccagcagctgctacacaacaagttcgtggtcatcttgggggactccattcagagggctgtgtacaaggacctggtgctcttgctccagaaagactcactgctcacagctgcccagctgaaagccaagggggagctgagctttgaacaggaccagctggtggctgggggccagctgggcgagctgcacaacgggacacagtatcgtgaggtccgccagttctgctcgggctctggccaccaccttgtgcgcttctacttcctcactcgtgtttactccgagtaccttgaggatgttctggaagagctgacatatggacctgccccggacctggtgatcatcaactcctgcctctgggatctctccagatatggtcgctgctcaatggagagctaccgggagaacctggagcgggtgtttgtgcgcatggaccaagtattgccagactcctgcctgctggtgtggaacatggcgatgcccctcggggaacgtatcactgggggtttcctcctgccagagctccagcccctggcaggctccctgcggcgggatgtggttgaagggaacttctacagtgctacgctggccggggaccactgctttgatgtcctagacctccactttcacttccggcatgcagtacagcaccgtcatcgggatggtgtccactgggaccagcatgcacaccgccacctctcacacctgcttctgacccatgtggctgacgcctggggcgtggagctgcccaagcgtggctatccccctgacccgtggattgaggactgggcagagatgaatcatccattccagggaagccataggcagaccccagacttcggggagcacctggccttgctcccacccccaccttcttctttgcctcctcccatgccttttccctacccgcttcctcagccctcgccacctcccctcttcccacccctgccccaggataccccttttttcccaggccagcccttcccaccccatgaattcttcaactataatccagtggaggacttctcgatgccaccccacttaggatgtggccctggagtgaactttgtgcctggccctctgccacctccaatccctggccctaatccccatggtcagcactggggcccagtggtccaccgggggatgccacgctatgttcctaacagcccctaccatgtgcggagaatgggggggccctgcaggcagcggctcagacactcagagagactgatccacacatacaaactggacagacggcctcctgcccattcggggacatggcctgggtagactggatcttgggctgggactggatgtgccaatggcccttcagggcctgcctggcacctcaggtactgggctagggtgtctgctatgcctggtattgttcttgtccattgctgtcaccaataaaggcatggaagaacagagtgacaaa

SEQ ID NO: 163990 - DNA, 1170 bp, Homo sapiens
  Payload ID: 12288
  Gene Symbol: PCED1A
  Gene Name: PC-esterase domain containing 1A
  ENST ID: ENST00000448755
  CDS Start-End: 483-1170
cgccgccgcggccatcaccactgtgggcagcctcacttggctgccgccccgagaccccagcccgtacctgggcttcgcgcccgccaagtgggcccagccctggctcctgcgccctgtggcggccacctccatcgccttgctttcccttcgggcactgggggtcgctcagggcgggacatgggtgaacggaagtggaagctgtgagcgtcgcagcccgaggcgccgaggcctgaggcgccgtcggggccacagcgacgctcgcatggagagcgctgggcgctgggctgtgcaccgacggctaacctggacccacggtctctgcggggcgggagctttgcagaaccgactggccgactggggcgcgggaacatgaggcttggctaggagcccgctgcgggccaggcgcgcggtgcgcaggcatacccgggtcgcgggtgaacaccgcggagccccgggacttgcctgtcgttgctggtggcggcatggtcttctgtctgtcgagcgaggagccgcgccgcccgctgcgaagcgacatggtccacttccaggcctcggaagtccagcagctgctacacaacaagttcgtggtcatcttgggggactccattcagagggctgtgtacaaggacctggtgctcttgctccagaaagactcactgctcacagctgcccagctgaaagccaagtaccttgaggatgttctggaagagctgacatatggacctgccccggacctggtgatcatcaactcctgcctctgggatctctccagatatggtcgctgctcaatggagagctaccgggagaacctggagcgggtgtttgtgcgcatggaccaagtattgccagactcctgcctgctggtgtggaacatggcgatgcccctcggggaacgtatcactgggggtttcctcctgccagagctccagcccctggcaggctccctgcggcgggatgtggttgaagggaacttctacagtgctacgctggccggggaccactgctttgatgtcctagacctccactttcacttccggcatgcagtacagcaccgtcatcgggatggtgtccactgggaccagcatgcacaccgccacctctcacacctgcttctgacccatgtggctgacgcctggggcgtggagctgcccaagcgtggctatccccctg

SEQ ID NO: 163991 - DNA, 1187 bp, Homo sapiens
  Payload ID: 12288
  Gene Symbol: PCED1A
  Gene Name: PC-esterase domain containing 1A
  ENST ID: ENST00000439542
  CDS Start-End: 347-1187
gatcccgcccccctcggagcgcccctgtggtctgacttcagcagcactttccggcaggagactgggcactcgctgtcacccgcgagctgcctccctcagcgagatctgagcatctttccggaggctaacagacctgggcttcggggtgaccactgtgcttgcctcagtttccttttctggagcaggggaaggcccggctccctgcccaaaggcggctgtgcgctaagtggcagacgctcggggagagccggcgcggggcggaccccagcgccagtagtgacaggggcgaacgccgccgggagactccagccggcgggcgagcaggcctgtcgttgctggtggcggcatggtcttctgtctgtcgagcgaggagccgcgccgcccgctgcgaagcgacatggtccacttccaggcctcggaagtccagcagctgctacacaacaagttcgtggtcatcttgggggactccattcagagggctgtgtacaaggacctggtgctcttgctccagaaagactcactgctcacagctgcccagctgaaagccaagggggagctgagctttgaacaggaccagctggtggctgggggccagctgggcgagctgcacaacgggacacagtatcgtgaggtccgccagttctgctcgggctctggccaccaccttgtgcgcttctacttcctcactcgtgtttactccgagtaccttgaggatgttctggaagagctgacatatggacctgccccggacctggtgatcatcaactcctgcctctgggatctctccagatatggtcgctgctcaatggagagctaccgggagaacctggagcgggtgtttgtgcgcatggaccaagtattgccagactcctgcctgctggtgtggaacatggcgatgcccctcggggaacgtatcactgggggtttcctcctgccagagctccagcccctggcaggctccctgcggcgggatgtggttgaagggaacttctacagtgctacgctggccggggaccactgctttgatgtcctagacctccactttcacttccggcatgcagtacagcaccgtcatcgggatggtgtccactgggaccagcatgcacaccgccacctctcacacctgcttctgacccatgtggctgacgcctggggcgtggagctgcccaagcgtggctatccccctg

SEQ ID NO: 163992 - DNA, 531 bp, Homo sapiens
  Payload ID: 12288
  Gene Symbol: PCED1A
  Gene Name: PC-esterase domain containing 1A
  ENST ID: ENST00000474714
  CDS Start-End: 1-383
ggcatgcagtacagcaccgtcatcgggatggtgtccactgggaccagcatgcacaccgccacctctcacacctgcttctgacccatgtggctgacgcctggggcgtggagctgcccaagcgtggctatccccctggatgtggccctggagtgaactttgtgcctggccctctgccacctccaatccctggccctaatccccatggtcagcactggggcccagtggtccaccgggggatgccacgctatgttcctaacagcccctaccatgtgcggagaatgggggggccctgcaggcagcggctcagacactcagagagactgatccacacatacaaactggacagacggcctcctgcccattcggggacatggcctgggtagactggatcttgggctgggactggatgtgccaatggcccttcagggcctgcctggcacctcaggtactgggctagggtgtctgctatgcctggtattgttcttgtccattgctgtcaccaataaaggcatggaagaacagagtgacaaa

SEQ ID NO: 163993 - DNA, 1862 bp, Homo sapiens
  Payload ID: 12289
  Gene Symbol: PCED1B
  Gene Name: PC-esterase domain containing 1B
  Uniprot ID: Q96HM7
  ENST ID: ENST00000432328
  CDS Start-End: 264-1562
gccggctctcaactttgaggagtttcaagcagccgcggcggcagcagcagccctggacgcagcagccaagctcttcgctggctcccgggggctctcccgggttcctctcattgcaggctgaaggtaatgagaggccctaagatcccagaggatgccataagaggaaaagtcaggggagtgttgaagactctgcctcctacaaatatccatccgcagagccatcctgtgcaaaggaaggagctaggctgtgcgccctgggcgtcatgatccttctgcgggcctccgaagtgcggcagctgcttcacaataagttcgtggtcatcctgggggactctgtgcatagggcagtatacaaggacctggtgcttctgctgcagaaggaccgcctgctcactcccgggcagcttagagcaaggggggagctgaacttcgaacaagatgagctggtggacggaggccagcggggccacatgcacaacggccttaactaccgtgaggtccgcgagttccgctccgaccaccatctggtacgtttttacttcctcacccgcgtgtactccgattacctccagaccatcttgaaagagctgcagtcgggcgagcacgcccccgacctggtcatcatgaattcctgcctctgggacatctccaggtatggtccgaactcctggagaagctacctggagaacctggagaacctgttccagtgcctgggccaggtgctgcccgagtcttgcctcctggtgtggaacacggccatgcctgtgggcgaggaagtcaccgggggttttcttccgcccaagctccggcggcagaaggccaccttcctgaaaaacgaagtggtcaaagccaacttccacagcgccaccgaggcacgtaaacataacttcgatgtactggacttgcatttccacttccgccacgcgagggagaacctgcactgggacggggtgcactggaatggacgtgtgcaccgctgcctctcccagctgctgctggcccacgtggccgacgcctggggtgtggagctgccccaccgccaccccgtgggcgagtggatcaagaagaaaaaacctggcccgagagtcgaagggccgccccaggccaacagaaatcacccggccttacctctgtccccacccttaccttcccccacataccgccccctgcttgggttcccaccccagcgcttgccgctgctcccgctcctgtccccacagcctcctcctcccattctccatcaccagggaatgccccggttcccacagggtcccccagatgcctgtttttcctcagaccatactttccagtcggatcaattctattgccattcagatgtcccctcatcagcccatgcaggtttcttcgtcgaagacaattttatggttggtcctcagctgcctatgcccttcttccccacaccccgttatcagcggcctgccccagtggtacataggggttttggcaggtatcgtccccgtggcccctatacgccctggggacagcggcctcgaccttcaaagagaagggccccagccaatcctgagccaaggcctcaatagacggacctaggccttatttcctctttatgaacatggattggacagatctgacacttcctttccattgcttggcctgaacagactgaccttgttaacttaagcctggagtccatgcctcgtcttccttttgttcattgctgttaccaagaaagccaaggaagagcagcctgactcattcttcttggctgcagcctcttccccacttcctgggagtgacccagcgttattcctgcctcctcactcctattctctttgcctttgtgtaaaaataaaatggaaataaacaagttgcacagaagt

SEQ ID NO: 163994 - DNA, 2328 bp, Homo sapiens
  Payload ID: 12289
  Gene Symbol: PCED1B
  Gene Name: PC-esterase domain containing 1B
  Uniprot ID: Q96HM7
  ENST ID: ENST00000546455
  CDS Start-End: 732-2030
gccggctctcaactttgaggagtttcaagcagccgcggcggcagcagcagccctggacgcagcagccaagctcttcgctggctcccgggggctctcccgggttcctctcattgcaggctgaaggtaatgagaggccctaagatcccagaggatgccataagaggaaaagtcaggggagtgttgaagactctgcctcctacaaatatccgtgaacataccacaccagcaagaacaataagagccaagggtctgaattgtttaatcaaaggaagagtcaaaataagctacacccagattactgagaaaggtgaaatgaaaacaagctcaaaaccaaattccaggaagatgctgtctttgtattgacttaccatttcatgttttcacacatgtcaaagtcttgaagcttcggtcattagtcttccgcttcctaaagcaagaaactaaatgctgacttgtgtcgtttgccccagatgccaccggaaatgtcatcttctccccagacgctggcttgcaagcacagcagcacccagaggctaacctatttcccctatagcccaagctctgagatctcccgtctggtcacaatgatctacaggagaggaagaaagctatctagggacgagatctagaatcaactgagagagatgcttaaaaatcaccagttactttaatgaccatccgcagagccatcctgtgcaaaggaaggagctaggctgtgcgccctgggcgtcatgatccttctgcgggcctccgaagtgcggcagctgcttcacaataagttcgtggtcatcctgggggactctgtgcatagggcagtatacaaggacctggtgcttctgctgcagaaggaccgcctgctcactcccgggcagcttagagcaaggggggagctgaacttcgaacaagatgagctggtggacggaggccagcggggccacatgcacaacggccttaactaccgtgaggtccgcgagttccgctccgaccaccatctggtacgtttttacttcctcacccgcgtgtactccgattacctccagaccatcttgaaagagctgcagtcgggcgagcacgcccccgacctggtcatcatgaattcctgcctctgggacatctccaggtatggtccgaactcctggagaagctacctggagaacctggagaacctgttccagtgcctgggccaggtgctgcccgagtcttgcctcctggtgtggaacacggccatgcctgtgggcgaggaagtcaccgggggttttcttccgcccaagctccggcggcagaaggccaccttcctgaaaaacgaagtggtcaaagccaacttccacagcgccaccgaggcacgtaaacataacttcgatgtactggacttgcatttccacttccgccacgcgagggagaacctgcactgggacggggtgcactggaatggacgtgtgcaccgctgcctctcccagctgctgctggcccacgtggccgacgcctggggtgtggagctgccccaccgccaccccgtgggcgagtggatcaagaagaaaaaacctggcccgagagtcgaagggccgccccaggccaacagaaatcacccggccttacctctgtccccacccttaccttcccccacataccgccccctgcttgggttcccaccccagcgcttgccgctgctcccgctcctgtccccacagcctcctcctcccattctccatcaccagggaatgccccggttcccacagggtcccccagatgcctgtttttcctcagaccatactttccagtcggatcaattctattgccattcagatgtcccctcatcagcccatgcaggtttcttcgtcgaagacaattttatggttggtcctcagctgcctatgcccttcttccccacaccccgttatcagcggcctgccccagtggtacataggggttttggcaggtatcgtccccgtggcccctatacgccctggggacagcggcctcgaccttcaaagagaagggccccagccaatcctgagccaaggcctcaatagacggacctaggccttatttcctctttatgaacatggattggacagatctgacacttcctttccattgcttggcctgaacagactgaccttgttaacttaagcctggagtccatgcctcgtcttccttttgttcattgctgttaccaagaaagccaaggaagagcagcctgactcattcttcttggctgcagcctcttccccacttcctgggagtgacccagcgttattcctgcctcctcactcctattctctttgcctttgtgtaaaaataaaatggaaataaacaagttgcacagaa

SEQ ID NO: 163995 - DNA, 732 bp, Homo sapiens
  Payload ID: 12289
  Gene Symbol: PCED1B
  Gene Name: PC-esterase domain containing 1B
  ENST ID: ENST00000549630
  CDS Start-End: 230-732
caaagatgtttcctttctttttcaaagcaagaaactagaatgtgtttaatgctaaaaagaaggatccaggccaaggagggtaaagaaaatgcagaatgcaaattatcccctcactgggggatatccgggagcgaagtccctgagctgctgaggaagctttacgcctaaggagccatccgcagagccatcctgtgcaaaggaaggagctaggctgtgcgccctgggcgtcatgatccttctgcgggcctccgaagtgcggcagctgcttcacaataagttcgtggtcatcctgggggactctgtgcatagggcagtatacaaggacctggtgcttctgctgcagaaggaccgcctgctcactcccgggcagcttagagcaaggggggagctgaacttcgaacaagatgagctggtggacggaggccagcggggccacatgcacaacggccttaactaccgtgaggtccgcgagttccgctccgaccaccatctggtacgtttttacttcctcacccgcgtgtactccgattacctccagaccatcttgaaagagctgcagtcgggcgagcacgcccccgacctggtcatcatgaattcctgcctctgggacatctccaggtatggtccgaactcctggagaagctacctggagaacctggagaacctgttccagtgcctgggccaggtgctgcccgagtcttgcctcctggtgtggaacacggccatgcctgt

SEQ ID NO: 163996 - DNA, 723 bp, Homo sapiens
  Payload ID: 12289
  Gene Symbol: PCED1B
  Gene Name: PC-esterase domain containing 1B
  ENST ID: ENST00000548348
  CDS Start-End: 155-723
ccgtctggtcacaatgatctacaggagaggaagaaagctatctagggacgagatctagaatcaactgagagagatgcttaaaaatcaccagttactttaatgaaccatcttgaaagagctgcagtcgggcgagcacgcccccgacctggtcatcatgaattcctgcctctgggacatctccaggtatggtccgaactcctggagaagctacctggagaacctggagaacctgttccagtgcctgggccaggtgctgcccgagtcttgcctcctggtgtggaacacggccatgcctgtgggcgaggaagtcaccgggggttttcttccgcccaagctccggcggcagaaggccaccttcctgaaaaacgaagtggtcaaagccaacttccacagcgccaccgaggcacgtaaacataacttcgatgtactggacttgcatttccacttccgccacgcgagggagaacctgcactgggacggggtgcactggaatggacgtgtgcaccgctgcctctcccagctgctgctggcccacgtggccgacgcctggggtgtggagctgccccaccgccaccccgtgggcgagtggatcaagaagaaaaaacctggcccgagagtcgaagggccgccccaggccaacagaaatcacccggccttacctctgtccccacccttaccttcccccacataccgccccctgcttgggttcccaccccagcgctt

SEQ ID NO: 163997 - DNA, 476 bp, Homo sapiens
  Payload ID: 12289
  Gene Symbol: PCED1B
  Gene Name: PC-esterase domain containing 1B
  ENST ID: ENST00000551777
  CDS Start-End: 302-476
tttaatgctaaaaagaaggatccaggccaaggagggtaaagaaaatgcagaatgcaaattatcccctcactgggggatatccgggagcgaagtccctgagctgctgaggaagctttacgcctaaggagaagaggaaactggttcagaactgtgggcagccagcccaagagcacgcagctgtccaggggcagagtccacgtctggcttctttgtctggagttgaaagccagatcaccaccttctgccatccgcagagccatcctgtgcaaaggaaggagctaggctgtgcgccctgggcgtcatgatccttctgcgggcctccgaagtgcggcagctgcttcacaataagttcgtggtcatcctgggggactctgtgcatagggcagtatacaaggacctggtgcttctgctgcagaaggaccgcctgctcactcccgggcagcttagagcaaggggggagctgaacttcgaacaag

SEQ ID NO: 163998 - DNA, 796 bp, Homo sapiens
  Payload ID: 12289
  Gene Symbol: PCED1B
  Gene Name: PC-esterase domain containing 1B
  ENST ID: ENST00000549500
  CDS Start-End: 295-796
caatgatctacaggagaggaagaaagctatctagggacgagatctagaatcaactgagagagatgcttaaaaatcaccagttactttaatgacaagaaactagaatgtgtttaatgctaaaaagaaggatccaggccaaggagggtaaagaaaatgcagaatgcaaattatcccctcactgggggatatccgggagcgaagtccctgagctgctgaggaagctttacgcctaaggagccatccgcagagccatcctgtgcaaaggaaggagctaggctgtgcgccctgggcgtcatgatccttctgcgggcctccgaagtgcggcagctgcttcacaataagttcgtggtcatcctgggggactctgtgcatagggcagtatacaaggacctggtgcttctgctgcagaaggaccgcctgctcactcccgggcagcttagagcaaggggggagctgaacttcgaacaagatgagctggtggacggaggccagcggggccacatgcacaacggccttaactaccgtgaggtccgcgagttccgctccgaccaccatctggtacgtttttacttcctcacccgcgtgtactccgattacctccagaccatcttgaaagagctgcagtcgggcgagcacgcccccgacctggtcatcatgaattcctgcctctgggacatctccaggtatggtccgaactcctggagaagctacctggagaacctggagaacctgttccagtgcctgggccaggtgctgcccgagtcttgcctcctggtgtggaacacggccatgcctg

SEQ ID NO: 163999 - DNA, 7677 bp, Homo sapiens
  Payload ID: 12290
  Gene Symbol: PCF11
  Gene Name: PCF11 cleavage and polyadenylation factor subunit
  Uniprot ID: O94913
  ENST ID: ENST00000298281
  CDS Start-End: 453-5120
ggccggagaagaaggcggtgccagggcgtcctgcggaagggccgggggcggggctcgtgacgttgccgggacagccaatcacgcctggttttatcagtggccccgcccttttaccgcacatttcccctcccctagttcatttcgcacgacgcagcggttgggaacacagacattttcggagctggagccgccactgccgccgccattttgtgtctgtggagaaagaagcttctgtggcggctggaagtggacggagatcacccgcgagacggcggcgtttcatacccgaggttccccctgtgtcgtcccccatcccccctccgcggtcagcatgtggtgaagccggagccgcgagagagccggggagaggaagaggagtcggaagggaggcggggtatccagagcggcttcagcttcagctgcagcggacctcggaggggggccgcggcgcaatgtcagagcagacgccggccgaggccggtgctgcgggggcccgggaggacgcctgtcgggattatcagtcatcgctcgaagacctgaccttcaatagcaagccgcacatcaatatgctgaccattctagccgaggagaacctgcccttcgccaaggagatcgtctctctcatcgaggcccaaaccgccaaggctccttcctcagagaagcttcctgttatgtaccttatggattctattgtgaaaaacgttggaagagagtatctcactgcctttactaaaaatctagttgcaacatttatttgtgtgtttgaaaaggtggatgaaaatactaggaaaagtttatttaagttacgttctacatgggatgaaatattccctttgaagaaactttatgccctggatgtcagagtcaattcattagatcctgcttggcctattaaacctctaccccccaatgtgaatacgtctagcatccatgtgaatcctaaatttttaaataaatcgcccgaggagccttcaacacctggtacagtggtcagttcccctagcatctccactcctccaattgttcctgatatacaaaagaatcttacacaagaacaactaataaggcagcagttactggcaaagcaaaaacagttgttagaacttcagcagaaaaagctggagcttgagctagagcaagctaaggcacagttggcagtttctcttagtgttcagcaggaaacatccaatttaggtcctggatctgcaccatccaaattacatgtttcacagattccccctatggcagttaaagctcctcatcaggttcctgtgcaatctgagaaaagccgtccaggaccatccttacaaattcaggatttaaaaggaactaaccgggatcctcgtctgaacaggataagccaacattctcatggaaaagatcagagtcacaggaaagaatttctaatgaacacattaaaccagtctgatactaagacaagtaaaactataccctctgaaaaactaaattcatccaagcaagaaaaaagtaaatcaggtgaaaaaataaccaagaaagaacttgaccaattagattctaaatcgaaatcgaaatcgaaatcaccctcacctttgaaaaacaaattatctcacacaaaagacttgaaaaatcaagaatcggaaagtatgaggttgtctgatatgaacaagagagatccaagattaaaaaaacatcttcaggataagaccgatggcaaagatgatgatgtgaaagagaagagaaaaactgcagaaaaaaaggataaagatgagcacatgaagtcatccgaacacagactggctggaagtagaaataaaatcataaatggcattgtacaaaaacaggatacaataacagaagagtcagaaaaacaggggacaaaaccagggagatcgagtactagaaagcgatcaagatctcgatcacccaagtctaggtcaccaattatacattccccaaagagaagagataggcggtcacccaaacgaaggcaaagaagtatgtctccaacatcgacacctaaagctggaaagattcgccaatctggagctaagcagtcacatatggaagagtttacaccaccttctagggaagacagaaatgctaagagaagtactaaacaggatattcgggatccaaggcgaatgaaaaagactgaagaggagcgaccacaagaaactacaaatcagcattctacaaagtcaggcactgaaccaaaggagaatgtagaaaactggcaaagttccaagtctgccaaaagatggaaatctggttgggaagaaaataaaagcttacaacaggttgatgaacatagtaaacctcctcatctgaggcatagggagagctggtcaagcactaaaggaattttatcacctcgagccccaaagcagcaacagcatcgattaagtgtagatgccaatcttcagattcctaaagagttaactcttgcaagcaaaagagaattacttcaaaagacgagtgaacgtttagcatctggtgaaattacacaggatgacttccttgttgttgtgcatcaaattcgacagctatttcagtatcaagaaggtgtgcgagaagagcagagatctccattcaatgatcgttttccacttaagcgacctcgatatgaagattcagataaaccatttgtagatagtccagcatcaagattcgccggcctggatacaaatcagcgacttacagctttagctgaagacagaccgttatttgatggacctagtaggccatcagtagcaagagatggcccaacgaagatgatttttgaaggacccaataaattaagccctcgaattgatggacctcccacaccagcttctcttcggtttgatgggtcaccaggacaaatggggggaggaggccctttgagatttgaggggccacaaggtcagctaggaggtgggtgtcctttgagatttgaaggtcctccaggaccagtggggacacctctgcggtttgagggcccaattggtcaagcaggaggaggtggttttcggtttgaaggttcccctggtctgaggtttgagggatctccaggtggtttgagatttgagggaccaggaggccagcctgtgggtggtctgaggtttgagggacatcgtggtcaacctgtgggtggtctaaggtttgagggacctcatggtcagcctgtgggtggacttagatttgataatccccgaggtcagcctgtaggtggacttagatttgaggggggtcatggtccatcaggggctgcgattaggtttgatggacctcatggtcagccaggaggtggaatcagatttgagggccctttgctacagcaaggggttggaatgaggtttgagggcccccatggtcagtcagtagctggtctgagatttgagggacaacataatcaacttggtgggaaccttaggtttgagggtccacatggtcagccaggggttggtatcaggtttgaaggccctttagtccaacaaggaggtggaatgaggtttgagggtccttctgtaccaggaggtggcctgagaattgaagggcctctgggtcaaggtggtccaagatttgaaggttgtcatgctttaaggtttgatgggcagccaggtcagccgtcactcttgccaagatttgatggattacatggtcagccaggtcctagatttgaaaggactcctggtcagccaggccctcagaggtttgatggaccacctggacagcaggttcaacccagatttgacggtgtacctcaaagatttgatggtccacaacatcagcaagcatcaaggtttgatattcctcttggtcttcaaggcacaagatttgacaatcatccttcacaaaggcttgaatcagtatctttcaatcagactggtccatataatgatccacctggcaatgcttttaatgccccatcccaaggactacagttccaaagacatgaacaaatatttgattcacctcaaggaccaaattttaatggaccacatggccctggaaaccagagtttctctaatccacttaacagagcttctggacactattttgatgaaaaaaatcttcagagttctcaatttggaaactttggcaatatacctgctccaatgacagtaggaaatattcaggcatctcaacaggttctgagtggtgttgctcagccagtagcttttggtcaaggacaacagtttttaccagttcatccacaaaatcctggatttgttcagaatccttcaggagccctccctaaggcatatcctgataatcatctcagtcaggtggatgtaaatgaattgttttcaaaattgctaaaaacaggaattctcaaattgtcccaaactgattcagctacaacacaagtaagtgaagtaactgctcagcctccccctgaagaggaggaagatcaaaatgaagatcaagatgttccagatcttactaattttacagttgaagaattgaaacaacgttatgacagtgttataaatcgactgtacactggtattcagtgttactcttgtggaatgaggtttacaacatcacagacagatgtttatgcagatcatttggactggcattatcggcaaaatagaactgaaaaggatgttagccgaaaagtcactcatagacgttggtactacagtttaacagactggatagaatttgaggagatagctgatctggaagaacgggcaaagagccagttttttgaaaaggtgcatgaagaagttgtgctcaaaactcaagaggctgctaaagaaaaagagttccaaagtgtacctgctggaccagctggagcagttgagagttgtgaaatctgtcaagaacaatttgaacaatactgggatgaagaagaggaggaatggcatttgaaaaatgctattagagtagatggaaagatttatcatccatcatgttatgaagattatcaaaatacatcttcatttgattgtacaccatctcccagcaagacaccagttgaaaaccccttgaatattatgttgaacattgtcaaaaacgaattgcaggaaccctgtgacagtcccaaagttaaggaagaacgaattgatacaccaccagcttgtacagaggaaagcatagcaacaccctctgaaattaaaacagaaaatgacacagtcgagtcagtttaaataaaatgagaaaggtatgtttttcttttttaaaaaagctgctgttggatctagaaggtgaagaatttttttatgtatatatagacatatctatataaattgtctggctgaggcagggccttcagctatcatttggttaataaatacattttagtatttgcatttcctactgcctgcagagtttcaggtgcttgttgtgtgaaagttctgtagatgtgtgcaaatttaacgaaatgaaattgtatgtgtaaaaatgtacgatttttcactgtgcaactgtaaattataaataaaaaatatttttgctattcatggagtgtaatatttatgcacaccatcaaatagtttctgtactttttattgggtaaaaatggaattgaacagcaacctcaacataagattttttttctagtagcctcccactgattaaagaagcaagtttgaggtttcatccttcaaaagggggttccgagagagcaccgtagggcttttctcaaatagaaaagccagattttgaaaaaattttaaagataaaataggacatattttgcagatatatatatatatatacacaaacacatctccaggtatagagaaccatccagatgttcacttttgaaaatatctaatgatgcaaagttttattcttgaacttggacactgatgccatcaaacaattaacaaatatatttaagtactaaaggtgattttttttttaaagactttttcaaattgtcaaatgatttaatgcagatgaacatatttctattttaagtaacgggaatctgtaagaatgtttgcttgagatatggttaacttttttcttttgttggttttgacttagatggacaccatgagatgttaatattcatacatgtaataaatagaatgatgaagaaactttgtttgtacttctttatttcttgaaaagctttagaatgtgactttcttgttgtctttcatctgttttttgaaacatgaacatggtacttgctatgagccaggcactctgagacaggttagtcttttctgccatttattggagataggcatataaaacactgagttttattgagcacatagtatgtggcaggcactagcactttctacatgtattttctctggtattcacatctaataactacatggtagatggtgtccccactttacagatgaaattaagccactcactttaaaatttttataagaatttgaacgtggctttgtttcctctaattccatacaatttctgcaattttaaaagatacccccaaattgattgttaggatagaaataagcacaccaaactactggaaggtggctaaggaagattctacaaaagtggtgacatttgagtcttggaggataaccaggagtggagtccatactgatgggaagggtatctttggaaaatgaacagcaaatgtaaaggcttaaaatacttttgtgttttcaaaaattgacttcttatggttaaaactcagtagttttgaatagattatgatgagccattaatttttttagtagaaatggagtctcactacgtagtccaggctggtttcgaattcctgggctcaagtgatcctactgccttggcctcccagagtgctgggattacaggcatgagccacgtgcccagcctttatttttaagtagtgaagagccttcttggtcatgctaaggaatttttattaaactgatgaccagagcagccactagaaattttaaacagggtgacatcctatctgcatttaagcttttttatttttttaagaatcaagtgaatacaattttagagattgctaaatccagagaggtccagtgggaaaactggtagccattggatttgagttgtaaacacgtaacagctgaacttacgtatatgaacactgccataggaactgaggtctgtgaatccaaaaatgtaggcaaaacttcctgttgaacatttttctggggaaaccaccatagcttttatcaaatgcttaaaggtatggaacattctaaaaggaaggtgatattcaaacctaaaagtgtatcaacggtatccacatggagaagagggtcaaggatgggggaacaaagactggtaggtgggaaggtcaaaaagaaaatgggaaaaccagcaatgggaaaatttttttttttctttttttgagacagtcttgctatgttgctcaggctggatcagtgcagtagcacaatctcggctcagtgcagtggcacaatctcggctcactgcaacctctgcctcctgggttcaagtgattctcctgtctcagcctcccaagtagctgggattacaggtgcccgccaccacgcctggctaatttttatattttgagtagaggcggggtttcaccacgttggccaggctggtctcgaactcctgaccttaagtgatctgcccgtcttggcctcccagagtgctgggattacaggtgtgcgcaggaagaaaatttcaatggacgaggtagtcaacaaaatgaagtcaagaaaatatgtaagactcagaaatactctaactgttgacctaagaacagctgagtatgggtgc

SEQ ID NO: 164000 - DNA, 2649 bp, Homo sapiens
  Payload ID: 12290
  Gene Symbol: PCF11
  Gene Name: PCF11 cleavage and polyadenylation factor subunit
  ENST ID: ENST00000530304
  CDS Start-End: 298-2649
ggttgggaacacagacattttcggagctggagccgccactgccgccgccattttgtgtctgtggagaaagaagcttctgtggcggctggaagtggacggagatcacccgcgagacggcggcgtttcatacccgaggttccccctgtgtcgtcccccatcccccctccgcggtcagcatgtggtgaagccggagccgcgagagagccggggagaggaagaggagtcggaagggaggcggggtatccagagcggcttcagcttcagctgcagcggacctcggaggggggccgcggcgcaatgtcagagcagacgccggccgaggccggtgctgcgggggcccgggaggacgcctgtcgggattatcagtcatcgctcgaagacctgaccttcaatagcaagccgcacatcaatatgctgaccattctagccgaggagaacctgcccttcgccaaggagatcgtctctctcatcgaggcccaaaccgccaaggctccttcctcagagaagcttcctgttatgtaccttatggattctattgtgaaaaacgttggaagagagtatctcactgcctttactaaaaatctagttgcaacatttatttgtgtgtttgaaaaggtggatgaaaatactaggaaaagtttatttaagttacgttctacatgggatgaaatattccctttgaagaaactttatgccctggatgtcagagtcaattcattagatcctgcttggcctattaaacctctaccccccaatgtgaatacgtctagcatccatgtgaatcctaaatttttaaataaatcgcccgaggagccttcaacacctggtacagtggtcagttcccctagcatctccactcctccaattgttcctgatatacaaaagaatcttacacaagaacaactaataaggcagcagttactggcaaagcaaaaacagttgttagaacttcagcagaaaaagctggagcttgagctagagcaagctaaggcacagttggcagtttctcttagtgttcagcaggaaacatccaatttaggtcctggatctgcaccatccaaattacatgtttcacagattccccctatggcagttaaagctcctcatcaggttcctgtgcaatctgagaaaagccgtccaggaccatccttacaaattcaggatttaaaaggaactaaccgggatcctcgtctgaacaggataagccaacattctcatggaaaagatcagagtcacaggaaagaatttctaatgaacacattaaaccagtctgatactaagacaagtaaaactataccctctgaaaaactaaattcatccaagcaagaaaaaagtaaatcaggtgaaaaaataaccaagaaagaacttgaccaattagattctaaatcgaaatcgaaatcgaaatcaccctcacctttgaaaaacaaattatctcacacaaaagacttgaaaaatcaagaatcggaaagtatgaggttgtctgatatgaacaagagagatccaagattaaaaaaacatcttcaggataagaccgatggcaaagatgatgatgtgaaagagaagagaaaaactgcagaaaaaaaggataaagatgagcacatgaagtcatccgaacacagactggctggaagtagaaataaaatcataaatggcattgtacaaaaacaggatacaataacagaagagtcagaaaaacaggggacaaaaccagggagatcgagtactagaaagcgatcaagatctcgatcacccaagtctaggtcaccaattatacattccccaaagagaagagataggcggtcacccaaacgaaggcaaagaagtatgtctccaacatcgacacctaaagctggaaagattcgccaatctggagctaagcagtcacatatggaagagtttacaccaccttctagggaagacagaaatgctaagagaagtactaaacaggatattcgggatccaaggcgaatgaaaaagactgaagaggagcgaccacaagaaactacaaatcagcattctacaaagtcaggcactgaaccaaaggagaatgtagaaaactggcaaagttccaagtctgccaaaagatggaaatctggttgggaagaaaataaaagcttacaacaggttgatgaacatagtaaacctcctcatctgaggcatagggagagctggtcaagcactaaaggaattttatcacctcgagccccaaagcagcaacagcatcgattaagtgtagatgccaatcttcagattcctaaagagttaactcttgcaagcaaaagagaattacttcaaaagacgagtgaacgtttagcatctggtgaaattacacaggatgacttccttgttgttgtgcatcaaattcgacagctatttcagtatcaagaaggtgtgcgagaagagcagagatctccattcaatgatcgttttccacttaagcgacctcgatatgaagattcagataaaccatttgtagatagtccagcatcaagattcgccggcctggatacaaatcagcgacttacagctttagctgaagacagaccgttatttgatggacctagtaggccatcagtagcaagagatggcccaacgaagatgatttttgaaggacccaataaattaagccctcgaattgatggacctccc

SEQ ID NO: 164001 - DNA, 3309 bp, Homo sapiens
  Payload ID: 12290
  Gene Symbol: PCF11
  Gene Name: PCF11 cleavage and polyadenylation factor subunit
  ENST ID: ENST00000530660
  CDS Start-End: 314-3309
tttcgcacgacgcagcggttgggaacacagacattttcggagctggagccgccactgccgccgccattttgtgtctgtggagaaagaagcttctgtggcggctggaagtggacggagatcacccgcgagacggcggcgtttcatacccgaggttccccctgtgtcgtcccccatcccccctccgcggtcagcatgtggtgaagccggagccgcgagagagccggggagaggaagaggagtcggaagggaggcggggtatccagagcggcttcagcttcagctgcagcggacctcggaggggggccgcggcgcaatgtcagagcagacgccggccgaggccggtgctgcgggggcccgggaggacgcctgtcgggattatcagtcatcgctcgaagacctgaccttcaatagcaagccgcacatcaatatgctgaccattctagccgaggagaacctgcccttcgccaaggagatcgtctctctcatcgaggcccaaaccgccaaggctccttcctcagagaagcttcctgttatgtaccttatggattctattgtgaaaaacgttggaagagagtatctcactgcctttactaaaaatctagttgcaacatttatttgtgtgtttgaaaaggtggatgaaaatactaggaaaagtttatttaagttacgttctacatgggatgaaatattccctttgaagaaactttatgccctggatgtcagagtcaattcattagatcctgcttggcctattaaacctctaccccccaatgtgaatacgtctagcatccatgtgaatcctaaatttttaaataaatcgcccgaggagccttcaacacctggtacagtggtcagttcccctagcatctccactcctccaattgttcctgatatacaaaagaatcttacacaagaacaactaataaggcagcagttactggcaaagcaaaaacagttgttagaacttcagcagaaaaagctggagcttgagctagagcaagctaaggcacagttggcagtttctcttagtgttcagcaggaaacatccaatttaggtcctggatctgcaccatccaaattacatgtttcacagattccccctatggcagttaaagctcctcatcaggttcctgtgcaatctgagaaaagccgtccaggaccatccttacaaattcaggatttaaaaggaactaaccgggatcctcgtctgaacaggataagccaacattctcatggaaaagatcagagtcacaggaaagaatttctaatgaacacattaaaccagtctgatactaagacaagtaaaactataccctctgaaaaactaaattcatccaagcaagaaaaaagtaaatcaggtgaaaaaataaccaagaaagaacttgaccaattagattctaaatcgaaatcgaaatcgaaatcaccctcacctttgaaaaacaaattatctcacacaaaagacttgaaaaatcaagaatcggaaagtatgaggttgtctgatatgaacaagagagatccaagattaaaaaaacatcttcaggataagaccgatggcaaagatgatgatgtgaaagagaagagaaaaactgcagaaaaaaaggataaagatgagcacatgaagtcatccgaacacagactggctggaagtagaaataaaatcataaatggcattgtacaaaaacaggatacaataacagaagagtcagaaaaacaggggacaaaaccagggagatcgagtactagaaagcgatcaagatctcgatcacccaagtctaggtcaccaattatacattccccaaagagaagagataggcggtcacccaaacgaaggcaaagaagtatgtctccaacatcgacacctaaagctggaaagattcgccaatctggagctaagcagtcacatatggaagagtttacaccaccttctagggaagacagaaatgctaagagaagtactaaacaggatattcgggatccaaggcgaatgaaaaagactgaagaggagcgaccacaagaaactacaaatcagcattctacaaagtcaggcactgaaccaaaggagaatgtagaaaactggcaaagttccaagtctgccaaaagatggaaatctggttgggaagaaaataaaagcttacaacaggttgatgaacatagtaaacctcctcatctgaggcatagggagagctggtcaagcactaaaggaattttatcacctcgagccccaaagcagcaacagcatcgattaagtgtagatgccaatcttcagattcctaaagagttaactcttgcaagcaaaagagaattacttcaaaagacgagtgaacgtttagcatctggtgaaattacacaggatgacttccttgttgttgtgcatcaaattcgacagctatttcagtatcaagaaggtaaacatagatgcaatgtacgggatagtcctacagaagaaaataaaggtggattaaaaaagaaacctctcttatctgatgctgaattaacctactatgaacataaagcaaaactgaaaaggacacaggttcagcattcatttccaagacttgatctcttagatcctgatatttttgactaccctttgactgatgccttgttgtctggaatagaatgtgagccatccaaaagtaaacatgcaagtaggaatagtggagcacagtttgacagaaaagaacaatttagtgaaagagcaagacgtctttctcctatatctgggagtcgtacttatgctgagaatctttcaccccatgagggccggagaagacatgacgagcaagtctctgctaaaggtgtgcgagaagagcagagatctccattcaatgatcgttttccacttaagcgacctcgatatgaagattcagataaaccatttgtagatagtccagcatcaagattcgccggcctggatacaaatcagcgacttacagctttagctgaagacagaccgttatttgatggacctagtaggccatcagtagcaagagatggcccaacgaagatgatttttgaaggacccaataaattaagccctcgaattgatggacctcccacaccagcttctcttcggtttgatgggtcaccaggacaaatggggggaggaggccctttgagatttgaggggccacaaggtcagctaggaggtgggtgtcctttgagatttgaaggtcctccaggaccagtggggacacctctgcggtttgagggcccaattggtcaagcaggaggaggtggttttcggtttgaaggttcccctggtctgaggtttgagggatctccaggtggtttgagatttgagggacc

SEQ ID NO: 164002 - DNA, 580 bp, Homo sapiens
  Payload ID: 12290
  Gene Symbol: PCF11
  Gene Name: PCF11 cleavage and polyadenylation factor subunit
  ENST ID: ENST00000533018
  CDS Start-End: 282-580
attttcggagctggagccgccactgccgccgccattttgtgtctgtggagaaagaagcttctgtggcggctggaagtggacggagatcacccgcgagacggcggcgtttcatacccgaggttccccctgtgtcgtcccccatcccccctccgcggtcagcatgtggtgaagccggagccgcgagagagccggggagaggaagaggagtcggaagggaggcggggtatccagagcggcttcagcttcagctgcagcggacctcggaggggggccgcggcgcaatgtcagagcagacgccggccgaggccggtgctgcgggggcccgggaggacgcctgtcgggattatcagtcatcgctcgaagacctgaccttcaatagcaagccgcacatcaatatgctgaccattctagccgaggagaacctgcccttcgccaaggagatcgtctctctcatcgaggcccaaaccgccaaggtggatgaaaatactaggaaaagtttatttaagttacgttctacatgggatgaaatattccctttgaagaaactttatgccctggatgtcagagtcaattcattaga

SEQ ID NO: 164003 - DNA, 628 bp, Homo sapiens
  Payload ID: 12290
  Gene Symbol: PCF11
  Gene Name: PCF11 cleavage and polyadenylation factor subunit
  ENST ID: ENST00000530906
  CDS Start-End: 33-628
ataaccatgtgcaaagatgatggccaagcaagatgcttacctgcttggttctgagtggtgttgctcagccagtagcttttggtcaaggacaacagtttttaccagttcatccacaaaatcctggatttgttcagaatccttcaggagccctccctaaggcatatcctgataatcatctcagtcaggtggatgtaaatgaattgttttcaaaattgctaaaaacaggaattctcaaattgtcccaaactgattcagctacaacacaagtaagtgaagtaactgctcagcctccccctgaagaggaggaagatcaaaatgaagatcaagatgttccagatcttactaattttacagttgaagaattgaaacaacgttatgacagtgttataaatcgactgtacactggtattcagtgttactcttgtggaatgaggtttacaacatcacagacagatgtttatgcagatcatttggactggcattatcggcaaaatagaactgaaaaggatgttagccgaaaagtcactcatagacgttggtactacagtttaacagactggatagaatttgaggagatagctgatctggaagaacgggcaaagagccagttttttgaaaaggtgcatga

SEQ ID NO: 164004 - DNA, 2647 bp, Homo sapiens
  Payload ID: 12290
  Gene Symbol: PCF11
  Gene Name: PCF11 cleavage and polyadenylation factor subunit
  ENST ID: ENST00000620955
  CDS Start-End: 298-2475
ggttgggaacacagacattttcggagctggagccgccactgccgccgccattttgtgtctgtggagaaagaagcttctgtggcggctggaagtggacggagatcacccgcgagacggcggcgtttcatacccgaggttccccctgtgtcgtcccccatcccccctccgcggtcagcatgtggtgaagccggagccgcgagagagccggggagaggaagaggagtcggaagggaggcggggtatccagagcggcttcagcttcagctgcagcggacctcggaggggggccgcggcgcaatgtcagagcagacgccggccgaggccggtgctgcgggggcccgggaggacgcctgtcgggattatcagtcatcgctcgaagacctgaccttcaatagcaagccgcacatcaatatgctgaccattctagccgaggagaacctgcccttcgccaaggagatcgtctctctcatcgaggcccaaaccgccaaggctccttcctcagagaagcttcctgttatgtaccttatggattctattgtgaaaaacgttggaagagagtatctcactgcctttactaaaaatctagttgcaacatttatttgtgtgtttgaaaaggtggatgaaaatactaggaaaagtttatttaagttacgttctacatgggatgaaatattccctttgaagaaactttatgccctggatgtcagagtcaattcattagatcctgcttggcctattaaacctctaccccccaatgtgaatacgtctagcatccatgtgaatcctaaatttttaaataaatcgcccgaggagccttcaacacctggtacagtggtcagttcccctagcatctccactcctccaattgttcctgatatacaaaagaatcttacacaagaacaactaataaggcagcagttactggcaaagcaaaaacagttgttagaacttcagcagaaaaagctggagcttgagctagagcaagctaaggcacagttggcagtttctcttagtgttcagcaggaaacatccaatttaggtcctggatctgcaccatccaaattacatgtttcacagattccccctatggcagttaaagctcctcatcaggttcctgtgcaatctgagaaaagccgtccaggaccatccttacaaattcaggatttaaaaggaactaaccgggatcctcgtctgaacaggataagccaacattctcatggaaaagatcagagtcacaggaaagaatttctaatgaacacattaaaccagtctgatactaagacaagtaaaactataccctctgaaaaactaaattcatccaagcaagaaaaaagtaaatcaggtgaaaaaataaccaagaaagaacttgaccaattagattctaaatcgaaatcgaaatcgaaatcaccctcacctttgaaaaacaaattatctcacacaaaagacttgaaaaatcaagaatcggaaagtatgaggttgtctgatatgaacaagagagatccaagattaaaaaaacatcttcaggataagaccgatggcaaagatgatgatgtgaaagagaagagaaaaactgcagaaaaaaaggataaagatgagcacatgaagtcatccgaacacagactggctggaagtagaaataaaatcataaatggcattgtacaaaaacaggatacaataacagaagagtcagaaaaacaggggacaaaaccagggagatcgagtactagaaagcgatcaagatctcgatcacccaagtctaggtcaccaattatacattccccaaagagaagagataggcggtcacccaaacgaaggcaaagaagtatgtctccaacatcgacacctaaagctggaaagattcgccaatctggagctaagcagtcacatatggaagagtttacaccaccttctagggaagacagaaatgctaagagaagtactaaacaggatattcgggatccaaggcgaatgaaaaagactgaagaggagcgaccacaagaaactacaaatcagcattctacaaagtcaggcactgaaccaaaggagaatgtagaaaactggcaaagttccaagtctgccaaaagatggaaatctggttgggaagaaaataaaagcttacaacaggttgatgaacatagtaaacctcctcatctgaggcatagggagagctggtcaagcactaaaggaattttatcacctcgagccccaaagcagcaacagcatcgattaagtgtagatgccaatcttcagattcctaaagagttaactcttgcaagcaaaagagaattacttcaaaagacgagtgaacgtttagcatctggtgaaattacacaggatgacttccttgttgttgtgcatcaaattcgacagctatttcagtatcaagaaggtgtgcgagaagagcagagatctccattcaatgatcgtttccacttaagcgacctcgatatgaagattcagataaaccatttgtagatagtccagcatcaagattcgccggcctggatacaaatcagcgacttacagctttagctgaagacagaccgttatttgatggacctagtaggccatcagtagcaagagatggcccaacgaagatgatttttgaaggacccaataaattaagccctcgaattgatggacctcc

SEQ ID NO: 164005 - DNA, 1786 bp, Homo sapiens
  Payload ID: 12291
  Gene Symbol: PCID2
  Gene Name: PCI domain containing 2
  Uniprot ID: Q5JVF3
  ENST ID: ENST00000246505
  CDS Start-End: 36-1397
gtagggggtggcgctctccgttcggcggcgctcccatggcgcacattaccattaaccagtacctgcagcaggtgtacgaagccatcgacagcagagatggagcatcttgtgcagagttggtgtcttttaaacatcctcatgttgcaaacccacgacttcaaatggcctctccagaggagaagtgtcaacaagtcttggaacccccttatgatgaaatgtttgcagctcatttaaggtgcacttatgcagtggggaatcatgacttcatagaggcatacaagtgccagaccgtgatagtccaatatcctttgtcgttcatggcagctgtcccgcatagaacacatgcagtggattacttgggacttgagacccggaaacactgggccagttgctcatttctgcagttagaaaggaatgacagtgttttggaacagaagctcgtttcagctctttcacttggtacatcattcttgcgagcattccaggcccacaaagaagaaaactgggctctgcctgtcatgtatgcagtagcgcttgaccttcgagtgtttgccaataatgcagatcaacagttggtaaagaaaggaaaaagcaaagttggggacatgttggaaaaagcagcagagttactgatgagctgtttccgggtctgtgccagcgacacccgtgctggtatagaggactctaagaagtggggcatgctgtttctggtgaaccagctgtttaaaatctacttcaagatcaacaaactccatttatgtaaacccctaattagagcaattgacagctcaaacctgaaagacgattacagcactgcacagagagtaacatacaaatactacgttggacgcaaggctatgtttgacagcgattttaagcaagctgaggagtacctgtcatttgcctttgagcattgtcaccgttctagtcagaagaacaaaaggatgattctgatctatttgcttccagtaaaaatgctattgggtcacatgcccactgtggagctcctgaaaaagtatcacctgatgcagtttgcggaagtaaccagagctgtgagcgagggcaacctgctgctgctgcacgaggcgctggcgaagcacgaggccttcttcattcgctgcggaatcttcctcatcctggagaagctgaagatcatcacctacaggaacctctttaagaaagtgtatttgttactgaaaacacaccagctgtctctggatgcttttctggttgccttgaagttcatgcaggtggaggacgtggacattgacgaagttcagtgtattctggctaacttgatatacatgggacacgtcaaaggctacatatcgcatcagcatcagaagctggtggtcagcaagcagaacccatttcctcccctgtccacggtgtgttgaaagtacacggagccccgaggacggactcggctggttctggagtctttgtgagacttctttgaaggaggctttgcgtgaaggctgctcggctcacttttcctaagtgtggttcctgaaggctgtctttgtaactttttgtagttctttgtgtaaaaagcgtattctgaatttatacacatggcatgttcttcattatatcttccaggatacatctatttttatatattaaatttgaatgtgttatcaaaatgcttggttaacttaaggcacctttttaaaagcagaatttaatttgatttaaattttccagattttatagcttgcctgtatggatgctcctcaatttatgatagggttacatcccaataaacttattttatttgcctttg

SEQ ID NO: 164006 - DNA, 1898 bp, Homo sapiens
  Payload ID: 12291
  Gene Symbol: PCID2
  Gene Name: PCI domain containing 2
  Uniprot ID: Q5JVF3
  ENST ID: ENST00000337344
  CDS Start-End: 78-1277
ggaccgagggccggaagtgacgccagctggcccgcttgaggcgtagggggtggcgctctccgttcggcggcgctcccatggcgcacattaccattaaccagtacctgcagcaggtgtacgaagccatcgacagcagagatggagcatcttgtgcagagttggtgtcttttaaacatcctcatgttgcaaacccacgacttcaaatggcctctccagaggagaagtgtcaacaagtcttggaacccccttatgatgaaatgtttgcagctcatttaaggtgcacttatgcagtggggaatcatgacttcatagaggcatacaagtgccagaccgtgatagtccaatcattcttgcgagcattccaggcccacaaagaagaaaactgggctctgcctgtcatgtatgcagtagcgcttgaccttcgagtgtttgccaataatgcagatcaacagttggtaaagaaaggaaaaagcaaagttggggacatgttggaaaaagcagcagagttactgatgagctgtttccgggtctgtgccagcgacacccgtgctggtatagaggactctaagaagtggggcatgctgtttctggtgaaccagctgtttaaaatctacttcaagatcaacaaactccatttatgtaaacccctaattagagcaattgacagctcaaacctgaaagacgattacagcactgcacagagagtaacatacaaatactacgttggacgcaaggctatgtttgacagcgattttaagcaagctgaggagtacctgtcatttgcctttgagcattgtcaccgttctagtcagaagaacaaaaggatgattctgatctatttgcttccagtaaaaatgctattgggtcacatgcccactgtggagctcctgaaaaagtatcacctgatgcagtttgcggaagtaaccagagctgtgagcgagggcaacctgctgctgctgcacgaggcgctggcgaagcacgaggccttcttcattcgctgcggaatcttcctcatcctggagaagctgaagatcatcacctacaggaacctctttaagaaagtgtatttgttactgaaaacacaccagctgtctctggatgcttttctggttgccttgaagttcatgcaggtggaggacgtggacattgacgaagttcagtgtattctggctaacttgatatacatgggacacgtcaaaggctacatatcgcatcagcatcagaagctggtggtcagcaagcagaacccatttcctcccctgtccacggtgtgttgaaagtacacggagccccgaggacgggtgagcagttgtttctttccactttggttgtgctgatgagaccggtccggtactgcaacaaggctccctgaagccggaactcttggaggcgcttttcccagggatgctgaggctgagattttcagcacacccgagttaatctccttcatttgtaactaatttcagcctgatgaaaacctggaattcctttttcacagactcggctggttctggagtctttgtgagacttctttgaaggaggctttgcgtgaaggctgctcggctcacttttcctaagtgtggttcctgaaggctgtctttgtaactttttgtagttctttgtgtaaaaagcgtattctgaatttatacacatggcatgttcttcattatatcttccaggatacatctatttttatatattaaatttgaatgtgttatcaaaatgcttggttaacttaaggcacctttttaaaagcagaatttaatttgatttaaattttccagattttatagcttgcctgtatggatgctcctcaatttatgatagggttacatcccaataaacttattttatttgcctttgctttgttggttaaaaaaaaatttcttttaaaaaac

SEQ ID NO: 164007 - DNA, 2372 bp, Homo sapiens
  Payload ID: 12291
  Gene Symbol: PCID2
  Gene Name: PCI domain containing 2
  Uniprot ID: Q5JVF3
  ENST ID: ENST00000375457
  CDS Start-End: 598-1791
gttcggcggcgctcccatggcgcacattaccattaaccagtacctgcagcaggtgggtcctagccggggagcgcgcggcggcgtggttggccctcggcgtgttccgtgtgtcccctcctgccttggaccctcaggccttttcctttcccgcctcgccacccttcttccgttcgggtccccggcgggcagccgcgcgagccgaacagcggcggccgggactcgggaaggcggcccgagttctcccctgcagggccgccgtgggggccgggcggtgtccgtggatcgcggagtcgtcgcggtgtaagtagacgcggcggtcccaggtcgctgccctcacttgctggcacgtgtggccgcgctcccaggcggtccgaagggcctgcgggccacgccgagggcccgctgtgggcggtgctgtgtcggatggacgctgtttcccagcaggatgcgggatgaattcggggactccaggaggcgatggaggagtaagcgcgaggctgtggccgtgctgcaggccgggctcgtgcccctcgtcctcgctgtcgtttaacgcccttcactctccgagcacaatgcacacttcatatcgctcggtacatgcgtctgacagatgttgttcaacagcttgtgtacgaagccatcgacagcagagatggagcatcttgtgcagagttggtgtcttttaaacatcctcatgttgcaaacccacgacttcaaatggcctctccagaggagaagtgtcaacaagtcttggaacccccttatgatgaaatgtttgcagctcatttaaggtgcacttatgcagtggggaatcatgacttcatagaggcatacaagtgccagaccgtgatagtccaatcattcttgcgagcattccaggcccacaaagaagaaaactgggctctgcctgtcatgtatgcagtagcgcttgaccttcgagtgtttgccaataatgcagatcaacagttggtaaagaaaggaaaaagcaaagttggggacatgttggaaaaagcagcagagttactgatgagctgtttccgggtctgtgccagcgacacccgtgctggtatagaggactctaagaagtggggcatgctgtttctggtgaaccagctgtttaaaatctacttcaagatcaacaaactccatttatgtaaacccctaattagagcaattgacagctcaaacctgaaagacgattacagcactgcacagagagtaacatacaaatactacgttggacgcaaggctatgtttgacagcgattttaagcaagctgaggagtacctgtcatttgcctttgagcattgtcaccgttctagtcagaagaacaaaaggatgattctgatctatttgcttccagtaaaaatgctattgggtcacatgcccactgtggagctcctgaaaaagtatcacctgatgcagtttgcggaagtaaccagagctgtgagcgagggcaacctgctgctgctgcacgaggcgctggcgaagcacgaggccttcttcattcgctgcggaatcttcctcatcctggagaagctgaagatcatcacctacaggaacctctttaagaaagtgtatttgttactgaaaacacaccagctgtctctggatgcttttctggttgccttgaagttcatgcaggtggaggacgtggacattgacgaagttcagtgtattctggctaacttgatatacatgggacacgtcaaaggctacatatcgcatcagcatcagaagctggtggtcagcaagcagaacccatttcctcccctgtccacggtgtgttgaaagtacacggagccccgaggacgggtgagcagttgtttctttccactttggttgtgctgatgagaccggtccggtactgcaacaaggctccctgaagccggaactcttggaggcgcttttcccagggatgctgaggctgagattttcagcacacccgagttaatctccttcatttgtaactaatttcagcctgatgaaaacctggaattcctttttcacagactcggctggttctggagtctttgtgagacttctttgaaggaggctttgcgtgaaggctgctcggctcacttttcctaagtgtggttcctgaaggctgtctttgtaactttttgtagttctttgtgtaaaaagcgtattctgaatttatacacatggcatgttcttcattatatcttccaggatacatctatttttatatattaaatttgaatgtgttatcaaaatgcttggttaacttaaggcacctttttaaaagcagaatttaatttgatttaaattttccagattttatagcttgcctgtatggatgctcctcaatttatgatagggttacatcccaataaacttattttatttgc

SEQ ID NO: 164008 - DNA, 1668 bp, Homo sapiens
  Payload ID: 12291
  Gene Symbol: PCID2
  Gene Name: PCI domain containing 2
  Uniprot ID: Q5JVF3
  ENST ID: ENST00000375459
  CDS Start-End: 54-1247
gtttaacgcccttcactctccgagcacaatgcacacttcatatcgctcggtacatgcgtctgacagatgttgttcaacagcttgtgtacgaagccatcgacagcagagatggagcatcttgtgcagagttggtgtcttttaaacatcctcatgttgcaaacccacgacttcaaatggcctctccagaggagaagtgtcaacaagtcttggaacccccttatgatgaaatgtttgcagctcatttaaggtgcacttatgcagtggggaatcatgacttcatagaggcatacaagtgccagaccgtgatagtccaatcattcttgcgagcattccaggcccacaaagaagaaaactgggctctgcctgtcatgtatgcagtagcgcttgaccttcgagtgtttgccaataatgcagatcaacagttggtaaagaaaggaaaaagcaaagttggggacatgttggaaaaagcagcagagttactgatgagctgtttccgggtctgtgccagcgacacccgtgctggtatagaggactctaagaagtggggcatgctgtttctggtgaaccagctgtttaaaatctacttcaagatcaacaaactccatttatgtaaacccctaattagagcaattgacagctcaaacctgaaagacgattacagcactgcacagagagtaacatacaaatactacgttggacgcaaggctatgtttgacagcgattttaagcaagctgaggagtacctgtcatttgcctttgagcattgtcaccgttctagtcagaagaacaaaaggatgattctgatctatttgcttccagtaaaaatgctattgggtcacatgcccactgtggagctcctgaaaaagtatcacctgatgcagtttgcggaagtaaccagagctgtgagcgagggcaacctgctgctgctgcacgaggcgctggcgaagcacgaggccttcttcattcgctgcggaatcttcctcatcctggagaagctgaagatcatcacctacaggaacctctttaagaaagtgtatttgttactgaaaacacaccagctgtctctggatgcttttctggttgccttgaagttcatgcaggtggaggacgtggacattgacgaagttcagtgtattctggctaacttgatatacatgggacacgtcaaaggctacatatcgcatcagcatcagaagctggtggtcagcaagcagaacccatttcctcccctgtccacggtgtgttgaaagtacacggagccccgaggacggcctgatgaaaacctggaattcctttttcacagactcggctggttctggagtctttgtgagacttctttgaaggaggctttgcgtgaaggctgctcggctcacttttcctaagtgtggttcctgaaggctgtctttgtaactttttgtagttctttgtgtaaaaagcgtattctgaatttatacacatggcatgttcttcattatatcttccaggatacatctatttttatatattaaatttgaatgtgttatcaaaatgcttggttaacttaaggcacctttttaaaagcagaatttaatttgatttaaattttccagattttatagcttgcctgtatggatgctcctcaatttatgatagggttacatcccaataaacttattttatttgcctttg

SEQ ID NO: 164009 - DNA, 1654 bp, Homo sapiens
  Payload ID: 12291
  Gene Symbol: PCID2
  Gene Name: PCI domain containing 2
  Uniprot ID: Q5JVF3
  ENST ID: ENST00000375477
  CDS Start-End: 33-1232
gggggtggcgctctccgttcggcggcgctcccatggcgcacattaccattaaccagtacctgcagcaggtgtacgaagccatcgacagcagagatggagcatcttgtgcagagttggtgtcttttaaacatcctcatgttgcaaacccacgacttcaaatggcctctccagaggagaagtgtcaacaagtcttggaacccccttatgatgaaatgtttgcagctcatttaaggtgcacttatgcagtggggaatcatgacttcatagaggcatacaagtgccagaccgtgatagtccaatcattcttgcgagcattccaggcccacaaagaagaaaactgggctctgcctgtcatgtatgcagtagcgcttgaccttcgagtgtttgccaataatgcagatcaacagttggtaaagaaaggaaaaagcaaagttggggacatgttggaaaaagcagcagagttactgatgagctgtttccgggtctgtgccagcgacacccgtgctggtatagaggactctaagaagtggggcatgctgtttctggtgaaccagctgtttaaaatctacttcaagatcaacaaactccatttatgtaaacccctaattagagcaattgacagctcaaacctgaaagacgattacagcactgcacagagagtaacatacaaatactacgttggacgcaaggctatgtttgacagcgattttaagcaagctgaggagtacctgtcatttgcctttgagcattgtcaccgttctagtcagaagaacaaaaggatgattctgatctatttgcttccagtaaaaatgctattgggtcacatgcccactgtggagctcctgaaaaagtatcacctgatgcagtttgcggaagtaaccagagctgtgagcgagggcaacctgctgctgctgcacgaggcgctggcgaagcacgaggccttcttcattcgctgcggaatcttcctcatcctggagaagctgaagatcatcacctacaggaacctctttaagaaagtgtatttgttactgaaaacacaccagctgtctctggatgcttttctggttgccttgaagttcatgcaggtggaggacgtggacattgacgaagttcagtgtattctggctaacttgatatacatgggacacgtcaaaggctacatatcgcatcagcatcagaagctggtggtcagcaagcagaacccatttcctcccctgtccacggtgtgttgaaagtacacggagccccgaggacggcctgatgaaaacctggaattcctttttcacagactcggctggttctggagtctttgtgagacttctttgaaggaggctttgcgtgaaggctgctcggctcacttttcctaagtgtggttcctgaaggctgtctttgtaactttttgtagttctttgtgtaaaaagcgtattctgaatttatacacatggcatgttcttcattatatcttccaggatacatctatttttatatattaaatttgaatgtgttatcaaaatgcttggttaacttaaggcacctttttaaaagcagaatttaatttgatttaaattttccagattttatagcttgcctgtatggatgctcctcaatttatgatagggttacatcccaataaacttattttatttgcctttgc

SEQ ID NO: 164010 - DNA, 1671 bp, Homo sapiens
  Payload ID: 12291
  Gene Symbol: PCID2
  Gene Name: PCI domain containing 2
  Uniprot ID: Q5JVF3
  ENST ID: ENST00000375479
  CDS Start-End: 82-1281
agacggaccgagggccggaagtgacgccagctggcccgcttgaggcgtagggggtggcgctctccgttcggcggcgctcccatggcgcacattaccattaaccagtacctgcagcaggtgtacgaagccatcgacagcagagatggagcatcttgtgcagagttggtgtcttttaaacatcctcatgttgcaaacccacgacttcaaatggcctctccagaggagaagtgtcaacaagtcttggaacccccttatgatgaaatgtttgcagctcatttaaggtgcacttatgcagtggggaatcatgacttcatagaggcatacaagtgccagaccgtgatagtccaatcattcttgcgagcattccaggcccacaaagaagaaaactgggctctgcctgtcatgtatgcagtagcgcttgaccttcgagtgtttgccaataatgcagatcaacagttggtaaagaaaggaaaaagcaaagttggggacatgttggaaaaagcagcagagttactgatgagctgtttccgggtctgtgccagcgacacccgtgctggtatagaggactctaagaagtggggcatgctgtttctggtgaaccagctgtttaaaatctacttcaagatcaacaaactccatttatgtaaacccctaattagagcaattgacagctcaaacctgaaagacgattacagcactgcacagagagtaacatacaaatactacgttggacgcaaggctatgtttgacagcgattttaagcaagctgaggagtacctgtcatttgcctttgagcattgtcaccgttctagtcagaagaacaaaaggatgattctgatctatttgcttccagtaaaaatgctattgggtcacatgcccactgtggagctcctgaaaaagtatcacctgatgcagtttgcggaagtaaccagagctgtgagcgagggcaacctgctgctgctgcacgaggcgctggcgaagcacgaggccttcttcattcgctgcggaatcttcctcatcctggagaagctgaagatcatcacctacaggaacctctttaagaaagtgtatttgttactgaaaacacaccagctgtctctggatgcttttctggttgccttgaagttcatgcaggtggaggacgtggacattgacgaagttcagtgtattctggctaacttgatatacatgggacacgtcaaaggctacatatcgcatcagcatcagaagctggtggtcagcaagcagaacccatttcctcccctgtccacggtgtgttgaaagtacacggagccccgaggacggactcggctggttctggagtctttgtgagacttctttgaaggaggctttgcgtgaaggctgctcggctcacttttcctaagtgtggttcctgaaggctgtctttgtaactttttgtagttctttgtgtaaaaagcgtattctgaatttatacacatggcatgttcttcattatatcttccaggatacatctatttttatatattaaatttgaatgtgttatcaaaatgcttggttaacttaaggcacctttttaaaagcagaatttaatttgatttaaattttccagattttatagcttgcctgtatggatgctcctcaatttatgatagggttacatcccaataaacttattttatttgcctttgc

SEQ ID NO: 164011 - DNA, 1937 bp, Homo sapiens
  Payload ID: 12291
  Gene Symbol: PCID2
  Gene Name: PCI domain containing 2
  Uniprot ID: Q5JVF3
  ENST ID: ENST00000622406
  CDS Start-End: 82-1443
agacggaccgagggccggaagtgacgccagctggcccgcttgaggcgtagggggtggcgctctccgttcggcggcgctcccatggcgcacattaccattaaccagtacctgcagcaggtgtacgaagccatcgacagcagagatggagcatcttgtgcagagttggtgtcttttaaacatcctcatgttgcaaacccacgacttcaaatggcctctccagaggagaagtgtcaacaagtcttggaacccccttatgatgaaatgtttgcagctcatttaaggtgcacttatgcagtggggaatcatgacttcatagaggcatacaagtgccagaccgtgatagtccaatatcctttgtcgttcatggcagctgtcccgcatagaacacatgcagtggattacttgggacttgagacccggaaacactgggccagttgctcatttctgcagttagaaaggaatgacagtgttttggaacagaagctcgtttcagctctttcacttggtacatcattcttgcgagcattccaggcccacaaagaagaaaactgggctctgcctgtcatgtatgcagtagcgcttgaccttcgagtgtttgccaataatgcagatcaacagttggtaaagaaaggaaaaagcaaagttggggacatgttggaaaaagcagcagagttactgatgagctgtttccgggtctgtgccagcgacacccgtgctggtatagaggactctaagaagtggggcatgctgtttctggtgaaccagctgtttaaaatctacttcaagatcaacaaactccatttatgtaaacccctaattagagcaattgacagctcaaacctgaaagacgattacagcactgcacagagagtaacatacaaatactacgttggacgcaaggctatgtttgacagcgattttaagcaagctgaggagtacctgtcatttgcctttgagcattgtcaccgttctagtcagaagaacaaaaggatgattctgatctatttgcttccagtaaaaatgctattgggtcacatgcccactgtggagctcctgaaaaagtatcacctgatgcagtttgcggaagtaaccagagctgtgagcgagggcaacctgctgctgctgcacgaggcgctggcgaagcacgaggccttcttcattcgctgcggaatcttcctcatcctggagaagctgaagatcatcacctacaggaacctctttaagaaagtgtatttgttactgaaaacacaccagctgtctctggatgcttttctggttgccttgaagttcatgcaggtggaggacgtggacattgacgaagttcagtgtattctggctaacttgatatacatgggacacgtcaaaggctacatatcgcatcagcatcagaagctggtggtcagcaagcagaacccatttcctcccctgtccacggtgtgttgaaagtacacggagccccgaggacggcctgatgaaaacctggaattcctttttcacagactcggctggttctggagtctttgtgagacttctttgaaggaggctttgcgtgaaggctgctcggctcacttttcctaagtgtggttcctgaaggctgtctttgtaactttttgtagttctttgtgtaaaaagcgtattctgaatttatacacatggcatgttcttcattatatcttccaggatacatctatttttatatattaaatttgaatgtgttatcaaaatgcttggttaacttaaggcacctttttaaaagcagaatttaatttgatttaaattttccagattttatagcttgcctgtatggatgctcctcaatttatgatagggttacatcccaataaacttattttatttgcctttgctttgttggttaaaaaaaaatttcttttaaaaaaccatcttaaattgaaaatacatttaatacacctgctact

SEQ ID NO: 164012 - DNA, 2546 bp, Homo sapiens
  Payload ID: 12292
  Gene Symbol: PDAP1
  Gene Name: PDGFA associated protein 1
  Uniprot ID: Q13442
  ENST ID: ENST00000350498
  CDS Start-End: 282-827
ctcacttccggtgggtggcaggcagggccacgcgtcttcccgaacggagagactaggggcgttgttgcctggcagcagacgggcaagcctggacttaggcggcgcgcaggacggtccgacttcgtgcggaggcctccctgaggtccgggtccttgcggccactgcggccactgaagcggcggcggcggctggcccaggaggaagaagtcgagcccaagctatttccggttccggtgtcagttcgaggcgccgccgccgccgccgcagccgccggagccgcaatgcctaaaggaggaagaaagggaggccacaaaggccgggcgaggcagtatacaagccctgaggagatcgacgcgcagctgcaggctgagaagcagaaggccagggaagaagaggagcaaaaagaaggtggagatggggctgcaggtgaccccaaaaaggagaagaaatctctagactcagatgagagtgaggatgaagaagatgactaccagcaaaagcgcaaaggcgttgaagggctcatcgacatcgagaaccccaaccgggtggcacagacaaccaaaaaggtcacacaactggatctggacgggccaaaggagctttcgaggagagaacgagaagagattgagaagcagaaggcaaaagagcgttacatgaaaatgcacttggccgggaagacagagcaagccaaggctgacctggcccggctggccatcatccggaaacagcgggaggaggctgcccggaagaaggaagaggaaaggaaagcaaaagacgatgccacattgtcaggaaaacgaatgcagtcactctccctgaataagtaactgcgacccgtgggaggagatgccggggacctgggccgcgctgccaggacctctgctgtgtctcgcccaccctgtgccctggcgccgctgcaacagcccctcatggccaggagccccccatggcctggggcctcctcttcatcttggcacagaaattgtttgggggatggggggggggactgggggaggggtagctgctatctttgagacagaaagatgcaggacagcatttcatatgtaaccatttgaatgtttttgctgtttttagaattcagagcccttgctggggggtgcctgggagatggggtaagaagagctttcatttgtctggtagatagatagcatgtaagggggtggttgtcccaggaggcagctgctgacaggtttgctacacacagccccggactgtgttgcctgggtgctcattcagagaggggctatcatctgggagcctgtgcccctgggtcctcgagggtcatggcttgtccctggtcagtcctgtctgactgacctcagggcctcacctctctgcccttccctgcccggttcctactcacctggctagggccagtgcccattttcagccctacccattgatcatttcaagaaacctctgtttactgtgtggcacccaggcaaaacatgctccacaaattcaacttgtatatttggcagattaaacttgacattatcgtaatctttgttttggcaatccatcctttggcttccgtgctcgagccgtttttacccagctgggtacggtgccacgttcaggcacgtgcacccggcaaggttcagggcacatacctacctggggcatgacatctgtcaggtggcaccgagcaggatgcggggatggaccctagataccacagcctgccccctcccctcctttagccaagtcaggatcttaggcctcagcaggcagggacccttccaggccacagtaggctgaagcagcaccaggatcctggcctggcctggcctgtaggtgtcccctggtggttataattctgtaactctaggggagaaggggaatagcactagcattggatgtcgccaaggcccacattttcctgagagaagccacaaaagatgtgcaaatgcccttcagcacaggacctggtgacatgacataaactccaagacagaacctcagtttacagcacacgaaaaaaatatcttgccaacattgtaatgacaaaataaattcccgtgaagttccacaaccaggccgggcatggtggctcatgcctgtaatcccagcactttgggaggtgaggtgggtggatcatctgaggtcaggagttcaagaccagcctggccaacatggagaaactccgtctctactaaaaatacaaaaattaaccaggcttggtggtgtatgcctgtaatcccagctacttgggaggctgaggcaggagaatcgcttgatcccaggaaggcagaggtggcagtgagctgagaacgcacaactgcactccagcctgggtgacgagcaaaactccatctcaaaacaaaagttccacaaccagcctggagtgtgtagcccctttgtccaggaatttgactagtcaatcagtgacacctggtactggcagttttgggagtggcagcccaggatggacagcagtggggagggaaccatttggcataaggccgttgggcttcaggatcaattttgttggcaagcagtaaaaataagctatctacctatgg

SEQ ID NO: 164013 - DNA, 767 bp, Homo sapiens
  Payload ID: 12292
  Gene Symbol: PDAP1
  Gene Name: PDGFA associated protein 1
  ENST ID: ENST00000426447
  CDS Start-End: 43-162
gttcgaggcgccgccgccgccgccgcagccgccggagccgcaatgcctaaaggaggaagaaagggaggccacaaaggccgggcgaggcagtatacaagccctgaggagatcgacgcgcagctgcaggctgagaagcagaaggccagggttgtccatttctgaaacaggaagaagaggagcaaaaagaaggtggagatggggctgcaggtgaccccaaaaaggagaagaaatctctagactcagatgagagtgaggatgaagaagatgactaccagcaaaagcgcaaaggcgttgaagggctcatcgacatcgagaaccccaaccgggtggcacagacaaccaaaaaggtcacacaactggatctggacgggccaaaggagctttcgaggagagaacgagaagagattgagaagcagaaggcaaaagagcgttacatgaaaatgcacttggccgggaagacagagcaagccaaggctgacctggcccggctggccatcatccggaaacagcgggaggaggctgcccggaagaaggaagaggaaaggaaagcaaaagacgatgccacattgtcaggaaaacgaatgcagtcactctccctgaataagtaactgcgacccgtgggaggagatgccggggacctgggccgcgctgccaggacctctgctgtgtctcgcccaccctgtgccctggcgccgctgcaacagcccctcatggccaggagccccccatggcctggggcctcctcttcatcttggcacagaaattgt

SEQ ID NO: 164014 - DNA, 120 bp, Homo sapiens
  Payload ID: 12292
  Gene Symbol: PDAP1
  Gene Name: PDGFA associated protein 1
  ENST ID: ENST00000626285
  CDS Start-End: 1-120
atgcctaaaggaggaagaaagggaggccacaaaggccgggcgaggcagtatacaagccctgaggagatcgacgcgcagctgcaggctgagaagcagaaggccagggttgtccatttctga

SEQ ID NO: 164015 - DNA, 2566 bp, Homo sapiens
  Payload ID: 12293
  Gene Symbol: PDIK1L
  Gene Name: PDLIM1 interacting kinase 1 like
  Uniprot ID: Q8N165
  ENST ID: ENST00000374269
  CDS Start-End: 85-1110
gcgagctgcccgataatggcggcctgcagagcccatgagagggagaagcggcagcgtctaccctgagaaacctcgaccttgaagatggtgagtagccagccaaagtacgatctaatacgggaggtaggccgaggtagttacggtgttgtgtatgaagcagtcatcagaaagacctctgcacgggtggcagtgaagaaaattcgatgtcacgcacctgaaaatgttgaactagcccttcgtgagttctgggcactaagcagtatcaagagccaacatccaaatgtgattcacttggaggaatgcatcctacaaaaggatgggatggtgcaaaagatgtcccacggctctaattcttccctttatttacagcttgtagaaacttcattaaaaggagaaattgcctttgatcccagaagcgcctattatttgtggtttgtgatggatttttgtgacggaggagatatgaatgagtatctgttgtccaggaaacccaatcgtaaaactaacaccagcttcatgcttcagctgagcagtgccctggctttcttgcataaaaaccagatcatccaccgagatcttaagcctgataacatcctgatttctcaaaccaggttggataccagtgacttggaacctaccctcaaagtggctgattttggtctaagtaaagtttgttcagcctctgggcagaacccagaagaacctgtcagtgtaaacaagtgtttcctttccacagcatgtggaacagatttttacatggctcctgaagtttgggaaggacattacacagcaaaagctgacatctttgctctggggattatcatctgggcaatgctggaaaggatcacattcatagacacagagacaaagaaggaactcttggggagttatgtaaaacaaggaactgagattgtgcctgttggggaggcacttctggaaaatcccaaaatggaacttctcattcctgtgaagaaaaaatctatgaatgggcgaatgaaacaactgattaaggaaatgctggctgcaaaccctcaggatcgtccagatgcttttgaactagaactcagattagtacaaattgcatttaaagatagcagctgggaaacgtgacacatattatttgcaaataccatggatgatatgctgcttctgtttaacagtgatgcaacattatgtggctgaaaaagaatataaaaagctagactctaccctctaagggtttagattttttgtgggattttttttttcctcatttttcttaaatccaagttggccgttttattagtatgtttcaaatgtgtattaccaatgtgggtgtaaatttttaaaaaatgattattgatagaagtttggcaggaaaattctttaagagctaacaagagaagagagtccagttttctggaaatatgtctttaagtattttagacattcctcgtcagtattaggaatttccatgggaaaagaggtttgcatgctggtaatgcaacctttgaaactttgtaaaggaaacatatatgtatatatttatgtatatgtaagtatgtgaatgtgcgcattttgcattccatatgaaaaaaatgccacgtctgtttaaattatttgatgtaggtttgggtttttgagatttgctggtgaagtcagtgacgaaaaataaaccttcccttatcttcctactctgcccctccccctaatgaaatcatattaagttgtttttttttttttttgtaatatacagctttttttttaaggcatcattttcgagggtctaaaattatctggtaaaacaaatgaaattaagtgatccaaagctgctgaagtatgtttgaactctccagtgccctatagctgcaagagttgaattagtcatgcagtcatatggcagcaggttggtgattcagtccgaccttctttaggtaaccgagcatttatttaaccaactataccactgcattgggacgtctgcacttgagcttctacaatctgatataaatctgaatacaggattattctgtttgaaaactttgctatgtgtgaactgtaatacttgatacatttttggtttgaagactttgtctaagcctcattatactgaagttgaagaaaccaaatgagctccaccctcactttgcctgccctgatatgatcacttgttgagtcactggagttcctttcattttggcactgatgctgttttctcttgtctgatttgaaacagtactggtaataatatggttgttgaaaatgtgatcacctttatctaaagtgggagaagatacatacacagtatggcaaatggataaaatattgtggcatcaactacttttaaagtagaaaagctatccattttatacaatcactgatacagtctatgtcaaaaaaccaacagaccattattcctcttgaagttagtttgattttatctttgtatggttgtctacaatttgttttcctgtaaatgcagatagttaaaatctaaaggatagaatgctttcctaaaacagaacattagcctttaaggttaaatagactttacattgtatctaagttaatctttataaagcactag

SEQ ID NO: 164016 - DNA, 4279 bp, Homo sapiens
  Payload ID: 12293
  Gene Symbol: PDIK1L
  Gene Name: PDLIM1 interacting kinase 1 like
  Uniprot ID: Q8N165
  ENST ID: ENST00000374271
  CDS Start-End: 288-1313
ggcagcggaggcgcgagctgcccgataatggcggcctgcagagcccatgagagggagaagcggcagcgtctaccctgaggaaggtgctcttccccatggggactgtaccaggctggagaggacatggcactgcttcagagacacgaaccaccttgagtggatgtgattggcgatccccgtagagcaggaaagctcgtctgctgtgcagccggcgcagaggattctgtggcaggaaattagacactaggaaattcagtagcgatttgaaggaaacctcgaccttgaagatggtgagtagccagccaaagtacgatctaatacgggaggtaggccgaggtagttacggtgttgtgtatgaagcagtcatcagaaagacctctgcacgggtggcagtgaagaaaattcgatgtcacgcacctgaaaatgttgaactagcccttcgtgagttctgggcactaagcagtatcaagagccaacatccaaatgtgattcacttggaggaatgcatcctacaaaaggatgggatggtgcaaaagatgtcccacggctctaattcttccctttatttacagcttgtagaaacttcattaaaaggagaaattgcctttgatcccagaagcgcctattatttgtggtttgtgatggatttttgtgacggaggagatatgaatgagtatctgttgtccaggaaacccaatcgtaaaactaacaccagcttcatgcttcagctgagcagtgccctggctttcttgcataaaaaccagatcatccaccgagatcttaagcctgataacatcctgatttctcaaaccaggttggataccagtgacttggaacctaccctcaaagtggctgattttggtctaagtaaagtttgttcagcctctgggcagaacccagaagaacctgtcagtgtaaacaagtgtttcctttccacagcatgtggaacagatttttacatggctcctgaagtttgggaaggacattacacagcaaaagctgacatctttgctctggggattatcatctgggcaatgctggaaaggatcacattcatagacacagagacaaagaaggaactcttggggagttatgtaaaacaaggaactgagattgtgcctgttggggaggcacttctggaaaatcccaaaatggaacttctcattcctgtgaagaaaaaatctatgaatgggcgaatgaaacaactgattaaggaaatgctggctgcaaaccctcaggatcgtccagatgcttttgaactagaactcagattagtacaaattgcatttaaagatagcagctgggaaacgtgacacatattatttgcaaataccatggatgatatgctgcttctgtttaacagtgatgcaacattatgtggctgaaaaagaatataaaaagctagactctaccctctaagggtttagattttttgtgggattttttttttcctcatttttcttaaatccaagttggccgttttattagtatgtttcaaatgtgtattaccaatgtgggtgtaaatttttaaaaaatgattattgatagaagtttggcaggaaaattctttaagagctaacaagagaagagagtccagttttctggaaatatgtctttaagtattttagacattcctcgtcagtattaggaatttccatgggaaaagaggtttgcatgctggtaatgcaacctttgaaactttgtaaaggaaacatatatgtatatatttatgtatatgtaagtatgtgaatgtgcgcattttgcattccatatgaaaaaaatgccacgtctgtttaaattatttgatgtaggtttgggtttttgagatttgctggtgaagtcagtgacgaaaaataaaccttcccttatcttcctactctgcccctccccctaatgaaatcatattaagttgtttttttttttttttgtaatatacagctttttttttaaggcatcattttcgagggtctaaaattatctggtaaaacaaatgaaattaagtgatccaaagctgctgaagtatgtttgaactctccagtgccctatagctgcaagagttgaattagtcatgcagtcatatggcagcaggttggtgattcagtccgaccttctttaggtaaccgagcatttatttaaccaactataccactgcattgggacgtctgcacttgagcttctacaatctgatataaatctgaatacaggattattctgtttgaaaactttgctatgtgtgaactgtaatacttgatacatttttggtttgaagactttgtctaagcctcattatactgaagttgaagaaaccaaatgagctccaccctcactttgcctgccctgatatgatcacttgttgagtcactggagttcctttcattttggcactgatgctgttttctcttgtctgatttgaaacagtactggtaataatatggttgttgaaaatgtgatcacctttatctaaagtgggagaagatacatacacagtatggcaaatggataaaatattgtggcatcaactacttttaaagtagaaaagctatccattttatacaatcactgatacagtctatgtcaaaaaaccaacagaccattattcctcttgaagttagtttgattttatctttgtatggttgtctacaatttgttttcctgtaaatgcagatagttaaaatctaaaggatagaatgctttcctaaaacagaacattagcctttaaggttaaatagactttacattgtatctaagttaatctttataaagcactagaatttttggtcaaaagtcaaaatagtattagaatattgaaattattgatagctttcataatctcagcttttttgaacttccacaatttttggaatatgtcataatttttttccctgtttcaaatgtgttcagaggaaatagaatgtaaaacatcacaaaaaaaattgcagtacataaaatttctggactatgttagttacttgatctggaagtttaaaatttggactaaaaggttttattgaaataaagcctcttaaaatgaaaaatcatatacttttaacatcacttttaagctaataaatataagaattcttttggaaattagaggtggaaacacactggaacctcatgataattgaccctctggatcaccagattagtttaatttaacagatatgtccaaggaagttgagctatagggagtaagaaaaagcatcatgataacgtctagtcaataacatggcacttcagcagagattcatagatgatggtatgcccatgcatcatttgctcttcaaatatctatgtgcttggagccacagtttcctaagcgcatagtttttggtcctgcctcatgtaaaatagttaatgattatcatttacttggaaagattttacctgtgaagtgaaattctttcattgggggtaagggtatgaggtgatcaggaagtttcttctggaattttatcaagtccttgtattctaaaatagccaagcaaaatgatagtaaattctttgtctttgttctttcagtcagaggtatttattaagtacctactgtgtgctcagcactaaaggtttgttgataaaatgacaattaaaaaatggcatttagccaaaggccttttcagccaggagtaagaaaagatggttagtgatatttggaaatacctggatatttgctagaggaaaaatgaaagcaaaacttcgtacacagtgccttgcccataataggtactcaataagcaattgttcctcatagagtcttttgccatgatttatggtgttttttgaaatttgtcttaattgaaaaaagaccaaatatttcaaatgagcttataggcagctgtggccagtgaaaatatggggttgtacagttagttcctagaatgttattttgcactagttgtcacttagaaagatggggttcctgtagattttttggtgctaagggatactttgtcattatgatgaagtaagtgttaagtgtcagataaatagcacacagaatagttctttctgctggtctgttttttctcttcgttgttgttgtttttaattgtaaattgttatcaatcaaactattgtagcagctacaaagtaattcaccagcatgacaaaatggtcaaaaaataagtcatcagcacttaagaaatgaaagcaacttttgaaattttctgttaaaattgtcaaatatattttatgaagaatttataaaaggggaaaatgattgtaatttattgttcatgacttttttttttaaataaagtgagtttcaacaaaaaaaaaa

SEQ ID NO: 164017 - DNA, 838 bp, Homo sapiens
  Payload ID: 12293
  Gene Symbol: PDIK1L
  Gene Name: PDLIM1 interacting kinase 1 like
  ENST ID: ENST00000444713
  CDS Start-End: 266-838
gcacccagccccgcgccgccgccgccgccgccgtctccgcaactgcaccgcccgcaaacatggctcagtgactcggagaaaagctgcagtctccctcccggcggggcggacgccaggcctccttggtcgggccgcacctccccgcaggcccgccaaagagcaccgcgccccgcaggcacccgagacccgcgcggaagatgcaccgggcgttccaccccagcgagccccgcaccccagcccgcagctcgaaacctcgaccttgaagatggtgagtagccagccaaagtacgatctaatacgggaggtaggccgaggtagttacggtgttgtgtatgaagcagtcatcagaaagacctctgcacgggtggcagtgaagaaaattcgatgtcacgcacctgaaaatgttgaactagcccttcgtgagttctgggcactaagcagtatcaagagccaacatccaaatgtgattcacttggaggaatgcatcctacaaaaggatgggatggtgcaaaagatgtcccacggctctaattcttccctttatttacagcttgtagaaacttcattaaaaggagaaattgcctttgatcccagaagcgcctattatttgtggtttgtgatggatttttgtgacggaggagatatgaatgagtatctgttgtccaggaaacccaatcgtaaaactaacaccagcttcatgcttcagctgagcagtgccctggctttcttgcataaaaaccagatcatccaccgagatcttaagcctgataacatcctgatttctcaaaccaggttggataccagtgacttggaacctaccctcaaagtggctgatttt

SEQ ID NO: 164018 - DNA, 4252 bp, Homo sapiens
  Payload ID: 12293
  Gene Symbol: PDIK1L
  Gene Name: PDLIM1 interacting kinase 1 like
  Uniprot ID: Q8N165
  ENST ID: ENST00000619836
  CDS Start-End: 274-1299
agatgatcgcacccagccccgcgccgccgccgccgccgccgtctccgcaactgcaccgcccgcaaacatggctcagtgactcggagaaaagctgcagtctccctcccggcggggcggacgccaggcctccttggtcgggccgcacctccccgcaggcccgccaaagagcaccgcgccccgcaggcacccgagacccgcgcggaagatgcaccgggcgttccaccccagcgagccccgcaccccagcccgcagctcgaaacctcgaccttgaagatggtgagtagccagccaaagtacgatctaatacgggaggtaggccgaggtagttacggtgttgtgtatgaagcagtcatcagaaagacctctgcacgggtggcagtgaagaaaattcgatgtcacgcacctgaaaatgttgaactagcccttcgtgagttctgggcactaagcagtatcaagagccaacatccaaatgtgattcacttggaggaatgcatcctacaaaaggatgggatggtgcaaaagatgtcccacggctctaattcttccctttatttacagcttgtagaaacttcattaaaaggagaaattgcctttgatcccagaagcgcctattatttgtggtttgtgatggatttttgtgacggaggagatatgaatgagtatctgttgtccaggaaacccaatcgtaaaactaacaccagcttcatgcttcagctgagcagtgccctggctttcttgcataaaaaccagatcatccaccgagatcttaagcctgataacatcctgatttctcaaaccaggttggataccagtgacttggaacctaccctcaaagtggctgattttggtctaagtaaagtttgttcagcctctgggcagaacccagaagaacctgtcagtgtaaacaagtgtttcctttccacagcatgtggaacagatttttacatggctcctgaagtttgggaaggacattacacagcaaaagctgacatctttgctctggggattatcatctgggcaatgctggaaaggatcacattcatagacacagagacaaagaaggaactcttggggagttatgtaaaacaaggaactgagattgtgcctgttggggaggcacttctggaaaatcccaaaatggaacttctcattcctgtgaagaaaaaatctatgaatgggcgaatgaaacaactgattaaggaaatgctggctgcaaaccctcaggatcgtccagatgcttttgaactagaactcagattagtacaaattgcatttaaagatagcagctgggaaacgtgacacatattatttgcaaataccatggatgatatgctgcttctgtttaacagtgatgcaacattatgtggctgaaaaagaatataaaaagctagactctaccctctaagggtttagattttttgtgggattttttttttcctcatttttcttaaatccaagttggccgttttattagtatgtttcaaatgtgtattaccaatgtgggtgtaaatttttaaaaaatgattattgatagaagtttggcaggaaaattctttaagagctaacaagagaagagagtccagttttctggaaatatgtctttaagtattttagacattcctcgtcagtattaggaatttccatgggaaaagaggtttgcatgctggtaatgcaacctttgaaactttgtaaaggaaacatatatgtatatatttatgtatatgtaagtatgtgaatgtgcgcattttgcattccatatgaaaaaaatgccacgtctgtttaaattatttgatgtaggtttgggtttttgagatttgctggtgaagtcagtgacgaaaaataaaccttcccttatcttcctactctgcccctccccctaatgaaatcatattaagttgtttttttttttttttgtaatatacagctttttttttaaggcatcattttcgagggtctaaaattatctggtaaaacaaatgaaattaagtgatccaaagctgctgaagtatgtttgaactctccagtgccctatagctgcaagagttgaattagtcatgcagtcatatggcagcaggttggtgattcagtccgaccttctttaggtaaccgagcatttatttaaccaactataccactgcattgggacgtctgcacttgagcttctacaatctgatataaatctgaatacaggattattctgtttgaaaactttgctatgtgtgaactgtaatacttgatacatttttggtttgaagactttgtctaagcctcattatactgaagttgaagaaaccaaatgagctccaccctcactttgcctgccctgatatgatcacttgttgagtcactggagttcctttcattttggcactgatgctgttttctcttgtctgatttgaaacagtactggtaataatatggttgttgaaaatgtgatcacctttatctaaagtgggagaagatacatacacagtatggcaaatggataaaatattgtggcatcaactacttttaaagtagaaaagctatccattttatacaatcactgatacagtctatgtcaaaaaaccaacagaccattattcctcttgaagttagtttgattttatctttgtatggttgtctacaatttgttttcctgtaaatgcagatagttaaaatctaaaggatagaatgctttcctaaaacagaacattagcctttaaggttaaatagactttacattgtatctaagttaatctttataaagcactagaatttttggtcaaaagtcaaaatagtattagaatattgaaattattgatagctttcataatctcagcttttttgaacttccacaatttttggaatatgtcataatttttttccctgtttcaaatgtgttcagaggaaatagaatgtaaaacatcacaaaaaaaattgcagtacataaaatttctggactatgttagttacttgatctggaagtttaaaatttggactaaaaggttttattgaaataaagcctcttaaaatgaaaaatcatatacttttaacatcacttttaagctaataaatataagaattcttttggaaattagaggtggaaacacactggaacctcatgataattgaccctctggatcaccagattagtttaatttaacagatatgtccaaggaagttgagctatagggagtaagaaaaagcatcatgataacgtctagtcaataacatggcacttcagcagagattcatagatgatggtatgcccatgcatcatttgctcttcaaatatctatgtgcttggagccacagtttcctaagcgcatagtttttggtcctgcctcatgtaaaatagttaatgattatcatttacttggaaagattttacctgtgaagtgaaattctttcattgggggtaagggtatgaggtgatcaggaagtttcttctggaattttatcaagtccttgtattctaaaatagccaagcaaaatgatagtaaattctttgtctttgttctttcagtcagaggtatttattaagtacctactgtgtgctcagcactaaaggtttgttgataaaatgacaattaaaaaatggcatttagccaaaggccttttcagccaggagtaagaaaagatggttagtgatatttggaaatacctggatatttgctagaggaaaaatgaaagcaaaacttcgtacacagtgccttgcccataataggtactcaataagcaattgttcctcatagagtcttttgccatgatttatggtgttttttgaaatttgtcttaattgaaaaaagaccaaatatttcaaatgagcttataggcagctgtggccagtgaaaatatggggttgtacagttagttcctagaatgttattttgcactagttgtcacttagaaagatggggttcctgtagattttttggtgctaagggatactttgtcattatgatgaagtaagtgttaagtgtcagataaatagcacacagaatagttctttctgctggtctgttttttctcttcgttgttgttgtttttaattgtaaattgttatcaatcaaactattgtagcagctacaaagtaattcaccagcatgacaaaatggtcaaaaaataagtcatcagcacttaagaaatgaaagcaacttttgaaattttctgttaaaattgtcaaatatattttatgaagaatttataaaaggggaaaatgattgtaatttattgttcatgacttttttttttaaataaagtgagtttc

SEQ ID NO: 164019 - DNA, 7176 bp, Homo sapiens
  Payload ID: 12294
  Gene Symbol: PDS5A
  Gene Name: PDS5 cohesin associated factor A
  Uniprot ID: Q29RF7
  ENST ID: ENST00000303538
  CDS Start-End: 541-4554
ggccggcggaggaaggggagggagcgaggagcgcgcgctgctctcgcgtgctctcgcgccgctcgcgtgaccggccggtgtgtgcgcgaggccccggctcccggggcacggacggccgggcgcgcgcctctgcgaggggcgtccgggtccgagtcggcggtccgggccggcgcgaggtgcgtgcgggcgggccgcgggggtcccggacggacacaagcgcacacactcccggaggagccttcgaggctgctcttcctcggccagacggagagcggcactgtctccccgcccagcgctcactcgccccgcgtctccccccgcggcggctgctcctcctcggcaccgccagccccagcgccgctcccgggcgggcgggcggcggcggcggcggcggcgggacccgcggagccgctttgtgtgcagcccgactaggggcggcggcgcaaccacctgacagaggcccgggcgctcgatgcaccttccgcccgcatgaggaggagaggccggtagaggactgtgaaccaaaagttgtcccccaggatggacttcaccgcgcagcccaagcctgccactgccctctgtggcgtcgtgagtgccgacgggaagatcgcttaccctccgggggtaaaagagatcaccgacaagatcaccacggacgagatgatcaaacgcctgaagatggtagtgaaaacctttatggatatggatcaggactcagaagatgaaaaacagcagtatctcccactagccttgcatcttgcatctgaattcttcctcaggaaccccaataaagatgtgcgtctccttgtagcatgttgtttggctgatatctttcgtatctatgccccagaagctccatatacttcccatgataaacttaaggacatatttttgtttattaccagacaattaaaaggtttggaggatacaaagagtccacagtttaatagatacttttatttattagagaatttagcttgggttaaatcatataacatctgctttgaattggaagattgcaatgaaatttttattcagctttttagaactctcttctcagtgatcaacaatagccacaataagaaggtacaaatgcacatgctagatttgatgagttctatcatcatggaaggtgatggagttactcaagaattattggactccattcttattaacctcattcctgcacataagaacttaaataaacagtcctttgaccttgcaaaagtgctattgaaaagaacagtccagactattgaggcatgcattgctaattttttcaatcaagtcctggtgctgggaagatcatcagtaagtgatttgtcagaacatgtatttgatctgattcaggaactttttgctatagatcctcatttattattatccgtcatgccacagcttgaattcaaactaaagagcaatgatggagaagagcgattagctgttgttcgacttctagctaaattgtttggctccaaagattctgatttggcaacacagaatcgtcctctttggcaatgttttcttggacgatttaatgatattcatgttcctgtgagattagaaagtgtgaaatttgccagtcattgtttaatgaatcacccagatttagcgaaggatctcacagaatatttaaaggttagatcacatgatccagaagaagctattcgtcatgatgtcattgttactataataacagctgccaagagggacctggccttagtaaatgatcagctgcttggctttgtaagggaaagaacactggataaacggtggcgagtaagaaaagaagctatgatgggtctggctcagctttataagaaatactgtcttcatggtgaagcaggaaaggaagctgcagagaaagtcagctggataaaggacaaacttctgcatatttattatcagaacagcattgacgacaaactgttggtagagaaaatctttgctcagtatcttgtcccccacaacctggaaacagaagagagaatgaaatgcttatattacttatatgctagtttggatccaaatgctgtaaaagctctcaacgaaatgtggaagtgtcagaacatgcttcggagccatgtacgcgaactattggatttgcacaagcagcctacatcagaggctaactgttctgccatgtttggaaaactgatgaccatagcaaagaatttgcctgaccccgggaaagcacaagattttgtgaagaaatttaaccaggttctcggcgatgatgagaaacttcggtctcagttggagttattaattagcccaacctgttcttgcaaacaagcagatatttgtgtgagagaaatagcccggaaacttgcaaatcctaagcaaccaacaaatccttttctagagatggtcaaatttctgttggaaagaatcgcacctgtgcacattgattcagaagccataagtgcactagtgaaattgatgaataagtcaatagaggggacagcagatgatgaagaggagggtgtaagtccagatacagctatccgttcaggacttgaacttcttaaggttctgtcttttacacatcctacctcgttccactctgcagagacatatgagtccttgttacagtgcctaagaatggaggatgacaaggtagcagaagctgctattcaaatttttagaaatacaggtcacaaaatagaaacagaccttccccagatacgatcgaccttaattcccattttacatcaaaaagcaaagaggggtactccacaccaagcaaaacaggctgtgcactgtatacacgccatattcacaaataaagaagtccagcttgcacagatttttgagccactcagtaggagtctgaatgctgatgtgccagaacaacttataactccattagtttcattgggccacatttctatgttagcaccagatcagtttgcttccccaatgaaatctgtagtagcaaattttattgtgaaagatctgctaatgaatgacaggtcaacaggtgaaaagaatggaaaactgtggtctccagatgaagaggtttcccctgaagtactagcaaaggtacaggcaattaaacttctggtaaggtggctgttgggtatgaaaaacaaccagtctaaatctgccaattcaacccttcggttattatcagcgatgttggttagtgagggtgacctgacagagcaaaagaggatcagtaaatctgatatgtctcgcttgcgattagctgctggtagtgccataatgaagcttgctcaggaaccttgttaccatgaaattattaccccagaacagtttcagctctgtgcacttgttattaatgatgagtgttaccaagtaaggcagatatttgctcagaagctgcataaggcacttgtgaagttactgctcccattggagtatatggcgatctttgccttgtgtgccaaagatcctgtgaaggagagaagagcacacgcacgacaatgtttactgaaaaatatcagtatacgcagggaatacattaagcagaatcctatggctactgagaaattattatcactgttgcctgaatatgtagttccatacatgattcacctgctagcccatgatccagattttacaagatcacaagatgttgatcagcttcgtgatatcaaagagtgcctatggttcatgcttgaagttttaatgacaaagaatgaaaacaatagccatgcctttatgaagaagatggcagagaacatcaagttaaccagagatgcccagtctccagatgaatccaagacaaatgaaaaactgtatacagtatgtgatgtggctctctgtgttataaatagtaaaagtgctttgtgcaatgcagattcaccaaaggacccagtcctcccaatgaaattttttacacaacctgaaaaggacttctgtaacgataagagttatatttcagaagagacaagagtacttctgttaacaggaaagccaaagcctgctggagtactaggtgcagtaaataagcctttatcagcaacgggaaggaaaccctatgttagaagcactggcactgagactggaagcaatattaatgtaaattcagagctgaacccttcaaccggaaatcgatcaagggaacagagttcagaggcagcagaaactggagttagtgaaaatgaagagaaccctgtgaggattatttcagtcacacctgtaaagaatattgacccagtaaagaataaggaaattaattctgatcaggctacccagggcaacatcagcagtgaccgaggaaagaaaagaacagtaacagcagctggtgcagagaatatccaacaaaaaacagatgagaaagtagatgaatcgggacctcccgccccttccaaacccaggagaggacgtcgacccaagtctgaatctcagggcaatgctaccaaaaatgatgatctaaataaacctattaacaagggaaggaagagagctgcagtgggtcaggagagccctgggggtttggaagcaggtaatgccaaagcacccaaactgcaagatttagccaaaaaggcagcaccagcagaaagacaaattgacttacaaaggtaaaaatgcatttgcaaagggagaaaatgaaggccaaacagaagcaggctccagcttctgcaaaaacttggattcacaaatgtccctgaacagaaaatgaagctcacttcagaacacacactctctgccttgaaaactaaagagactattacttccttttcacatgaccacaagtcctctgatggaaatgtacagcagaaactcttgagagagaggctaaaagcaactctgttctcccccttcccctagacttttcttacgaaaagtcaataattaagcaaattgcttaacacttggttccagttcctgcctatctggagtttaaatgcgtaatacaccattaatttccacgctgcagtttttattttaaagaaagtaacaagatgtctttacactgacactgaaaattcatccattttagagccaggaattcccatgttacacaggaaaaaatagaagtctactgaattaattttttaaaagaaaagagatcagattaaatatttctttgtttttccttttggaaacttttatgtataattctttctgcctgcctacttttctgcaaaaatgagatgtacagatttcggttccctgctatgaaaagtgatgtggtagcaattttataaatgttgctttctgatttttatcagagtgagaaaattaaaattattgatttgcaagtagtaaacagttcatattttgatttcccctcattttagtttaatataatttgcaataaatgtacatattgttgtttgtttcataaagcatatcactttaaaatggtttttactcctgtgattatgttggaatatttggaattttaaaggagtaaagactgtccagcatttggttttataatgtttgtcaccagatttttattaatgtaaaaaaaatcaatttttaaaaaatagttggactttggcagcttttaaggaaagttggaggtgttttaggattgctatcaattttcagcattgtgctatttggaaataagtgttttgcttttgtctgatggtctgggctcatttttatgtttattttagaaaactgttgcatcaatatattatgtttcttggcattgttcagcataggtaatgtgtgcactttatgtgtacacataatcatatttaagttttttgcataaaataaatgcttctagatgtcatggcagtctttttaatctttttatcatatgctttcttgtgaattttttcatgttaaagagctaaagtcataacatgattacagtcaactctccattatctatataaaatagtgactaagcctcaggtttttaattttgtgataacaaaataacgaaggcatgtaagacctgattctggaggaacatgaaatttgtcttttctcatgtccagagttctatcctgcccccactgtccactgtagggtcatccgcaaagccctagcagaatgtgctcactccatttccttacacgtttctagcatgggtcagaggaaacaacatttgtgttataacttcgtcttgataggctgtagtgtacatgggatgtaaaacaaacaagtgtatcaaaggtggatgattctgttagagtgaagtttgagagtaaatgtcacttacgtttctcatagataatcaagagttggctgtgtattgactgaaagatgggtaattattttaaatatgcatttacacacatttaggtatcagaagatgcttagggaacaatggataccaatgatagaaaatgatacctttacaggggcagaaaaatccccactcttccttattgcctcttcagaaccctttagaaagtataaaatattgcctccaacatgctgaaaaagagtatctatgcataagtatcagagaagtccctcaagcaatcagtaggtgtgttctatttagagagagtttaaagttctcttagcatcagacaacttgattcctaaggtttccagtgtgtcaccaacaaaaagtgcattgatagggacctttgtctcttcctccctttgattaattgcccggcatcacagtttactagattaccaagtgttacatcatattaaataaaatgtagcagaaccatctgcatcaatatattcctgtttagatttttgcaggagagaagttaaaaggatttgctccttgtatgatgtaagtggcccaccccaattttgtaacatgatgcaagtgtctggcactaagggaagcaagagtagggttgtggaaagaccaagctgatggggagggacttgtttacgggaatttttttagttttccttttcaaaggaaaacattaaaatcccttaggaatttggtattcacatctcagagaactacaacacaaaagtgcagacttatatttgagaattaatgttaaccctttgtgtctagtttgaagcttcttgtatttgtctaaaacaacaagccagaattttgtatctcctttgataaaaagtgtgtataatgtaaagtagttttgcatattcttgtgctgcacatgggctgaatttttaaattttttttaaaaacttgaagcagaaccttgtaatttgtgtaaatgacaagtgtaaaatcctaccataaaatgctaaaaatatgcactgtttcaaataaaaccaagaaatgcagcatta

SEQ ID NO: 164020 - DNA, 781 bp, Homo sapiens
  Payload ID: 12294
  Gene Symbol: PDS5A
  Gene Name: PDS5 cohesin associated factor A
  ENST ID: ENST00000507020
  CDS Start-End: 1-381
ttaattcccattttacatcaaaaagcaaagaggggtactccacaccaagcaaaacaggctgtgcactgtatacacgccatattcacaaataaagaagtccagcttgcacagatttttgagccactcagtaggagtctgaatgctgatgtgccagaacaacttataactccattagtttcattgggccacatttctatgttagcaccagatcagtttgcttccccaatgaaatctgtagtagcaaattttattgtgaaagatctgctaatgaatgacaggtcaacaggtgaaaagaatggaaaactgtggtctccagatgaagaggtttcccctgaagtactagcaaagcactttgggaggcagagcaggaggatcgcttgagcccaagagttcaagaccaacctgggcagcatacatgttaatattttataggtacaggcaattaaacttctggtaaggtggctgttgggtatgaaaaacaaccagtctaaatctgccaattcaacccttcggttattatcagcgatgttggttagtgagggtgacctgacagagcaaaagaggatcagtaaatctgatatgtctcgcttgcgattagctgctggtagtgccataatgaagcttgctcaggaaccttgttaccatgaaattattaccccagaacagtttcagctctgtgcacttgttattaatgatgagtgttaccaagtaaggcagatatttgctcagaagctgcataaggcacttgtgaagttactgctcccattggagtatatggcga

SEQ ID NO: 164021 - DNA, 494 bp, Homo sapiens
  Payload ID: 12294
  Gene Symbol: PDS5A
  Gene Name: PDS5 cohesin associated factor A
  ENST ID: ENST00000513798
  CDS Start-End: 1-494
atctcccactagccttgcatcttgcatctgaattcttcctcaggaaccccaataaagatgtgcgtctccttgtagcatgttgtttggctgatatctttcgtatctatgccccagaagctccatatacttcccatgataaacttaagtggcgagtaagaaaagaagctatgatgggtctggctcagctttataagaaatactgtcttcatggtgaagcaggaaaggaagctgcagagaaagtcagctggataaaggacaaacttctgcatatttattatcagaacagcattgacgacaaactgttggtagagaaaatctttgctcagtatcttgtcccccacaacctggaaacagaagagagaatgaaatgcttatattacttatatgctagtttggatccaaatgctgtaaaagctctcaacgaaatgtggaagtgtcagaacatgcttcggagccatgtacgcgaactattggatttgcacaagcagcctaca

SEQ ID NO: 164022 - DNA, 581 bp, Homo sapiens
  Payload ID: 12294
  Gene Symbol: PDS5A
  Gene Name: PDS5 cohesin associated factor A
  ENST ID: ENST00000512643
  CDS Start-End: 1-132
agcaatgatggagaagagcgattagctgttgttcgacttctagctaaattgtttggctccaaagattctgatttggcaacacagaatcgtcctctttggcaatgttttcttggacgaatatttaaaggttagatcacatgatccagaagaagctattcgtcatgatgtcattgttactataataacagctgccaagagggacctggccttagtaaatgatcagctgcttggctttgtaagggaaagaacactggataaacggtggcgagtaagaaaagaagctatgatgggtctggctcagctttataagaaatactgtcttcatggtgaagcaggaaaggaagctgcagagaaagtcagctggataaaggacaaacttctgcatatttattatcagaacagcattgacgacaaactgttggtagagaaaatctttgctcagtatcttgtcccccacaacctggaaacagaagagagaatgaaatgcttatattacttatatgctagtttggatccaaatgctgtaaaagctctcaacgaaatgtggaagtgtcagaacatgcttcggagccatgtacgcg

SEQ ID NO: 164023 - DNA, 2685 bp, Homo sapiens
  Payload ID: 12294
  Gene Symbol: PDS5A
  Gene Name: PDS5 cohesin associated factor A
  Uniprot ID: Q29RF7
  ENST ID: ENST00000503396
  CDS Start-End: 541-2343
ggccggcggaggaaggggagggagcgaggagcgcgcgctgctctcgcgtgctctcgcgccgctcgcgtgaccggccggtgtgtgcgcgaggccccggctcccggggcacggacggccgggcgcgcgcctctgcgaggggcgtccgggtccgagtcggcggtccgggccggcgcgaggtgcgtgcgggcgggccgcgggggtcccggacggacacaagcgcacacactcccggaggagccttcgaggctgctcttcctcggccagacggagagcggcactgtctccccgcccagcgctcactcgccccgcgtctccccccgcggcggctgctcctcctcggcaccgccagccccagcgccgctcccgggcgggcgggcggcggcggcggcggcggcgggacccgcggagccgctttgtgtgcagcccgactaggggcggcggcgcaaccacctgacagaggcccgggcgctcgatgcaccttccgcccgcatgaggaggagaggccggtagaggactgtgaaccaaaagttgtcccccaggatggacttcaccgcgcagcccaagcctgccactgccctctgtggcgtcgtgagtgccgacgggaagatcgcttaccctccgggggtaaaagagatcaccgacaagatcaccacggacgagatgatcaaacgcctgaagatggtagtgaaaacctttatggatatggatcaggactcagaagatgaaaaacagcagtatctcccactagccttgcatcttgcatctgaattcttcctcaggaaccccaataaagatgtgcgtctccttgtagcatgttgtttggctgatatctttcgtatctatgccccagaagctccatatacttcccatgataaacttaaggacatatttttgtttattaccagacaattaaaaggtttggaggatacaaagagtccacagtttaatagatacttttatttattagagaatttagcttgggttaaatcatataacatctgctttgaattggaagattgcaatgaaatttttattcagctttttagaactctcttctcagtgatcaacaatagccacaataagaaggtacaaatgcacatgctagatttgatgagttctatcatcatggaaggtgatggagttactcaagaattattggactccattcttattaacctcattcctgcacataagaacttaaataaacagtcctttgaccttgcaaaagtgctattgaaaagaacagtccagactattgaggcatgcattgctaattttttcaatcaagtcctggtgctgggaagatcatcagtaagtgatttgtcagaacatgtatttgatctgattcaggaactttttgctatagatcctcatttattattatccgtcatgccacagcttgaattcaaactaaagagcaatgatggagaagagcgattagctgttgttcgacttctagctaaattgtttggctccaaagattctgatttggcaacacagaatcgtcctctttggcaatgttttcttggacgatttaatgatattcatgttcctgtgagattagaaagtgtgaaatttgccagtcattgtttaatgaatcacccagatttagcgaaggatctcacagaatatttaaaggttagatcacatgatccagaagaagctattcgtcatgatgtcattgttactataataacagctgccaagagggacctggccttagtaaatgatcagctgcttggctttgtaagggaaagaacactggataaacggtggcgagtaagaaaagaagctatgatgggtctggctcagctttataagaaatactgtcttcatggtgaagcaggaaaggaagctgcagagaaagtcagctggataaaggacaaacttctgcatatttattatcagaacagcattgacgacaaactgttggtagagaaaatctttgctcagtatcttgtcccccacaacctggaaacagaagagagaatgaaatgcttatattacttatatgctagtttggatccaaatgctgtaaaagctctcaacgaaatgtggaagtgtcagaacatgcttcggagccatgtacgcgaactattggatttgcacaagcagcctacatcagaggctaactgttctgccatgtttggaaaactgatgaccatagcaaagaatttgcctgaccccgggaaagcacaagattttgtgaagaaatttaaccaggttctcggcgatgatgagaaacttcggtctcagttggagttattaattagcccaacctgttcttgcaaacaagcagatatttgtgtggttagtaaatcatacttcacactttttctctagctttacttacagaaatatgtattttattaaagcctgttttacatacagtgatttgtgtaaatgtaacaatattgtgagctctgaattactttggagtatatctattgtcaagttaattctctatttaccattcactctcagccacattccaggaaaataactaaagaactaagccagggagattggtcttaggaattttacaagataaagtactttgaacttagtagacattcattgagtaatgataagtattttctgaatgcttgtgtacatgtgcattttcttctttcatgtattagaatggaaataatcgtcaataaattagtagtagtaacattgcca

SEQ ID NO: 164024 - DNA, 7497 bp, Homo sapiens
  Payload ID: 12295
  Gene Symbol: PDS5B
  Gene Name: PDS5 cohesin associated factor B
  Uniprot ID: Q9NTI5
  ENST ID: ENST00000315596
  CDS Start-End: 187-4530
gagcagccgccgaagagcgcttggcgccattttgaagcggagaggaggaggaacggcagggctggctgcggaaggggagggggggggagaaggcgattggatgcggcggcggcggcggatcccggagagccccggagtgagcggagtagcgagtcggcaacccggaggggtagaaatatttctgtcatggctcattcaaagactaggaccaatgatggaaaaattacatatccgcctggggtcaaggaaatatcagataaaatatctaaagaggagatggtgagacgattaaagatggttgtgaaaacttttatggatatggaccaggactctgaagaagaaaaggagctttatttaaacctagctttacatcttgcttcagatttttttctcaagcatcctgataaagatgttcgcttactggtagcctgctgccttgctgatattttcaggatttatgctcctgaagctccttacacatcccctgataaactaaaggatatatttatgtttataacaagacagttgaaggggctagaggatacaaagagcccacaattcaataggtatttttatttacttgagaacattgcttgggtcaagtcatataacatatgctttgagttagaagatagcaatgaaattttcacccagctatacagaaccttattttcagttataaacaatggccacaatcagaaagtccatatgcacatggtagaccttatgagctctattatttgtgaaggtgatacagtgtctcaggagcttttggatacggttttagtaaatctggtacctgctcataagaatttaaacaagcaagcatatgatttggcaaaggctttactgaagaggacagctcaagctattgagccatatattaccaatttttttaatcaggttctgatgcttgggaaaacatctatcagcgatttgtcagagcatgtctttgacttaattttggagctctacaatattgatagtcatttgctgctctctgttttaccccagcttgaatttaaattaaagagcaatgataatgaggagcgcctacaagttgttaaactactggcaaaaatgtttggggcaaaggattcagaattggcttctcaaaacaagccactttggcagtgctacttgggcaggtttaatgatatccatgtaccaatccgcctggaatgtgtgaaatttgctagccattgtctcatgaaccatcctgatttagcaaaagacttaacagagtatcttaaagtgaggtcacatgaccctgaggaagctattagacatgatgttattgtgtcaatagttacagctgctaaaaaggatattcttctggtcaatgatcacttacttaattttgtgagagagagaacattagacaaacgatggagagtacgcaaagaagccatgatgggacttgcccaaatttataagaaatatgctttacagtcagcagctggaaaagatgctgcaaaacagatagcatggatcaaagacaaattgctacatatatattatcaaaatagtattgatgatcgactacttgttgaacggatctttgctcaatacatggttcctcacaatttagaaactacagaacggatgaaatgcttatattacttgtatgccacactggatttaaatgctgtgaaagcattgaatgaaatgtggaaatgtcaaaatctgctccgacatcaagtaaaggatttgcttgacttgattaagcaacccaaaacagatgccagtgtcaaggccatattttcaaaagtgatggttattacaagaaatttacctgatcctggtaaggctcaggatttcatgaagaaattcacacaggtgttagaagatgatgagaaaataagaaagcagttagaagtacttgttagtccaacatgctcctgcaagcaggctgaaggttgtgtgcgtgaaataactaagaagttgggcaaccccaaacagcctacaaatcctttcctggaaatgatcaagtttctcttggagaggatagcacctgtgcacatagataccgaatctatcagtgctcttattaaacaagtgaacaaatcaatagatggaacagcagatgatgaagatgagggtgttccaactgatcaagccatcagagcaggtcttgaactgcttaaggtactctcatttacacatcccatctcatttcattctgctgaaacatttgaatcattactggcttgtctgaaaatggatgatgaaaaagtagcagaagctgcactacaaattttcaaaaacacaggaagcaaaattgaagaggattttccacacatcagatcagccttgcttcctgttttacatcacaaatctaaaaaaggacccccccgtcaagccaaatatgccattcattgtatccatgcgatattttctagtaaagagacccagtttgcacagatatttgagcctctgcataagagcctagatccaagcaacctggaacatctcataacaccattggttactattggtcatattgctctccttgcacctgatcaatttgctgctcctttgaaatctttggtagctactttcattgtgaaagatcttctcatgaatgatcggcttccagggaaaaagacaactaaactttgggttccagatgaagaagtatctcctgagacaatggtcaaaattcaggctattaaaatgatggttcgatggctacttggaatgaaaaataatcacagtaaatcaggaacttctaccttaagattgctaacaacaatattgcatagtgatggagacttgacagaacaggggaaaattagtaaaccagatatgtcacgtctgagacttgctgctgggagtgctattgtgaagctggcacaagaaccctgttaccatgaaatcatcacattagaacaatatcagctatgtgcattagctatcaacgatgaatgctatcaagtaagacaagtgtttgcccagaaacttcacaaaggcctttcccgtttacggcttccacttgagtatatggcaatctgtgccctttgtgcaaaagatcctgtaaaggagagaagagctcatgctaggcaatgtttggtgaaaaatataaatgtaaggcgggagtatctgaagcagcatgcagctgttagtgaaaaattattgtctcttctaccagagtatgttgttccatatacaattcaccttttggcacatgacccagattatgtcaaagtacaggatattgaacaacttaaagatgttaaagaatgtctttggtttgttctggaaatattaatggctaaaaatgaaaataacagtcacgcttttatcagaaagatggtagaaaatattaaacaaacaaaagatgcccaaggaccagatgatgcaaaaatgaatgaaaaactgtacactgtgtgtgatgttgccatgaatatcatcatgtcaaagagtactacatacagtttggaatctcctaaagacccggtactaccagctcgtttcttcactcaacctgacaagaatttcagtaacaccaaaaattatctgcctcctgaaatgaaatcatttttcactcctggaaaacctaaaacaaccaatgttctaggagctgttaacaagccactttcatcagcaggcaagcaatctcagaccaaatcatcacgaatggaaactgtaagcaatgcaagcagcagctcaaatccaagctctcctggaagaataaaggggaggcttgatagttctgaaatggatcacagtgaaaatgaagattacacaatgtcttcacctttgccggggaaaaaaagtgacaagagagacgactctgatcttgtaaggtctgaattggagaagcctagaggcaggaaaaaaacgcccgtcacagaacaggaggagaaattaggtatggatgacttgactaagttggtacaggaacagaaacctaaaggcagtcagcgaagtcggaaaagaggccatacggcttcagaatctgatgaacagcagtggcctgaggaaaagaggctcaaagaagatatattagaaaatgaagatgaacagaatagtccgccaaaaaagggtaaaagaggccgaccaccaaaacctcttggtggaggtacaccaaaagaagagccaacaatgaaaacttctaaaaaaggaagcaaaaaaaaatctggacctccagcaccagaggaggaggaagaagaagaaagacaaagtggaaatacggaacagaagtccaaaagcaaacagcaccgagtgtcaaggagagcacagcagagagcagaatctcctgaatctagtgcaattgaatccacacagtccacaccacagaaaggacgaggaagaccatcaaaaacgccatcaccatcacaaccaaaaaaaaatgtccgtgtaggacgctccaaacaagcagctactaaggaaaatgattcaagtgaagaagtagatgtgtttcagggtagctctcctgtcgatgatattccacaggaagaaacagaggaggaggaagtttctacagtaaatgtacggcggcgaagtgctaaaagggaacggcgatgaacaaatgtaattaataactttctctgtgaaagctttggaaaaatctttttttttttttttggtcaagcttgaggctgaataaagcctttgatgcacaaaatgggactgctgaagagtggacagttggaccttactttggtgaccccatacatttgtggtcacatgctttagccatacacatggtaacattgactatggagtcttgtgaaagtgtaatgtgcgatggctatgtagacataaagaagaaacttgtaaatatcttttttcttttttttaatgtttctgatttctgaagtgcttgtatagcttttatctgcggctttaaactgacagtacccgactgtttattggatctattgatttgaaaagaatttgttaggatagatcttaagcagtaatctgtcagtgtttgtatttgtattctctgcaattttactgtgaaaaaaaatttgttttcaacaattggtgtcattttcttgatgtcactatttgttggagagttaaatggtctcttccctttgtgtatcttacctagtgtttactcctgggcacccttaatcttcagaggtgctaaattgtctgccattacaccagaaggatgcctctgataggaggacaaccatgcaaattgtgaaatagtcctgaagttcttggattactttacacctcagtattgatttgtcccagaattttctggcctttcatggcaatgaaaattttaagaagaaagatttaaagtattttaattttaaagagtgtgttataaaataatgtactgaattctttatcccattttatcatcctttcagtttttattaatctactgtatcaataaaattctgtaatttgaatgagtttttaatagtctagaatgttattgtgtatagatatttcctcttgaacgttatgttcagaaaatgcaaattacactataatataaaacctgatatatacacattagaaatattccagttctccgtaacagtgtaaagttaatcagaaagaaaaaattttattgatgcagtgtgtctttataaagctgttcttgaaagccaagtgttttgtattttatagtgagttgcatgtttttgaaaaaaagtgctgaaaatgggatgtgctgttttctgtaaattcatatttagccatagtatatgatagattgccccataacatagtttttcatcaagagtttattattgtactttattttggagccaaaaaattgattctggggggtgggggcagcgtagaagtggtatatccaagtatatcagctactgtagttgtcacagtcttgtgaactttgaatgaaattccactttgtccagattgggagaagtggaaatttatttggatttagagcaggtctttttttttcttcattgtaatctgcaaaatgtagaaataaattacttaaggcagtatcctttatacagttgtataaactgtattttgaaccaaaacatataggttactacttaatgcttacctaatttcattttagtattttaggtgctgttatgttttttcatggttaacaccagaggggaaaaaatcatattctaacttattaaatttatcacattgaatagtggaacattttcatatgatacaccattatgtttaagatatatttccaagattggttataatagatggggcatataataaagaagctactattttggaaaatgacattttactatttgccaatgtatattgcaattgatgtgattatttttcttttaaagatttgtttgtgtttatgaaacagccatttattttttaaaaagtgttttgaattgtgtcttaatctctccatattcaactattcttcatttacaacaatagtgacaccagtaattatgagaggctgtcatatatcaaagcagctcaggtgggatcaacatacattggttttgaaatgtttccttagctcggttctcccaaacacataatttctgtttcagcagtacaaaggcatgttttaaaatctataacataaagaataaggaatagctttgtatttttgtcattgattaaattgcaccagaaatgtttatggaaatattaagaacattttataaaacatacgaaaaagtgattgtgaaggatttttatttgcatgattatagttaagcaaatttcatttcacatttttgtaatgctgtacagcagttcacaaaaaaatgttcattgtagattttgttatgttcaatgccaatgagtctgtaattttacgacctgtctgttctttttttgggtggattacgatgtaaatttttcttttctttctttctttttttttttttttgtgtagaaaaataggtgcaataatgatcaaagttttgatgtcttgagtctccatcttaggggattatcttacgtttaagcttaacatttcatgtagtaagatttggagagccacatactttacagtaaaattaagtgtgtataaaacattaattgctaacaattgttagcaaactatttcagtgataatgttcattttgaaaatatgtactgtataacattaagaaaatatttaactccctgtaacaagttccattatgaaaatcttattcctcagtgaggttatcttgctgcactctgtagcaaatttgtttaatctacattataataaaatttcttgctgcagtgcaacaggaggctttttcagtgatcttcactgtatatgtaaattacaaatgtggctgtaaaacttattccaggtattaaaggttaaattgctttctatatcttcttataacttgtaagtctgatttttaagatttccttttgtccacttgtaagaatgtcaggaatttaagaatttgtttaaattaggcatatctctgccatcacatagtattatgtcaccataatgaacaattgctatttaaatagataaccaattttcagacacatttttggatttctgtgaagttgaataaacataaaagctaa

SEQ ID NO: 164025 - DNA, 5246 bp, Homo sapiens
  Payload ID: 12295
  Gene Symbol: PDS5B
  Gene Name: PDS5 cohesin associated factor B
  Uniprot ID: Q9NTI5
  ENST ID: ENST00000450460
  CDS Start-End: 66-4241
ccggagagccccggagtgagcggagtagcgagtcggcaacccggaggggtagaaatatttctgtcatggctcattcaaagactaggaccaatgatggaaaaattacatatccgcctggggtcaaggaaatatcagataaaatatctaaagaggagatggtgagacgattaaagatggttgtgaaaacttttatggatatggaccaggactctgaagaagaaaaggagctttatttaaacctagctttacatcttgcttcagatttttttctcaagcatcctgataaagatgttcgcttactggtagcctgctgccttgctgatattttcaggatttatgctcctgaagctccttacacatcccctgataaactaaaggatatatttatgtttataacaagacagttgaaggggctagaggatacaaagagcccacaattcaataggtatttttatttacttgagaacattgcttgggtcaagtcatataacatatgctttgagttagaagatagcaatgaaattttcacccagctatacagaaccttattttcagttataaacaatggccacaatcagaaagtccatatgcacatggtagaccttatgagctctattatttgtgaaggtgatacagtgtctcaggagcttttggatacggttttagtaaatctggtacctgctcataagaatttaaacaagcaagcatatgatttggcaaaggctttactgaagaggacagctcaagctattgagccatatattaccaatttttttaatcaggttctgatgcttgggaaaacatctatcagcgatttgtcagagcatgtctttgacttaattttggagctctacaatattgatagtcatttgctgctctctgttttaccccagcttgaatttaaattaaagagcaatgataatgaggagcgcctacaagttgttaaactactggcaaaaatgtttggggcaaaggattcagaattggcttctcaaaacaagccactttggcagtgctacttgggcaggtttaatgatatccatgtaccaatccgcctggaatgtgtgaaatttgctagccattgtctcatgaaccatcctgatttagcaaaagacttaacagagtatcttaaagtgaggtcacatgaccctgaggaagctattagacatgatgttattgtgtcaatagttacagctgctaaaaaggatattcttctggtcaatgatcacttacttaattttgtgagagagagaacattagacaaacgatggagagtacgcaaagaagccatgatgggacttgcccaaatttataagaaatatgctttacagtcagcagctggaaaagatgctgcaaaacagatagcatggatcaaagacaaattgctacatatatattatcaaaatagtattgatgatcgactacttgttgaacggatctttgctcaatacatggttcctcacaatttagaaactacagaacggatgaaatgcttatattacttgtatgccacactggatttaaatgctgtgaaagcattgaatgaaatgtggaaatgtcaaaatctgctccgacatcaagtaaaggatttgcttgacttgattaagcaacccaaaacagatgccagtgtcaaggccatattttcaaaagtgatggttattacaagaaatttacctgatcctggtaaggctcaggatttcatgaagaaattcacacaggtgttagaagatgatgagaaaataagaaagcagttagaagtacttgttagtccaacatgctcctgcaagcaggctgaaggttgtgtgcgtgaaataactaagaagttgggcaaccccaaacagcctacaaatcctttcctggaaatgatcaagtttctcttggagaggatagcacctgtgcacatagataccgaatctatcagtgctcttattaaacaagtgaacaaatcaatagatggaacagcagatgatgaagatgagggtgttccaactgatcaagccatcagagcaggtcttgaactgcttaaggtactctcatttacacatcccatctcatttcattctgctgaaacatttgaatcattactggcttgtctgaaaatggatgatgaaaaagtagcagaagctgcactacaaattttcaaaaacacaggaagcaaaattgaagaggattttccacacatcagatcagccttgcttcctgttttacatcacaaatctaaaaaaggacccccccgtcaagccaaatatgccattcattgtatccatgcgatattttctagtaaagagacccagtttgcacagatatttgagcctctgcataagagcctagatccaagcaacctggaacatctcataacaccattggttactattggtcatattgctctccttgcacctgatcaatttgctgctcctttgaaatctttggtagctactttcattgtgaaagatcttctcatgaatgatcggcttccagggaaaaagacaactaaactttgggttccagatgaagaagtatctcctgagacaatggtcaaaattcaggctattaaaatgatggttcgatggctacttggaatgaaaaataatcacagtaaatcaggaacttctaccttaagattgctaacaacaatattgcatagtgatggagacttgacagaacaggggaaaattagtaaaccagatatgtcacgtctgagacttgctgctgggagtgctattgtgaagctggcacaagaaccctgttaccatgaaatcatcacattagaacaatatcagctatgtgcattagctatcaacgatgaatgctatcaagtaagacaagtgtttgcccagaaacttcacaaaggcctttcccgtttacggcttccacttgagtatatggcaatctgtgccctttgtgcaaaagatcctgtaaaggagagaagagctcatgctaggcaatgtttggtgaaaaatataaatgtaaggcgggagtatctgaagcagcatgcagctgttagtgaaaaattattgtctcttctaccagagtatgttgttccatatacaattcaccttttggcacatgacccagattatgtcaaagtacaggatattgaacaacttaaagatgttaaagaatgtctttggtttgttctggaaatattaatggctaaaaatgaaaataacagtcacgcttttatcagaaagatggtagaaaatattaaacaaacaaaagatgcccaaggaccagatgatgcaaaaatgaatgaaaaactgtacactgtgtgtgatgttgccatgaatatcatcatgtcaaagagtactacatacagtttggaatctcctaaagacccggtactaccagctcgtttcttcactcaacctgacaagaatttcagtaacaccaaaaattatctgcctcctgaaatgaaatcatttttcactcctggaaaacctaaaacaaccaatgttctaggagctgttaacaagccactttcatcagcaggcaagcaatctcagaccaaatcatcacgaatggaaactgtaagcaatgcaagcagcagctcaaatccaagctctcctggaagaataaaggggaggcttgatagttctgaaatggatcacagtgaaaatgaagattacacaatgtcttcacctttgccggggaaaaaaagtgacaagagagacgactctgatcttgtaaggtctgaattggagaagcctagaggcaggaaaaaaacgcccgtcacagaacaggaggagaaattaggtatggatgacttgactaagttggtacaggaacagaaacctaaaggcagtcagcgaagtcggaaaagaggccatacggcttcagaatctgatgaacagcagtggcctgaggaaaagaggctcaaagaagatatattagaaaatgaagatgaacagaatagtccgccaaaaaagggtaaaagaggccgaccaccaaaacctcttggtggaggtacaccaaaagaagagccaacaatgaaaacttctaaaaaaggaagcaaaaaaaaatctggacctccagcaccagaggaggaggaagaagaagaaagacaaagtggaaatacggaacagaagtccaaaagcaaacagcaccgagtgtcaaggagagcacagcagagagcagaatctcctgaatctagtgcaattgaatccacacagtccacaccacagaaaggacgaggaagaccatcaaaaacgccatcaccatcacaaccaaaaaaaaatgtgtaagttgtaaatattacatttcaaaccaatttcaaattattttgcaaaagttcctaaatttgtaaacatacatattgctgtatttaaattccatatatttagccccattacactaggtacggcggcgaagtgctaaaagggaacggcgatgaacaaatgtaattaataactttctctgtgaaagctttggaaaaatctttttttttttttttggtcaagcttgaggctgaataaagcctttgatgcacaaaatgggactgctgaagagtggacagttggaccttactttggtgaccccatacatttgtggtcacatgctttagccatacacatggtaacattgactatggagtcttgtgaaagtgtaatgtgcgatggctatgtagacataaagaagaaacttgtaaatatcttttttcttttttttaatgtttctgatttctgaagtgcttgtatagcttttatctgcggctttaaactgacagtacccgactgtttattggatctattgatttgaaaagaatttgttaggatagatcttaagcagtaatctgtcagtgtttgtatttgtattctctgcaattttactgtgaaaaaaaatttgttttcaacaattggtgtcattttcttgatgtcactatttgttggagagttaaatggtctcttccctttgtgtatcttacctagtgtttactcctgggcacccttaatcttcagaggtgctaaattgtctgccattacaccagaaggatgcctctgataggaggacaaccatgcaaattgtgaaatagtcctgaagttcttggattactttacacctcagtattgatttgtcccagaattttctggcctttcatggcaatgaaaattttaagaagaaagatttaaagtattttaattttaaagagtgtgttataaaataatgtactgaattctttatcccattttatcatcctttcagtttttattaatctactgtatcaataaaattctgtaatttgaatgagt

SEQ ID NO: 164026 - DNA, 906 bp, Homo sapiens
  Payload ID: 12295
  Gene Symbol: PDS5B
  Gene Name: PDS5 cohesin associated factor B
  ENST ID: ENST00000447833
  CDS Start-End: 1-906
attaaacaaacaaaagatgcccaaggaccagatgatgcaaaaatgaatgaaaaactgtacactgtgtgtgatgttgccatgaatatcatcatgtcaaagagtactacatacagtttggaatctcctaaagacccggtactaccagctcgtttcttcactcaacctgacaagaatttcagtaacaccaaaaattatctgcctcctgaaatgaaatcatttttcactcctggaaaacctaaaacaaccaatgttctaggagctgttaacaagccactttcatcagcaggcaagcaatctcagaccaaatcatcacgaatggaaactgtaagcaatgcaagcagcagctcaaatccaagctctcctggaagaataaaggggaggcttgatagttctgaaatggatcacagtgaaaatgaagattacacaatgtcttcacctttgccggggaaaaaaagtgacaagagagacgactctgatctttctgaattggagaagcctagaggcaggaaaaaaacgcccgtcacagaacaggaggagaaattaggtatggatgacttgactaagttggtacaggaacagaaacctaaaggcagtcagcgaagtcggaaaagaggccatacggcttcagaatctgatgaacagcagtggcctgaggaaaagaggctcaaagaagatatattagaaaatgaagatgaacagaatagtccgccaaaaaagggtaaaagaggccgaccaccaaaacctcttggtggaggtacaccaaaagaagagccaacaatgaaaacttctaaaaaaggaagcaaaaaaaaatctggacctccagcaccagaggaggaggaagaagaagaaagacaaagtggaaatacggaacagaagtccaaaagcaaacagcaccgagtgtcaagg

SEQ ID NO: 164027 - DNA, 2747 bp, Homo sapiens
  Payload ID: 12296
  Gene Symbol: PCIF1
  Gene Name: PDX1 C-terminal inhibiting factor 1
  Uniprot ID: Q9H4Z3
  ENST ID: ENST00000372409
  CDS Start-End: 365-2479
atggcggcgcggccgcggcgaggtccctcagaggcggtaccagcgcatgcgcagcgcggagtcccggcccgggacacaagatggcggcagcggcgctggggagggcgaggcggaggcggcaaaacgggcggtcgagcagaacgtgtagccgcgtcccctccagtccgctccgggcagctgctgatgcaaggaatcccctgggctcccgtccactccactgctgaccagcccattcgcctgtgctgagtcttcctgcaggcctttccttgcctctgtgggaccctgtgggggtccatccggctggagaagaaaagcctctcatgctaacgttgcagaccccagagggtcctgtgtgggtgtggagatggccaatgagaatcacggcagcccccgggaggaagcgtccctgctgagtcactccccaggtacctccaatcagagccagccctgttctccaaagccaatccgcctggttcaggacctcccagaggagctggtgcatgcaggctgggagaagtgctggagccggagggagaatcgtccctactacttcaaccgattcaccaaccagtccctgtgggagatgcccgtgctggggcagcacgatgtgatttcggaccctttggggctgaatgcgaccccactgccccaagactcaagcttggtggaaactcccccggctgagaacaagcccagaaagcggcagctctcggaagagcagccaagcggcaatggtgtgaagaagcccaagattgaaatcccagtgacacccacaggccagtcggtgcccagctcccccagtatcccaggaaccccaacgctgaagatgtggggtacgtcccctgaagataaacagcaggcagctctcctacgacccactgaggtctactgggacctggacatccagaccaatgctgtcatcaagcaccgggggccttcagaggtgctgcccccgcatcccgaagtggaactgctccgctctcagctcatcctgaagcttcggcagcactatcgggagctgtgccagcagcgagagggcattgagcctccacgggagtctttcaaccgctggatgctggagcgcaaggtggtagacaaaggatctgaccccctgttgcccagcaactgtgaaccagtcgtgtcaccttccatgtttcgtgaaatcatgaacgacattcctatcaggttatcccgaatcaagttccgggaggaagccaagcgcctgctctttaaatatgcggaggccgccaggcggctcatcgagtccaggagtgcatcccctgacagtaggaaggtggtcaaatggaatgtggaagacacctttagctggcttcggaaggaccactcagcctccaaggaggactacatggatcgcctggagcatctgcggaggcagtgtggcccccacgtctcggccgcagccaaggactccgtggaaggcatctgcagtaagatctaccacatctccctggagtacgtcaaacggatccgagagaagcaccttgccatcctcaaggaaaacaacatctcagaggaggtggaggcccctgaggtggagccccgcctagtgtactgctacccagtccggctggctgtgtctgcaccgcccatgcccagcgtggagatgcacatggagaacaacgtggtctgcatccggtataagggagagatggtcaaggtcagccgcaactacttcagcaagctgtggctcctttaccgctacagctgcattgatgactctgcctttgagaggttcctgccccgggtctggtgtcttctccgacggtaccagatgatgttcggcgtgggcctctacgaggggactggcctgcagggatcgctgcctgtgcatgtctttgaggccctccaccgactctttggcgtcagcttcgagtgcttcgcctcacccctcaactgctacttccgccagtactgttctgccttccccgacacagacggctactttggctcccgcgggccctgcctagactttgctccactgagtggttcatttgaggccaaccctcccttctgcgaggagctcatggatgccatggtctctcactttgagagactgcttgagagctcaccggagcccctgtccttcatcgtgttcatccctgagtggcgggaacccccaacaccagcgctcacccgcatggagcagagccgcttcaaacgccaccagttgatcctgcctgcctttgagcatgagtaccgcagtggctcccagcacatctgcaagaaggaggaaatgcactacaaggccgtccacaacacggctgtgctcttcctacagaacgaccctggctttgccaagtgggcgccgacgcctgaacggctgcaggagctgagtgctgcctaccggcagtcaggccgcagccacagctctggttcttcctcatcgtcctcctcggaggccaaggaccgggactcgggccgtgagcagggtcctagccgcgagcctcaccccacttaacatatcctgcggggaggaggagccccaggggtgctagtctggactgctgggactcgggcccctggggcctcagagggaccccggctgccactgacatatgaagattatggttctgccagggctcccctccctgcctgtccccaagtcctcacctcaaactccctccaagtcccatgtatataggtcctgatgccttcccaaccccgcccctcaccctgttgccaccttgtttcatttgtaaaaggaaatacagaaacccccccaagaa

SEQ ID NO: 164028 - DNA, 1324 bp, Homo sapiens
  Payload ID: 12296
  Gene Symbol: PCIF1
  Gene Name: PDX1 C-terminal inhibiting factor 1
  ENST ID: ENST00000479348
  CDS Start-End: 1-914
tcctcaaggaaaacaacatctcagaggaggtggaggcccctgaggtggagccccgcctagtgtactgctacccagtccggctggctgtgtctgcaccgcccatgcccagcgtggagatgcacatggagaacaacgtggtctgcatccggtataagggagagatggtcaaggtcagccgcaactacttcagcaagctgtggctcctttaccgctacagctgcattgatgactctgcctttgagaggttcctgccccgggtctggtgtcttctccgacggtaccagatgatgttcggcgtgggcctctacgaggggactggcctgcagggatcgctgcctgtgcatgtctttgaggccctccaccgactctttggcgtcagcttcgagtgcttcgcctcacccctcaactgctacttccgccagtactgttctgccttccccgacacagacggctactttggctcccgcgggccctgcctagactttgctccactgagtggttcatttgaggccaaccctcccttctgcgaggagctcatggatgccatggtctctcactttgagagactgcttgagagctcaccggagcccctgtccttcatcgtgttcatccctgagtggcgggaacccccaacaccagcgctcacccgcatggagcagagccgcttcaaacgccaccagttgatcctgcctgcctttgagcatgagtaccgcagtggctcccagcacatctgcaagaagtgggtgccagggagggcaggggaaggaggctgggctggccaggccaggcccagccccaccctgagccattgcctttgcccgcagggaggaaatgcactacaaggccgtccacaacacggctgtgctcttcctacagaacgaccctggctttgccaagtgggcgccgacgcctgaacggctgcaggagctgagtgctgcctaccggcagtcaggccgcagccacagctctggttcttcctcatcgtcctcctcggaggccaaggaccgggactcgggccgtgagcagggtcctagccgcgagcctcaccccacttaacatatcctgcggggaggaggagccccaggggtgctagtctggactgctgggactcgggcccctggggcctcagagggaccccggctgccactgacatatgaagattatggttctgccagggctcccctccctgcctgtccccaagtcctcacctcaaactccctccaagtcccatgtatataggtcctgatgccttcccaaccccgcccctcaccctgttgccaccttgtttcatttgtaaaaggaaatacagaaacccccccaagaa

SEQ ID NO: 164029 - DNA, 1452 bp, Homo sapiens
  Payload ID: 12297
  Gene Symbol: PDLIM1
  Gene Name: PDZ and LIM domain 1
  Uniprot ID: O00151
  ENST ID: ENST00000329399
  CDS Start-End: 110-1099
gcccgcgccgcgccgctctttctccgacagccgccgggggtgccctgcaagctgttccgcgcgtcctgcccgtctgtccccgcgggtcgtcgcccgccacagccgcgccatgaccacccagcagatagacctccagggcccggggccgtggggcttccgcctcgtgggcggcaaggacttcgagcagcctctcgccatttcccgggtcactcctggaagcaaggcggctctagctaatttatgtattggagatgtaatcacagccattgatggggaaaatactagcaatatgacacacttggaagctcagaacagaatcaaaggctgcacagacaacttgactctcactgtagccagatctgaacataaagtctggtctcctctggtgacggaggaagggaagcgtcatccatacaagatgaatttagcctctgaaccccaggaggtcctgcacataggaagcgcccacaaccgaagtgccatgccctttaccgcctcgcctgcctccagcactactgccagggtcatcacaaaccagtacaacaacccagctggcctctactcttctgaaaatatctccaacttcaacaatgccctggagtcaaagactgctgccagcggggtggaggcgaacagcagacccttagaccatgctcagcctccaagcagccttgtcatcgacaaagaatctgaagtttacaagatgcttcaggagaaacaggagttgaatgagcccccgaaacagtccacgtctttcttggttttgcaggaaatcctggagtctgaagaaaaaggggatcccaacaagccctcaggattcagaagtgttaaagctcctgtcactaaagtggctgcgtcgattggaaatgctcagaagttgcctatgtgtgacaaatgtggcactgggattgttggtgtgtttgtgaagctgcgggaccgtcaccgccaccctgagtgttatgtgtgcactgactgtggcaccaacctgaaacagaagggccatttctttgtggaggatcaaatctactgtgagaagcatgcccgggagcgagtcacaccacctgagggttatgaagtggtcactgtgttccccaagtgagccagcagatctgaccactgttctccagcaggcctctgctgcagctttttctctcagtgttctggccctctcctctcttgaaagttctctgcttactttggttttccctctgcttgtaaaacattgagtcccctccctgccttggttaattgactcacaccagctgtgcgatgcccgcttttacaattaaaggaaaactgttttgttcagtgtcaccttgtcagcaacactgtgtcccttcgccccaccgttcttctctgctgcatttggacatcagccaaatttgaacccaatcaaatataacgtgtctgacactgattttgtttttactcaataaatgtatagactacaaa

SEQ ID NO: 164030 - DNA, 4592 bp, Homo sapiens
  Payload ID: 12298
  Gene Symbol: PDLIM2
  Gene Name: PDZ and LIM domain 2 (mystique)
  Uniprot ID: Q96JY6
  ENST ID: ENST00000265810
  CDS Start-End: 116-1216
ccgggagctgtggtgccctctccttctccctttggctcctctcctgctgccttacagtgcccccagagccggctaggggcatggacttcacctcctggtcctctcttcctcaggtatggcgttgacggtggatgtggccgggccagcgccctggggcttccgtatcacagggggcagggatttccacacgcccatcatggtgactaaggtggccgagcggggcaaagccaaggacgctgacctccggcctggagacataatcgtggccatcaacggggaaagcgcggagggcatgctgcatgccgaggcccagagcaagatccgccagagcccctcgcccctgcggctgcagctggaccggtctcaggctacgtctccagggcagaccaatggggacagctccttggaagtgctggcgactcgcttccagggctccgtgaggacatacactgagagtcagtcctccttaaggtcctcctactccagcccaacctccctcagcccgagggccggcagccccttctcaccaccaccctctagcagctccctcactggagaggcagccatcagccgcagcttccagagtctggcatgttccccgggcctccccgctgctgaccgcctgtcctactcaggccgccctggaagccgacaggccggcctcggccgcgctggcgactcggcggtgctggtgctgccgccttccccgggccctcgttcctccaggcccagcatggactcggaagggggaagcctcctcctggacgaggactcggaagtcttcaagatgctgcaggaaaatcgcgagggacgggcggccccccgacagtccagctcctttcggctcttgcaggaagccctggaggctgaggagagaggtggcacgccagccttcttgcccagctcactgagcccccagtcctccctgcccgcctccagggccctggccacccctcccaagctccacacttgtgagaagtgcagtaccagcatcgcgaaccaggctgtgcgcatccaggagggccggtaccgccaccccggctgctacacctgtgccgactgtgggctgaacctgaagatgcgcgggcacttctgggaggacgcttgtgctatggagggaatgagattgtcactggaagctttggaggggatggtggagggcgccaagcggagggacaggaggaagaccaggagacccatccagccaagctggtgagacaacctctgatcctgaggaccggccgcccaccaagggttgggcccccggggccaggttgatctaccgacaccttccacttctttcctgggagagactgctggcttcattggtgattgatttggaggggggaaaaagggcagggtggctcaggctttaggcccaggtactggggaggcctgaggagccctcctggagctcaggaggccgaggctgccttaagctgtgatcatgccactgcattccagcctgggagagagagaggacctgtctgttgaaaaaaacacaaaaacaaatgaatgcatgtggccagtgccaggtgagctgccctgggggttcactggagttgaggcaggggacagtagtctcccctgccagcctaggattttgggcgtcattcacccactacccctagtgctagtcccagaggatgctgcggagggggcagcctcagctctcttttcagagaagatcaaagctgggcttcccagggtgcctggctggtccctgccggcagctttgtgctctccggctctttgtgaaaggaatcttggcgcagatgtttgtgttgcctcctcaggcacctgtagatataatttacaccatgatatcattgtctcaccttttgcctgggtggctgcctgagaaaggtctttctttttatagaaaagatcaaggctgtctggcgcgggactccatgagccccaggcgctggtcagaaacggggtagtctctttggcgccacctagtgtccagtttggcccatggcggggcccattcacggggcaacactgggcttctgggcacagcgggaatacagaaagatacagcactcctcatgccttcctggaggtagaaggccagtggcagcgactgagctggcatgaatgaataagaggatgtggcactgagcgccaagggctaccttggaacgcaccgaggagcgtcccgtgagttcaaagcagtggccgtgatgcaaaaggagggctgggtcttggagacgtggagaagaggaatgctgagtgatggggtggctgctggggggatgcttagctcagagcagtggctgatggggacactgagataagatcggaggggagctgtcaatgccagaagtggtttgaacttccccttgaggctctagggacattttgttttgagacatggtcttgctctattgcccaggctggagtgcagtggtacaatcttagctcactgcagcctccacctcccaggctcaagagatcctcccacagcctcccaggtagctgggactacaggcgtgcaccaccacacccagctaatttttaagtttttttttttttttaagagatggggtctcactatgttgcccaggctggtctcgaacttcgggccccaagccatcctcccaccttggctttccaaagtgttgggattacaagcgtgagctaaccttgcccagcctctgggaacacttggaaggttttaagcagagaagtgacaggttggaaaagatggtttggattattgatatggacagattcccacctgtatgtagcacgccatgctgggccagcagtgtcataggagtggagggggataagtggggactggggacatgtgaaatgatgggcattccagtgaggcatcgaatgccttctgagggctttgtaggttccagctcaaatccccctctggctcttgttctttggtgtggcagccatctctcctcccaggggtcctgagggtttcagcaccagggttctctgcagccacacaatcagcccggctcgggagcaaactcccctggaagaacggagttatgagttggtcagcagaggaggctggggacaggcagtttttggtcttttacctctgatcttgtccccaacctaagccagctagctgcgtgctcccactccctctgccgcacgccgcccgtctatgttcccggactttgtccagtgcagtgccctcttcccttcctgcactgaggagattaactgaagtgacagattagagttagaagtggcccaaaggagcatctggtacaaccccctttggttagagaagggaaagtgacttttccaaagctgcacagctagacagtcataatggctaagctctgggggtgcttttgatgtgctagggatacttccaatgctttaactcacttaatcctcacaacccgagataggtactgttaccatcctctctgcagacgaggaaaccgaggaccaggaggttcagtaaatggtccaagtactcctagctagtaaggaatggatctacagcctgcctcccaggtttctggcttgtggggggcagagtttgtccctctgtcatcagaggcagccttccaggcacagctctggtcacctctggtcacaactggaggtcaccacagccctccccagcgctctgtaggctctcagctttgtgcttcctcccacgggtactagctccagctgagcttgcaggaaacccacttcctgaagccaggacttccccatgggaagtgcaggggccactgggcagcctgagggctgaccctgctcaggacactgtctgtctcaggaactcatggcagtggtttaccttgtcaggagtgcatggacgggctgcccctcccattccttcaagcatcactcagagagccctggcctggctctaggcttgggactgcggctgccacaggaagggggcatccccctactttgggtgttgggtcagatcctgcccccgtgcccgccagggctcaggttcctctgagctggtcctgggccaggacgcatctgcatggcggtggtggggaggaggggtgcgccatggcctggaggggagtgtgtgttggggtgtgtgtgtggaggttcttttgagtcacacacaaagcattgtgctgagacactgcattcctgctggctgggcttcctgtttccagatgcattcctgtcccagagtcaccacagagactgtttggaatcccgccccacattctccaaattcagggcgcgatctggcaaaggctccctcccccaccctcttactttggagggagtctgggctccctcctacccagggagggctggcagggctctggcacggccggggtgtgattccacacatcttcttggtcttgcataaggcagttcctggagacccagcactctggttctctctctgcctgtgagaagcggaatgggtactgtctaggaggactgggcagggtgggggcaacccagaggacccatggctagcagggaagggcctgggcttgaatgtgactctgttgagacatggccagcaattctggcacttggctgtcattcggctggcctgcgcagagattggctgtgggcctcagtttccccattttataaagttttaaaatctg

SEQ ID NO: 164031 - DNA, 2236 bp, Homo sapiens
  Payload ID: 12298
  Gene Symbol: PDLIM2
  Gene Name: PDZ and LIM domain 2 (mystique)
  Uniprot ID: Q96JY6
  ENST ID: ENST00000308354
  CDS Start-End: 40-1848
agacacacccaggcagcccaccctgcccaggacctggggatgcggggcgggagagcgcggccggcgtgggagagctttatggggctgccccctcgatcgtctgcgaagtggggcgcggggcagtccctggaccggctctgctgtgctccgggcagtcgggggcttgcgggcgctccggggaggatgcgggcaccaccggctggacggtcgcagcctgcagggggccctggggacagcctgcctcatccccccggcgggctcgggccaggtggcagcgcctgggctcgccgcgcggaggcggcggcttctcgggctaggggcggcggcaggggcggccccgggatcacatgggcggaggcaggtccgggagccccgggcgggctctccccagagtcgggtagacggcagcgggagcggtggcgtctccccgccttccctccctcccgggcctgggcgcccagccggacaggtgagcggcagccaggtgagcgcgcccacctgcgcctctccgcgcggcccgccctccccggcgccgggctcctctccgcgcccctgtcggcgcggaaccctggcctcgtccgcggcccagctccctggagcctcgcatcagcgggggcgcccccgcgagctgcgctctccccggccggagcgctcctcctccagcccccagcccgcagggtactttgccctcggagcgaaggaggctccagaactggtagagccgggccatcgggctgggcacctccccgcggcgcccgcagcgcggagtccactgaccggctcaaaggtatggcgttgacggtggatgtggccgggccagcgccctggggcttccgtatcacagggggcagggatttccacacgcccatcatggtgactaaggtggccgagcggggcaaagccaaggacgctgacctccggcctggagacataatcgtggccatcaacggggaaagcgcggagggcatgctgcatgccgaggcccagagcaagatccgccagagcccctcgcccctgcggctgcagctggaccggtctcaggctacgtctccagggcagaccaatggggacagctccttggaagtgctggcgactcgcttccagggctccgtgaggacatacactgagagtcagtcctccttaaggtcctcctactccagcccaacctccctcagcccgagggccggcagccccttctcaccaccaccctctagcagctccctcactggagaggcagccatcagccgcagcttccagagtctggcatgttccccgggcctccccgctgctgaccgcctgtcctactcaggccgccctggaagccgacaggccggcctcggccgcgctggcgactcggcggtgctggtgctgccgccttccccgggccctcgttcctccaggcccagcatggactcggaagggggaagcctcctcctggacgaggactcggaagtcttcaagatgctgcaggaaaatcgcgagggacgggcggccccccgacagtccagctcctttcggctcttgcaggaagccctggaggctgaggagagaggtggcacgccagccttcttgcccagctcactgagcccccagtcctccctgcccgcctccagggccctggccacccctcccaagctccacacttgtgagaagtgcagtaccagcatcgcgaaccaggctgtgcgcatccaggagggccggtaccgccaccccggctgctacacctgtgccgactgtgggctgaacctgaagatgcgcgggcacttctgggtgggtgacgagctgtactgtgagaagcatgcccgccagcgctactccgcacctgccaccctcagctctcgggcctgagcccgccatgccctcagcctgcctcactgctgggccagggtcatgcctatataagttggcatggcagggacaatggtgggcagttgctcttacatgagctaagtttggagacctgaggcccctttgtcctcgctgggtgggccaaggtctgggacctgtcttggactgtgggagactcaccctcaccttgccaggcctctcccctgcaggactggcattgcactagtctgaggtggccactgcctttgatcaacctttgtgtgcgagggtctaagtagggtcgaacacagaagtgggaaggagaggggtgggccaggggctaatggtgtcactgtgtaaagtttttgacatactagctctataaatatatgaatatggacaaaataaa

SEQ ID NO: 164032 - DNA, 2226 bp, Homo sapiens
  Payload ID: 12298
  Gene Symbol: PDLIM2
  Gene Name: PDZ and LIM domain 2 (mystique)
  Uniprot ID: Q96JY6
  ENST ID: ENST00000339162
  CDS Start-End: 40-1848
agacacacccaggcagcccaccctgcccaggacctggggatgcggggcgggagagcgcggccggcgtgggagagctttatggggctgccccctcgatcgtctgcgaagtggggcgcggggcagtccctggaccggctctgctgtgctccgggcagtcgggggcttgcgggcgctccggggaggatgcgggcaccaccggctggacggtcgcagcctgcagggggccctggggacagcctgcctcatccccccggcgggctcgggccaggtggcagcgcctgggctcgccgcgcggaggcggcggcttctcgggctaggggcggcggcaggggcggccccgggatcacatgggcggaggcaggtccgggagccccgggcgggctctccccagagtcgggtagacggcagcgggagcggtggcgtctccccgccttccctccctcccgggcctgggcgcccagccggacaggtgagcggcagccaggtgagcgcgcccacctgcgcctctccgcgcggcccgccctccccggcgccgggctcctctccgcgcccctgtcggcgcggaaccctggcctcgtccgcggcccagctccctggagcctcgcatcagcgggggcgcccccgcgagctgcgctctccccggccggagcgctcctcctccagcccccagcccgcagggtactttgccctcggagcgaaggaggctccagaactggtagagccgggccatcgggctgggcacctccccgcggcgcccgcagcgcggagtccactgaccggctcaaaggtatggcgttgacggtggatgtggccgggccagcgccctggggcttccgtatcacagggggcagggatttccacacgcccatcatggtgactaaggtggccgagcggggcaaagccaaggacgctgacctccggcctggagacataatcgtggccatcaacggggaaagcgcggagggcatgctgcatgccgaggcccagagcaagatccgccagagcccctcgcccctgcggctgcagctggaccggtctcaggctacgtctccagggcagaccaatggggacagctccttggaagtgctggcgactcgcttccagggctccgtgaggacatacactgagagtcagtcctccttaaggtcctcctactccagcccaacctccctcagcccgagggccggcagccccttctcaccaccaccctctagcagctccctcactggagaggcagccatcagccgcagcttccagagtctggcatgttccccgggcctccccgctgctgaccgcctgtcctactcaggccgccctggaagccgacaggccggcctcggccgcgctggcgactcggcggtgctggtgctgccgccttccccgggccctcgttcctccaggcccagcatggactcggaagggggaagcctcctcctggacgaggactcggaagtcttcaagatgctgcaggaaaatcgcgagggacgggcggccccccgacagtccagctcctttcggctcttgcaggaagccctggaggctgaggagagaggtggcacgccagccttcttgcccagctcactgagcccccagtcctccctgcccgcctccagggccctggccacccctcccaagctccacacttgtgagaagtgcagtaccagcatcgcgaaccaggctgtgcgcatccaggagggccggtaccgccaccccggctgctacacctgtgccgactgtgggctgaacctgaagatgcgcgggcacttctgggtgggtgacgagctgtactgtgagaagcatgcccgccagcgctactccgcacctgccaccctcagctctcgggcctgagcccgccatgccctcagcctgcctcactgctgggccagggtcatgcctatataagttggcatggcagggacaatggtgggcagttgctcttacatgagctaagtttggagacctgaggcccctttgtcctcgctgggtgggccaaggtctgggacctgtcttggactgtgggagactcaccctcaccttgccaggcctctcccctgcaggactggcattgcactagtctgaggtggccactgcctttgatcaacctttgtgtgcgagggtctaagtagggtcgaacacagaagtgggaaggagaggggtgggccaggggctaatggtgtcactgtgtaaagtttttgacatactagctctataaatatatgaatatgg

SEQ ID NO: 164033 - DNA, 1847 bp, Homo sapiens
  Payload ID: 12298
  Gene Symbol: PDLIM2
  Gene Name: PDZ and LIM domain 2 (mystique)
  Uniprot ID: Q96JY6
  ENST ID: ENST00000397760
  CDS Start-End: 401-1459
agagtcgggtagacggcagcgggagcggtggcgtctccccgccttccctccctcccgggcctgggcgcccagccggacaggtgagcggcagccaggtgagcgcgcccacctgcgcctctccgcgcggcccgccctccccggcgccgggctcctctccgcgcccctgtcggcgcggaaccctggcctcgtccgcggcccagctccctggagcctcgcatcagcgggggcgcccccgcgagctgcgctctccccggccggagcgctcctcctccagcccccagcccgcagggtactttgccctcggagcgaaggaggctccagaactggtagagccgggccatcgggctgggcacctccccgcggcgcccgcagcgcggagtccactgaccggctcaaaggtatggcgttgacggtggatgtggccgggccagcgccctggggcttccgtatcacagggggcagggatttccacacgcccatcatggtgactaaggtggccgagcggggcaaagccaaggacgctgacctccggcctggagacataatcgtggccatcaacggggaaagcgcggagggcatgctgcatgccgaggcccagagcaagatccgccagagcccctcgcccctgcggctgcagctggaccggtctcaggctacgtctccagggcagaccaatggggacagctccttggaagtgctggcgactcgcttccagggctccgtgaggacatacactgagagtcagtcctccttaaggtcctcctactccagcccaacctccctcagcccgagggccggcagccccttctcaccaccaccctctagcagctccctcactggagaggcagccatcagccgcagcttccagagtctggcatgttccccgggcctccccgctgctgaccgcctgtcctactcaggccgccctggaagccgacaggccggcctcggccgcgctggcgactcggcggtgctggtgctgccgccttccccgggccctcgttcctccaggcccagcatggactcggaagggggaagcctcctcctggacgaggactcggaagtcttcaagatgctgcaggaaaatcgcgagggacgggcggccccccgacagtccagctcctttcggctcttgcaggaagccctggaggctgaggagagaggtggcacgccagccttcttgcccagctcactgagcccccagtcctccctgcccgcctccagggccctggccacccctcccaagctccacacttgtgagaagtgcagtaccagcatcgcgaaccaggctgtgcgcatccaggagggccggtaccgccaccccggctgctacacctgtgccgactgtgggctgaacctgaagatgcgcgggcacttctgggtgggtgacgagctgtactgtgagaagcatgcccgccagcgctactccgcacctgccaccctcagctctcgggcctgagcccgccatgccctcagcctgcctcactgctgggccagggtcatgcctatataagttggcatggcagggacaatggtgggcagttgctcttacatgagctaagtttggagacctgaggcccctttgtcctcgctgggtgggccaaggtctgggacctgtcttggactgtgggagactcaccctcaccttgccaggcctctcccctgcaggactggcattgcactagtctgaggtggccactgcctttgatcaacctttgtgtgcgagggtctaagtagggtcgaacacagaagtgggaaggagaggggtgggccaggggctaatggtgtcactgtgtaaagtttttgacatactagctctataaatatatgaatatggacaaaataaa

SEQ ID NO: 164034 - DNA, 1491 bp, Homo sapiens
  Payload ID: 12298
  Gene Symbol: PDLIM2
  Gene Name: PDZ and LIM domain 2 (mystique)
  Uniprot ID: Q96JY6
  ENST ID: ENST00000397761
  CDS Start-End: 78-1136
gggagcggtggcgtctccccgccttccctccctcccgggcctgggcgcccagccggacaggtgagcggcagccaggtatggcgttgacggtggatgtggccgggccagcgccctggggcttccgtatcacagggggcagggatttccacacgcccatcatggtgactaaggtggccgagcggggcaaagccaaggacgctgacctccggcctggagacataatcgtggccatcaacggggaaagcgcggagggcatgctgcatgccgaggcccagagcaagatccgccagagcccctcgcccctgcggctgcagctggaccggtctcaggctacgtctccagggcagaccaatggggacagctccttggaagtgctggcgactcgcttccagggctccgtgaggacatacactgagagtcagtcctccttaaggtcctcctactccagcccaacctccctcagcccgagggccggcagccccttctcaccaccaccctctagcagctccctcactggagaggcagccatcagccgcagcttccagagtctggcatgttccccgggcctccccgctgctgaccgcctgtcctactcaggccgccctggaagccgacaggccggcctcggccgcgctggcgactcggcggtgctggtgctgccgccttccccgggccctcgttcctccaggcccagcatggactcggaagggggaagcctcctcctggacgaggactcggaagtcttcaagatgctgcaggaaaatcgcgagggacgggcggccccccgacagtccagctcctttcggctcttgcaggaagccctggaggctgaggagagaggtggcacgccagccttcttgcccagctcactgagcccccagtcctccctgcccgcctccagggccctggccacccctcccaagctccacacttgtgagaagtgcagtaccagcatcgcgaaccaggctgtgcgcatccaggagggccggtaccgccaccccggctgctacacctgtgccgactgtgggctgaacctgaagatgcgcgggcacttctgggtgggtgacgagctgtactgtgagaagcatgcccgccagcgctactccgcacctgccaccctcagctctcgggcctgagcccgccatgccctcagcctgcctcactgctgggccagggtcatgcctatataagttggcatggcagggacaatggtgggcagttgctcttacatgagctaagtttggagacctgaggcccctttgtcctcgctgggtgggccaaggtctgggacctgtcttggactgtgggagactcaccctcaccttgccaggcctctcccctgcaggactggcattgcactagtctgaggtggccactgcctttgatcaacctttgtgtgcgagggtctaagtagggtcgaacacagaagtgggaaggagaggggtgggccaggggctaatggtgtcactgtgtaaagtttttgacatacta

SEQ ID NO: 164035 - DNA, 1463 bp, Homo sapiens
  Payload ID: 12298
  Gene Symbol: PDLIM2
  Gene Name: PDZ and LIM domain 2 (mystique)
  Uniprot ID: Q96JY6
  ENST ID: ENST00000409141
  CDS Start-End: 135-971
aagcccctgagtagctgctccgggagctgtggtgccctctccttctccctttggctcctctcctgctgccttacagtgcccccagagccggctaggggcatggacttcacctcctggtcctctcttcctcaggtatggcgttgacggtggatgtggccgggccagcgccctggggcttccgtatcacagggggcagggatttccacacgcccatcatggtgactaaggtggccgagcggggcaaagccaaggacgctgacctccggcctggagacataatcgtggccatcaacggggaaagcgcggagggcatgctgcatgccgaggcccagagcaagatccgccagagcccctcgcccctgcggctgcagctggaccggtctcaggctacgtctccagggcagaccaatggggacagctccttggaagtgctggcgactcgcttccagggctccgtgaggacatacactgagagtcagtcctccttaaggtcctcctactccagcccaacctccctcagcccgagggccggcagccccttctcaccaccaccctctagcagctccctcactggagaggcagccatcagccgcagcttccagagtctggcatgttccccgggcctccccgctgctgaccgcctgtcctactcaggccgccctggaagccgacaggccggcctcggccgcgctggcgactcggcggtgctggtgctgccgccttccccgggccctcgttcctccaggcccagcatggactcggaagggggaagcctcctcctggacgaggactcggaagtcttcaagatgctgcaggaaaatcgcgagggacgggcggccccccgacagtccagctcctttcggctcttgcaggaagccctggaggctgaggagagaggaaccaggctgtgcgcatccaggagggccggtaccgccaccccggctgctacacctgtgccgactgtgggctgaacctgaagatgcgcgggcacttctgggtgggtgacgagctgtactgtgagaagcatgcccgccagcgctactccgcacctgccaccctcagctctcgggcctgagcccgccatgccctcagcctgcctcactgctgggccagggtcatgcctatataagttggcatggcagggacaatggtgggcagttgctcttacatgagctaagtttggagacctgaggcccctttgtcctcgctgggtgggccaaggtctgggacctgtcttggactgtgggagactcaccctcaccttgccaggcctctcccctgcaggactggcattgcactagtctgaggtggccactgcctttgatcaacctttgtgtgcgagggtctaagtagggtcgaacacagaagtgggaaggagaggggtgggccaggggctaatggtgtcactgtgtaaagtttttgacatactagctctataaatatatgaatatggacaaaataaa

SEQ ID NO: 164036 - DNA, 1487 bp, Homo sapiens
  Payload ID: 12298
  Gene Symbol: PDLIM2
  Gene Name: PDZ and LIM domain 2 (mystique)
  Uniprot ID: Q96JY6
  ENST ID: ENST00000409417
  CDS Start-End: 77-1135
tctcctgctgccttacagtgcccccagagccggctaggggcatggacttcacctcctggtcctctcttcctcaggtatggcgttgacggtggatgtggccgggccagcgccctggggcttccgtatcacagggggcagggatttccacacgcccatcatggtgactaaggtggccgagcggggcaaagccaaggacgctgacctccggcctggagacataatcgtggccatcaacggggaaagcgcggagggcatgctgcatgccgaggcccagagcaagatccgccagagcccctcgcccctgcggctgcagctggaccggtctcaggctacgtctccagggcagaccaatggggacagctccttggaagtgctggcgactcgcttccagggctccgtgaggacatacactgagagtcagtcctccttaaggtcctcctactccagcccaacctccctcagcccgagggccggcagccccttctcaccaccaccctctagcagctccctcactggagaggcagccatcagccgcagcttccagagtctggcatgttccccgggcctccccgctgctgaccgcctgtcctactcaggccgccctggaagccgacaggccggcctcggccgcgctggcgactcggcggtgctggtgctgccgccttccccgggccctcgttcctccaggcccagcatggactcggaagggggaagcctcctcctggacgaggactcggaagtcttcaagatgctgcaggaaaatcgcgagggacgggcggccccccgacagtccagctcctttcggctcttgcaggaagccctggaggctgaggagagaggtggcacgccagccttcttgcccagctcactgagcccccagtcctccctgcccgcctccagggccctggccacccctcccaagctccacacttgtgagaagtgcagtaccagcatcgcgaaccaggctgtgcgcatccaggagggccggtaccgccaccccggctgctacacctgtgccgactgtgggctgaacctgaagatgcgcgggcacttctgggtgggtgacgagctgtactgtgagaagcatgcccgccagcgctactccgcacctgccaccctcagctctcgggcctgagcccgccatgccctcagcctgcctcactgctgggccagggtcatgcctatataagttggcatggcagggacaatggtgggcagttgctcttacatgagctaagtttggagacctgaggcccctttgtcctcgctgggtgggccaaggtctgggacctgtcttggactgtgggagactcaccctcaccttgccaggcctctcccctgcaggactggcattgcactagtctgaggtggccactgcctttgatcaacctttgtgtgcgagggtctaagtagggtcgaacacagaagtgggaaggagaggggtgggccaggggctaatggtgtcactgtgtaaagtttttgacata

SEQ ID NO: 164037 - DNA, 578 bp, Homo sapiens
  Payload ID: 12298
  Gene Symbol: PDLIM2
  Gene Name: PDZ and LIM domain 2 (mystique)
  ENST ID: ENST00000426493
  CDS Start-End: 58-578
gaagcaagcgctagtgggactgagccctgatggtggaggaggggagactgagggggtatggcgttgacggtggatgtggccgggccagcgccctggggcttccgtatcacagggggcagggatttccacacgcccatcatggtgactaaggtggccgagcggggcaaagccaaggacgctgacctccggcctggagacataatcgtggccatcaacggggaaagcgcggagggcatgctgcatgccgaggcccagagcaagatccgccagagcccctcgcccctgcggctgcagctggaccggtctcaggctacgtctccagggcagaccaatggggacagctccttggaagtgctggcgactcgcttccagggctccgtgaggacatacactgagagtcagtcctccttaaggtcctcctactccagcccaacctccctcagcccgagggccggcagccccttctcaccaccaccctctagcagctccctcactggagaggcagccatcagccgcagcttccagagtctggcatgttccccgggcctccccgctgctgaccgcctgtcctactcagg

SEQ ID NO: 164038 - DNA, 845 bp, Homo sapiens
  Payload ID: 12298
  Gene Symbol: PDLIM2
  Gene Name: PDZ and LIM domain 2 (mystique)
  ENST ID: ENST00000452226
  CDS Start-End: 83-845
agagtcgggtagacggcagcgggagcggtggcgtctccccgccttccctccctcccgggcctgggcgcccagccggacaggtatggcgttgacggtggatgtggccgggccagcgccctggggcttccgtatcacagggggcagggatttccacacgcccatcatggtgactaaggtggccgagcggggcaaagccaaggacgctgacctccggcctggagacataatcgtggccatcaacggggaaagcgcggagggcatgctgcatgccgaggcccagagcaagatccgccagagcccctcgcccctgcggctgcagctggaccggtctcaggctacgtctccagggcagaccaatggggacagctccttggaagtgctggcgactcgcttccagggctccgtgaggacatacactgagagtcagtcctccttaaggtcctcctactccagcccaacctccctcagcccgagggccggcagccccttctcaccaccaccctctagcagctccctcactggagaggcagccatcagccgcagcttccagagtctggcatgttccccgggcctccccgctgctgaccgcctgtcctactcaggccgccctggaagccgacaggccggcctcggccgcgctggcgactcggcggtgctggtgctgccgccttccccgggccctcgttcctccaggcccagcatggactcggaagggggaagcctcctcctggacgaggactcggaagtcttcaagatgctgcaggaaaatcgcgagggacgggcggccccccgacagtccagctcctttcggctcttgcaggaagccctggaggctgaggagagag

SEQ ID NO: 164039 - DNA, 507 bp, Homo sapiens
  Payload ID: 12298
  Gene Symbol: PDLIM2
  Gene Name: PDZ and LIM domain 2 (mystique)
  ENST ID: ENST00000436754
  CDS Start-End: 47-507
actcaccagccctcccccagagtggagaggaagtaccgtgtgctgtatggcgttgacggtggatgtggccgggccagcgccctggggcttccgtatcacagggggcagggatttccacacgcccatcatggtgactaaggtggccgagcggggcaaagccaaggacgctgacctccggcctggagacataatcgtggccatcaacggggaaagcgcggagggcatgctgcatgccgaggcccagagcaagatccgccagagcccctcgcccctgcggctgcagctggaccggtctcaggctacgtctccagggcagaccaatggggacagctccttggaagtgctggcgactcgcttccagggctccgtgaggacatacactgagagtcagtcctccttaaggtcctcctactccagcccaacctccctcagcccgagggccggcagccccttctcaccaccaccctctagcagctccctcactggagaggcagccatcagccgcag

SEQ ID NO: 164040 - DNA, 757 bp, Homo sapiens
  Payload ID: 12298
  Gene Symbol: PDLIM2
  Gene Name: PDZ and LIM domain 2 (mystique)
  ENST ID: ENST00000456545
  CDS Start-End: 52-757
acgagaggcggctctatggccttgaggtccccggagagagggttgccaggtatggcgttgacggtggatgtggccgggccagcgccctggggcttccgtatcacagggggcagggatttccacacgcccatcatggtgactaaggtggccgagcggggcaaagccaaggacgctgacctccggcctggagacataatcgtggccatcaacggggaaagcgcggagggcatgctgcatgccgaggcccagagcaagatccgccagagcccctcgcccctgcggctgcagctggaccggtctcaggctacgtctccagggcagaccaatggggacagctccttggaagtgctggcgactcgcttccagggctccgtgaggacatacactgagagtcagtcctccttaaggtcctcctactccagcccaacctccctcagcccgagggccggcagccccttctcaccaccaccctctagcagctccctcactggagaggcagccatcagccgcagcttccagagtctggcatgttccccgggcctccccgctgctgaccgcctgtcctactcaggccgccctggaagccgacaggccggcctcggccgcgctggcgactcggcggtgctggtgctgccgccttccccgggccctcgttcctccaggcccagcatggactcggaagggggaagcctcctcctggacgaggactcggaagtcttcaagatgctgcaggaaaatcgcgagggacgggcggccc

SEQ ID NO: 164041 - DNA, 728 bp, Homo sapiens
  Payload ID: 12298
  Gene Symbol: PDLIM2
  Gene Name: PDZ and LIM domain 2 (mystique)
  ENST ID: ENST00000429812
  CDS Start-End: 189-728
tgggactgagccctgatggtggaggaggggagactgagggggtgctggcatcccctccacttgccagcccctgccccccatgctccagcaagccccctgcctggcagcctgggcagccccctcctgggagtcgctccctgggctgaagactaaggaagggagaacccagaagcatggcttcccagggtatggcgttgacggtggatgtggccgggccagcgccctggggcttccgtatcacagggggcagggatttccacacgcccatcatggtgactaaggtggccgagcggggcaaagccaaggacgctgacctccggcctggagacataatcgtggccatcaacggggaaagcgcggagggcatgctgcatgccgaggcccagagcaagatccgccagagcccctcgcccctgcggctgcagctggaccggtctcaggctacgtctccagggcagaccaatggggacagctccttggaagtgctggcgactcgcttccagggctccgtgaggacatacactgagagtcagtcctccttaaggtcctcctactccagcccaacctccctcagcccgagggccggcagccccttctcaccaccaccctctagcagctccctcactggagaggcagccatcagccgcagcttccagagtctggcatgttccccgggcctccccgctgctgaccgcctgtcctactcaggccgccctggaagccgacag

SEQ ID NO: 164042 - DNA, 880 bp, Homo sapiens
  Payload ID: 12298
  Gene Symbol: PDLIM2
  Gene Name: PDZ and LIM domain 2 (mystique)
  ENST ID: ENST00000416159
  CDS Start-End: 6-122
caggtatggcgttgacggtggatgtggccgggccagcgccctggggcttccgtatcacagggggcagggatttccacacgcccatcatggtgactaaggcagccatttggggtgattactagaacaagagccccggagttcttggcagtctcctcttgacctgggcccaggctgggaacattcacaggagggctgtgcaggcagccacctgcaaggtggccgagcggggcaaagccaaggacgctgacctccggcctggagacataatcgtggccatcaacggggaaagcgcggagggcatgctgcatgccgaggcccagagcaagatccgccagagcccctcgcccctgcggctgcagctggaccggtctcaggctacgtctccagggcagaccaatggggacagctccttggaagtgctggcgactcgcttccagggctccgtgaggacatacactgagagtcagtcctccttaaggtcctcctactccagcccaacctccctcagcccgagggccggcagccccttctcaccaccaccctctagcagctccctcactggagaggcagccatcagccgcagcttccagagtctggcatgttccccgggcctccccgctgctgaccgcctgtcctactcaggccgccctggaagccgacaggccggcctcggccgcgctggcgactcggcggtgctggtgctgccgccttccccgggccctcgttcctccaggcccagcatggactcggaagggggaagcctcctcctggacgaggactcggaagtcttcaagatgctgcaggaaaatcgcgagggacgggcggccccccgacagtccagctcctttcggctcttgcaggaagccctggaggctgagga

SEQ ID NO: 164043 - DNA, 599 bp, Homo sapiens
  Payload ID: 12298
  Gene Symbol: PDLIM2
  Gene Name: PDZ and LIM domain 2 (mystique)
  ENST ID: ENST00000614502
  CDS Start-End: 95-535
tgcctcctcccaacaggccggcctcggccgcgctggcgactcggcggtgctggtgctgccgccttccccgggccctcgttcctccaggcccagcatggactcggaagggggaagcctcctcctggacgaggactcggaagtcttcaagatgctgcaggaaaatcgcgagggacgggcggccccccgacagtccagctcctttcggctcttgcaggaagccctggaggctgaggagagaggtggcacgccagccttcttgcccagctcactgagcccccagtcctccctgcccgcctccagggccctggccacccctcccaagctccacacttgtgagaagtgcagtaccagcatcgcgaaccaggctgtgcgcatccaggagggccggtaccgccaccccggctgctacacctgtgccgactgtgggctgaacctgaagatgcgcgggcacttctgggtgggtgacgagctgtactgtgagaagcatgcccgccagcgctactccgcacctgccaccctcagctctcgggcctgagcccgccatgccctcagcctgcctcactgctgggccagggtcatgcctatataagttggcatgg

SEQ ID NO: 164044 - DNA, 209 bp, Homo sapiens
  Payload ID: 12298
  Gene Symbol: PDLIM2
  Gene Name: PDZ and LIM domain 2 (mystique)
  ENST ID: ENST00000616289
  CDS Start-End: 156-209
cgctggtgctcttgatagattctcgcagcacttgcgtccccagggcagccccaggatgggtgctgggcagggtggtgcccagcctggcaccgcggcttcctgcctggattggctcctggctccagagctagaggctcaggaaatcccacaggggtatggcgttgacggtggatgtggccgggccagcgccctggggcttccgtatcaca

SEQ ID NO: 164045 - DNA, 701 bp, Homo sapiens
  Payload ID: 12298
  Gene Symbol: PDLIM2
  Gene Name: PDZ and LIM domain 2 (mystique)
  ENST ID: ENST00000443561
  CDS Start-End: 94-312
gcctcctcccaacaggccggcctcggccgcgctggcgactcggcggtgctggtgctgccgccttccccgggccctcgttcctccaggcccagcatggactcggaagggggaagcctcctcctggacgaggactcggaagtcttcaagatgctgcaggaaaatcgcgagggacgggcggccccccgacagtccagctcctttcggctcttgcaggaagccctggaggctgaggagagaggaaccaggctgtgcgcatccaggagggccggtaccgccaccccggctgctacacctgtgccgactgtgggctgaacctgaagatgcgcgggcacttctgggtgggtgacgagctgtactgtgagaagcatgcccgccagcgctactccgcacctgccaccctcagctctcgggcctgagcccgccatgccctcagcctgcctcactgctgggccagggtcatgcctatataagttggcatggcagggacaatggtgggcagttgctcttacatgagctaagtttggagacctgaggcccctttgtcctcgctgggtgggccaaggtctgggacctgtcttggactgtgggagactcaccctcaccttgccaggcctctcccctgcaggactggcattgcactagtctgaggtggccactgcctttgatcaacctttgtgtgcgagggtctaagtagggtcgaa

SEQ ID NO: 164046 - DNA, 1490 bp, Homo sapiens
  Payload ID: 12298
  Gene Symbol: PDLIM2
  Gene Name: PDZ and LIM domain 2 (mystique)
  ENST ID: ENST00000622702
  CDS Start-End: 135-1112
aagcccctgagtagctgctccgggagctgtggtgccctctccttctccctttggctcctctcctgctgccttacagtgcccccagagccggctaggggcatggacttcacctcctggtcctctcttcctcaggtatggcgttgacggtggatgtggccgggccagcgccctggggcttccgtatcacagggggcagggatttccacacgcccatcatggtgactaaggtggccgagcggggcaaagccaaggacgctgacctccggcctggagacataatcgtggccatcaacggggaaagcgcggagggcatgctgcatgccgaggcccagagcaagatccgccagagcccctcgcccctgcggctgcagctggaccggtctcaggctacgtctccagggcagaccaatggggacagctccttggaagtgctggcgactcgcttccagggctccgtgaggacatacactgagagtcagtcctccttaaggtcctcctactccagcccaacctccctcagccgagggccggcagccccttctcaccaccaccctctagcagctccctcactggagaggcagccatcagccgcagccggcctcggccgcgctggcgactcggcggtgctggtgctgccgccttccccgggccctcgttcctccaggcccagcatggactcggaagggggaagcctcctcctggacgaggactcggaagtcttcaagatgctgcaggaaaatcgcgagggacgggcggccccccgacagtccagctcctttcggctcttgcaggaagccctggaggctgaggagagaggtggcacgccagccttcttgcccagctcactgagcccccagtcctccctgcccgcctccagggccctggccacccctcccaagctccacacttgtgagaagtgcagtaccagcatcgcgaaccaggctgtgcgcatccaggagggccggtaccgccaccccggctgctacacctgtgccgactgtgggctgaacctgaagatgcgcgggcacttctgggtgggtgacgagctgtactgtgagaagcatgcccgccagcgctactccgcacctgccaccctcagctctcgggcctgagcccgccatgccctcagcctgcctcactgctgggccagggtcatgcctatataagttggcatggcagggacaatggtgggcagttgctcttacatgagctaagtttggagacctgaggcccctttgtcctcgctgggtgggccaaggtctgggacctgtcttggactgtgggagactcaccctcaccttgccaggcctctcccctgcaggactggcattgcactagtctgaggtggccactgcctttgatcaacctttgtgtgcgagggtctaagtagggtcgaacacagaagtgggaaggagaggggtgggccaggggctaatggtgtcactgtgtaaagtttttgacatactagctctataaatatatgaatatgg

SEQ ID NO: 164047 - DNA, 894 bp, Homo sapiens
  Payload ID: 12298
  Gene Symbol: PDLIM2
  Gene Name: PDZ and LIM domain 2 (mystique)
  ENST ID: ENST00000448520
  CDS Start-End: 1-414
gggcagaccaatggggacagctccttggaagtgctggcgactcgcttccagggctccgtgaggacatacactgagagtcagtcctccttaaggtcctcctactccagcccaacctccctcagcccgagggccggcagccccttctcaccaccaccctctagcagctccctcactggagaggcagccatcagccgcagcttccagagtctggcatgttccccgggcctccccgctgctgaccgcctgtcctactcaggccgccctggaagccgacagcatggactcggaagggggaagcctcctcctggacgaggactcggaagtcttcaagatgctgcaggaaaatcgcgagggacgggcggccccccgacagtccagctcctttcggctcttgcaggaagccctggaggctgaggagagaggtggcacgccagccttcttgcccagctcactgagcccccagtcctccctgcccgcctccagggccctggccacccctcccaagctccacacttgtgagaagtgcagtaccagcatcgcgaaccaggctgtgcgcatccaggagggccggtaccgccaccccggctgctacacctgtgccgactgtgggctgaacctgaagatgcgcgggcacttctgggtgggtgacgagctgtactgtgagaagcatgcccgccagcgctactccgcacctgccaccctcagctctcgggcctgagcccgccatgccctcagcctgcctcactgctgggccagggtcatgcctatataagttggcatggcagggacaatggtgggcagttgctcttacatgagctaagtttggagacctgaggcccctttgtcctcgctgggtgggccaaggtctgggacctgtcttggactgtgggagac

SEQ ID NO: 164048 - DNA, 1995 bp, Homo sapiens
  Payload ID: 12298
  Gene Symbol: PDLIM2
  Gene Name: PDZ and LIM domain 2 (mystique)
  ENST ID: ENST00000464275
  CDS Start-End: 1175-1615
atagaacgttttactggagaaccctgagagcagagggatgcgaggccaactgctggtagcagcctggtggggtgagggtctagggttgttttcttaagatccagaagtttttgctttagcttaaggatgtgtgcaattttccatgtggcttcataattcatccatgactttgaattttaaaatggagagaagttggcttcccaggaaatggtgcccctggccctgggcatcggcccacctggctgtctccaaggctctccttcccagtggctggtgcgggctccgggagctcagctgagtcccattggggtggcaacggaaagggagcaggggagtggggagtacggagatgcaggctggaaactggcctccaggaacaactgtgaggttgaaggcgagatttccatgttgggagcaaatttaagagccccagatggacacggcacacctggagacaggcactgctgcctgagtgtggcccagggagggctcggctccccaaagctccacggggcaggcccagacctcccagcagagtagggacaggctggttagcccagactcccgcctctgaggagaggaaccagctctccttgggaagagggcctctgccctggccggccctgactcccaggggacttcgaccccttgcttcatccctttatgtttctatctcctcagtgcaaaagggcagcgtgcttcctctctgctggttccgtgggatcggagccaggccccagtgtgcaatgtctttgcacacagataatagcgtgcgtgacagaggactctgtgcttagctgtcacctgctgccttcctgctgcccggtccccggcagaacccgcatgcctccctccctctctggaccctggcagtctctgcgccctggctccgagggaaggggcagggggcccgctggtcggcgagggctgggagcccccgacaccttggctccaagggaaggggcaggggtccgctggtcggcgagggccgggggccccctggtgtcgggcctgggaacagccgggctaggccctcctgggtgtgttggcccaaggctctggccctgactcctccccggctgcctcctcccaacaggccggcctcggccgcgctggcgactcggcggtgctggtgctgccgccttccccgggccctcgttcctccaggcccagcatggactcggaagggggaagcctcctcctggacgaggactcggaagtcttcaagatgctgcaggaaaatcgcgagggacgggcggccccccgacagtccagctcctttcggctcttgcaggaagccctggaggctgaggagagaggtggcacgccagccttcttgcccagctcactgagcccccagtcctccctgcccgcctccagggccctggccacccctcccaagctccacacttgtgagaagtgcagtaccagcatcgcgaaccaggctgtgcgcatccaggagggccggtaccgccaccccggctgctacacctgtgccgactgtgggctgaacctgaagatgcgcgggcacttctgggtgggtgacgagctgtactgtgagaagcatgcccgccagcgctactccgcacctgccaccctcagctctcgggcctgagcccgccatgccctcagcctgcctcactgctgggccagggtcatgcctatataagttggcatggcagggacaatggtgggcagttgctcttacatgagctaagtttggagacctgaggcccctttgtcctcgctgggtgggccaaggtctgggacctgtcttggactgtgggagactcaccctcaccttgccaggcctctcccctgcaggactggcattgcactagtctgaggtggccactgcctttgatcaacctttgtgtgcgagggtctaagtagggtcgaacacagaagtgggaaggagaggggtgggccaggggctaatggtgtcactgtgtaaagtttttgacatactagctctataaatatatgaatatggac

SEQ ID NO: 164049 - DNA, 2589 bp, Homo sapiens
  Payload ID: 12299
  Gene Symbol: PDLIM3
  Gene Name: PDZ and LIM domain 3
  ENST ID: ENST00000284767
  CDS Start-End: 125-955
cggtgacgtcacccccagcggggataaagcgcccccgcccgggtcggggccaggacgccgcccggcgcggagtggctgccctgcgcggggacacttagagcccggtgggcgggaggaaggcggcatgccccagacggtgatcctcccgggccctgcgccctggggcttcaggctctcagggggcatagacttcaaccagcctttggtcatcaccaggattacaccaggaagcaaggcggcagctgccaacctgtgtcctggagatgtcatcctggctattgacggctttgggacagagtccatgactcatgctgatgcgcaggacaggattaaagcagcagctcaccagctgtgtctcaaaattgacaggggagaaactcacttatggtctccacaagtatctgaagatgggaaagcccatcctttcaaaatcaacttagaatcagaaccacaggacgggaactactttgaacacaagcataatattcggcccaaacctttcgtgatcccgggccgaagcagcgagcccacagcctcggtgccccccgagtcggacgtgtaccggatgctccacgacaatcggaatgagcccacacagcctcgccagtcgggctccttcagagtgctccagggaatggtggacgatggctctgatgaccgtccggctggaacgcggagtgtgagagctccggtgacgaaagtccatggcggttcaggcggggcacagaggatgccgctctgtgacaaatgtgggagtggcatagtcggtgctgtggtgaaggcgcgggataagtaccggcaccctgagtgcttcgtgtgtgccgactgcaacctcaacctcaagcaaaagggctacttcttcatagaaggggagctgtactgcgaaacccacgcaagagcccgcacaaagcccccagagggctatgacacggtcactctgtatcccaaagcttaagtctctgcaggcgtggcacgcacgcacgcacccacccacgcgcacttacacgagaagacattcatggctttgggcagaaggattgtgcagattgtcaactccaaatctaaagtcaaggctttagacctttatcctattgtttattgaggaaaaggaatgggaggcaaatgcctgctatgtgaaaaaaacatacacttagctatgttttgcaactctttttggggctagcaataatgatatttaaagcaataattttttgtatgtcatactccacaatttacatgtatattacagccatcaaacacataaacatcaagatatttgaaggactctaattgtctttccttgacaagttgattttgcaattgtggtaaatagcaaataacaatcttgtattctaacataatctgcagttgtctgtatgtgttttaactattacagtgcatgttagggagaaattccctgaatttctttagttttgtattcaaacaattatgccactcgatgcaacaaacataataaatacataaaagatttaaaaaatacctaatgaagtggcattcattgaattcaaataaaatcaacatttcaatgagagaacccaatcatattttaacatgtacactaacaaatattttaagataaatgtggcttcttcaggttttataactcattactctttcttatgagcacaaaatttctgatgatagaagcgttgaaatttgctagttaaaggtagttcagtctctttcaaattaaaagtttcacttgcttcaacagagactctttcaatttaaatatctctttcagatcaatattcagtcaaattgaaggttcaaagtccatcactgctgtttcttaggctcaatggttcaccacctcctcctcttcccaagatggcatctccaggaagaaacaatttagacgacttcctaaggaaggcaggggctgctggtctcctggggtcctgcttgtatccactgttgaaatccttggtttcacttgtgatctgtggtctgttttcttgacatagttgaggccaggcaataataacacctccactaccacctccaaaactctcagctcagctttcctggagtcatggatcctctgtctgagacatgcactctgcctggccctggcgcaggcagcctaccttgcaggctctgcatggcgttaccttgcctctcacccagggtgcccatggcaatgctcctgacttgcatctctcacctactttccatgtcccccactggggacgtacaggaacttctgaaactgtcccctcaggttcaaaccatggggaaccagcagggtggggaccctcagaccctctgtctcaccaccttgtgtcacatggtcatctctaccacccctcaacccccacagctgctaacttctggcctgaaacaagtgttctcctcccataaggtcccaaatgggacacaagttttattgctctgggattcttccaaacttaactgactctgaccctgacctgttcaggattttgagaggagccaaaacacgtgcctggcccctgtaggcatttgacattgcaactcctgtgccaacacatgcattcactaacaaagctattaaaaaaataaaacagacttttgagatcaaagaaa

SEQ ID NO: 164050 - DNA, 1766 bp, Homo sapiens
  Payload ID: 12299
  Gene Symbol: PDLIM3
  Gene Name: PDZ and LIM domain 3
  Uniprot ID: Q53GG5
  ENST ID: ENST00000284770
  CDS Start-End: 75-1169
caggacgccgcccggcgcggagtggctgccctgcgcggggacacttagagcccggtgggcgggaggaaggcggcatgccccagacggtgatcctcccgggccctgcgccctggggcttcaggctctcagggggcatagacttcaaccagcctttggtcatcaccaggattacaccaggaagcaaggcggcagctgccaacctgtgtcctggagatgtcatcctggctattgacggctttgggacagagtccatgactcatgctgatgcgcaggacaggattaaagcagcagctcaccagctgtgtctcaaaattgacaggggagaaactcacttatggtctccacaagtatctgaagatgggaaagcccatcctttcaaaatcaacttagaatcagaaccacaggacgggaactactttgaacacaagcataatattcggcccaaacctttcgtgatcccgggccgaagcagtggatgcagcactccctccgggattgactgtggcagtggacgcagcaccccttcttctgtcagtactgttagtaccatttgcccaggtgacttgaaagttgcggctaagctggcccctaacattcctttggaaatggaacttcctggtgtgaagattgtacatgctcagtttaatacacctatgcagttgtactcagatgacaatattatggaaacactccagggtcaggtttcaacagccctaggggaaacacctttgatgagcgagcccacagcctcggtgccccccgagtcggacgtgtaccggatgctccacgacaatcggaatgagcccacacagcctcgccagtcgggctccttcagagtgctccagggaatggtggacgatggctctgatgaccgtccggctggaacgcggagtgtgagagctccggtgacgaaagtccatggcggttcaggcggggcacagaggatgccgctctgtgacaaatgtgggagtggcatagtcggtgctgtggtgaaggcgcgggataagtaccggcaccctgagtgcttcgtgtgtgccgactgcaacctcaacctcaagcaaaagggctacttcttcatagaaggggagctgtactgcgaaacccacgcaagagcccgcacaaagcccccagagggctatgacacggtcactctgtatcccaaagcttaagtctctgcaggcgtggcacgcacgcacgcacccacccacgcgcacttacacgagaagacattcatggctttgggcagaaggattgtgcagattgtcaactccaaatctaaagtcaaggctttagacctttatcctattgtttattgaggaaaaggaatgggaggcaaatgcctgctatgtgaaaaaaacatacacttagctatgttttgcaactctttttggggctagcaataatgatatttaaagcaataattttttgtatgtcatactccacaatttacatgtatattacagccatcaaacacataaacatcaagatatttgaaggactctaattgtctttccttgacaagttgattttgcaattgtggtaaatagcaaataacaatcttgtattctaacataatctgcagttgtctgtatgtgttttaactattacagtgcatgttagggagaaattccctgaatttctttagttttgtattcaaacaattatgccactcgatgcaacaaacataataaatacataaaagatttaaaaaatacctaatgaagtggcattcattgaattcaaataaaatcaacatttcaatgaga

SEQ ID NO: 164051 - DNA, 1672 bp, Homo sapiens
  Payload ID: 12299
  Gene Symbol: PDLIM3
  Gene Name: PDZ and LIM domain 3
  Uniprot ID: Q53GG5
  ENST ID: ENST00000284771
  CDS Start-End: 179-1129
cgcttccaaagttggagctctccggggtgggagggggcggggaggacggcggggcggtgacgtcacccccagcggggataaagcgcccccgcccgggtcggggccaggacgccgcccggcgcggagtggctgccctgcgcggggacacttagagcccggtgggcgggaggaaggcggcatgccccagacggtgatcctcccgggccctgcgccctggggcttcaggctctcagggggcatagacttcaaccagcctttggtcatcaccaggattacaccaggaagcaaggcggcagctgccaacctgtgtcctggagatgtcatcctggctattgacggctttgggacagagtccatgactcatgctgatgcgcaggacaggattaaagcagcagctcaccagctgtgtctcaaaattgacaggggagaaactcacttatggtctccacaagtatctgaagatgggaaagcccatcctttcaaaatcaacttagaatcagaaccacaggaattcaaacccattggtaccgcgcacaacagaagggcccagccttttgttgcagctgcaaacattgatgacaaaagacaggtagtgagcgcttcctataactcgccaattgggctctattcaactagcaatatacaagatgcgcttcacggacagctgcggggtctcattcctagctcacctcaaaacgagcccacagcctcggtgccccccgagtcggacgtgtaccggatgctccacgacaatcggaatgagcccacacagcctcgccagtcgggctccttcagagtgctccagggaatggtggacgatggctctgatgaccgtccggctggaacgcggagtgtgagagctccggtgacgaaagtccatggcggttcaggcggggcacagaggatgccgctctgtgacaaatgtgggagtggcatagtcggtgctgtggtgaaggcgcgggataagtaccggcaccctgagtgcttcgtgtgtgccgactgcaacctcaacctcaagcaaaagggctacttcttcatagaaggggagctgtactgcgaaacccacgcaagagcccgcacaaagcccccagagggctatgacacggtcactctgtatcccaaagcttaagtctctgcaggcgtggcacgcacgcacgcacccacccacgcgcacttacacgagaagacattcatggctttgggcagaaggattgtgcagattgtcaactccaaatctaaagtcaaggctttagacctttatcctattgtttattgaggaaaaggaatgggaggcaaatgcctgctatgtgaaaaaaacatacacttagctatgttttgcaactctttttggggctagcaataatgatatttaaagcaataattttttgtatgtcatactccacaatttacatgtatattacagccatcaaacacataaacatcaagatatttgaaggactctaattgtctttccttgacaagttgattttgcaattgtggtaaatagcaaataacaatcttgtattctaacataatctgcagttgtctgtatgtgttttaactattacagtgcatgttagggagaaattccctgaatttctttagttttgtattcaaacaattatgccactcgatgcaacaaacataataaatacataaaagatttaaaaaa

SEQ ID NO: 164052 - DNA, 581 bp, Homo sapiens
  Payload ID: 12299
  Gene Symbol: PDLIM3
  Gene Name: PDZ and LIM domain 3
  ENST ID: ENST00000512293
  CDS Start-End: 74-202
aggacgccgcccggcgcggagtggctgccctgcgcggggacacttagagcccggtgggcgggaggaaggcggcatgccccagacggtgatcctcccgggccctgcgccctggggcttcaggctctcagggggcatagacttcaaccagcctttggtcatcaccagggggagaaactcacttatggtctccacaagtatctgaagatgggaaagcccatcctttcaaaatcaacttagaatcagaaccacaggacgggaactactttgaacacaagcataatattcggcccaaacctttcgtgatcccgggccgaagcagtggatgcagcactccctccgggattgactgtggcagtggacgcagcaccccttcttctgtcagtactgttagtaccatttgcccaggtgacttgaaagttgcggctaagctggcccctaacattcctttggaaatggaacttcctggtgtgaagattgtacatgctcagtttaatacacctatgcagttgtactcagatgacaatattatggaaacactccagggtcaggtttcaacagccctaggggaaacacctttgatg

SEQ ID NO: 164053 - DNA, 571 bp, Homo sapiens
  Payload ID: 12299
  Gene Symbol: PDLIM3
  Gene Name: PDZ and LIM domain 3
  ENST ID: ENST00000505886
  CDS Start-End: 33-161
acttagagcccggtgggcgggaggaaggcggcatgccccagacggtgatcctcccgggccctgcgccctggggcttcaggctctcagggggcatagacttcaaccagcctttggtcatcaccagggggagaaactcacttatggtctccacaagtatctgaagatgggaaagcccatcctttcaaaatcaacttagaatcagaaccacaggaattcaaacccattggtaccgcgcacaacagaagggcccagccttttgttgcagctgcaaacattgatgacaaaagacaggtagtgagcgcttcctataactcgccaattgggctctattcaactagcaatatacaagatgcgcttcacggacagctgcggggtctcattcctagctcacctcaaaacgagcccacagcctcggtgccccccgagtcggacgtgtaccggatgctccacgacaatcggaatgagcccacacagcctcgccagtcgggctccttcagagtgctccagggaatggtggacgatggctctgatgaccgtccggctggaacgcggagtgtgagagctccggtga

SEQ ID NO: 164054 - DNA, 2352 bp, Homo sapiens
  Payload ID: 12299
  Gene Symbol: PDLIM3
  Gene Name: PDZ and LIM domain 3
  ENST ID: ENST00000620787
  CDS Start-End: 125-718
cggtgacgtcacccccagcggggataaagcgcccccgcccgggtcggggccaggacgccgcccggcgcggagtggctgccctgcgcggggacacttagagcccggtgggcgggaggaaggcggcatgccccagacggtgatcctcccgggccctgcgccctggggcttcaggctctcagggggcatagacttcaaccagcctttggtcatcaccagggacgggaactactttgaacacaagcataatattcggcccaaacctttcgtgatcccgggccgaagcagcgagcccacagcctcggtgccccccgagtcggacgtgtaccggatgctccacgacaatcggaatgagcccacacagcctcgccagtcgggctccttcagagtgctccagggaatggtggacgatggctctgatgaccgtccggctggaacgcggagtgtgagagctccggtgacgaaagtccatggcggttcaggcggggcacagaggatgccgctctgtgacaaatgtgggagtggcatagtcggtgctgtggtgaaggcgcgggataagtaccggcaccctgagtgcttcgtgtgtgccgactgcaacctcaacctcaagcaaaagggctacttcttcatagaaggggagctgtactgcgaaacccacgcaagagcccgcacaaagcccccagagggctatgacacggtcactctgtatcccaaagcttaagtctctgcaggcgtggcacgcacgcacgcacccacccacgcgcacttacacgagaagacattcatggctttgggcagaaggattgtgcagattgtcaactccaaatctaaagtcaaggctttagacctttatcctattgtttattgaggaaaaggaatgggaggcaaatgcctgctatgtgaaaaaaacatacacttagctatgttttgcaactctttttggggctagcaataatgatatttaaagcaataattttttgtatgtcatactccacaatttacatgtatattacagccatcaaacacataaacatcaagatatttgaaggactctaattgtctttccttgacaagttgattttgcaattgtggtaaatagcaaataacaatcttgtattctaacataatctgcagttgtctgtatgtgttttaactattacagtgcatgttagggagaaattccctgaatttctttagttttgtattcaaacaattatgccactcgatgcaacaaacataataaatacataaaagatttaaaaaatacctaatgaagtggcattcattgaattcaaataaaatcaacatttcaatgagagaacccaatcatattttaacatgtacactaacaaatattttaagataaatgtggcttcttcaggttttataactcattactctttcttatgagcacaaaatttctgatgatagaagcgttgaaatttgctagttaaaggtagttcagtctctttcaaattaaaagtttcacttgcttcaacagagactctttcaatttaaatatctctttcagatcaatattcagtcaaattgaaggttcaaagtccatcactgctgtttcttaggctcaatggttcaccacctcctcctcttcccaagatggcatctccaggaagaaacaatttagacgacttcctaaggaaggcaggggctgctggtctcctggggtcctgcttgtatccactgttgaaatccttggtttcacttgtgatctgtggtctgttttcttgacatagttgaggccaggcaataataacacctccactaccacctccaaaactctcagctcagctttcctggagtcatggatcctctgtctgagacatgcactctgcctggccctggcgcaggcagcctaccttgcaggctctgcatggcgttaccttgcctctcacccagggtgcccatggcaatgctcctgacttgcatctctcacctactttccatgtcccccactggggacgtacaggaacttctgaaactgtcccctcaggttcaaaccatggggaaccagcagggtggggaccctcagaccctctgtctcaccaccttgtgtcacatggtcatctctaccacccctcaacccccacagctgctaacttctggcctgaaacaagtgttctcctcccataaggtcccaaatgggacacaagttttattgctctgggattcttccaaacttaactgactctgaccctgacctgttcaggattttgagaggagccaaaacacgtgcctggcccctgtaggcatttgacattgcaactcctgtgccaacacatgcattcactaacaaagctattaaaaaaataaaacagacttttgagatcaaagaaa

SEQ ID NO: 164055 - DNA, 1016 bp, Homo sapiens
  Payload ID: 12299
  Gene Symbol: PDLIM3
  Gene Name: PDZ and LIM domain 3
  ENST ID: ENST00000629667
  CDS Start-End: 74-202
aggacgccgcccggcgcggagtggctgccctgcgcggggacacttagagcccggtgggcgggaggaaggcggcatgccccagacggtgatcctcccgggccctgcgccctggggcttcaggctctcagggggcatagacttcaaccagcctttggtcatcaccagggggagaaactcacttatggtctccacaagtatctgaagatgggaaagcccatcctttcaaaatcaacttagaatcagaaccacaggacgggaactactttgaacacaagcataatattcggcccaaacctttcgtgatcccgggccgaagcagtggatgcagcactccctccgggattgactgtggcagtggacgcagcaccccttcttctgtcagtactgttagtaccatttgcccaggtgacttgaaagttgcggctaagctggcccctaacattcctttggaaatggaacttcctggtgtgaagattgtacatgctcagtttaatacacctatgcagttgtactcagatgacaatattatggaaacactccagggtcaggtttcaacagccctaggggaaacacctttgatgagcgagcccacagcctcggtgccccccgagtcggacgtgtaccggatgctccacgacaatcggaatgagcccacacagcctcgccagtcgggctccttcagagtgctccagggaatggtggacgatggctctgatgaccgtccggctggaacgcggagtgtgagagctccggtgacgaaagtccatggcggttcaggcggggcacagaggatgccgctctgtgacaaatgtgggagtggcatagtcggtgctgtggtgaaggcgcgggataagtaccggcaccctgagtgcttcgtgtgtgccgactgcaacctcaacctcaagcaaaagggctacttcttcatagaaggggagctgtactgcgaaacccacgcaagagcccgcacaaagcccccagagggctatgacacggtcactctgtatcccaaagcttaa

SEQ ID NO: 164056 - DNA, 2282 bp, Homo sapiens
  Payload ID: 12300
  Gene Symbol: PDLIM4
  Gene Name: PDZ and LIM domain 4
  Uniprot ID: P50479
  ENST ID: ENST00000253754
  CDS Start-End: 65-1057
gctgcggcggcggcggctcctcctcagagtccggctcaggctccggctgcggctccagcccgcgatgccccattccgtgaccctgcgcgggccttcgccctggggcttccgcctggtgggcggccgggacttcagcgcgcccctcaccatctcacgggtccatgctggcagcaaggctgcattggctgccctgtgcccaggagacctgatccaggccatcaatggtgagagcacagagctcatgacacacctggaggcacagaaccgcatcaagggctgccacgatcacctcacactgtctgtgagcaggcctgagggtaggagctggcccagtgcccctgatgacagcaaggctcaggcacacaggatccacatcgatcctgagatccaggacggcagcccaacaaccagcaggcggccctcaggcaccgggactgggccagaagatggcagaccaagcctgggatctccatatggacaaccccctcgctttccagtccctcacaatggcagcagcgaggccaccctgccagcccagatgagcaccctgcatgtgtctccaccccccagcgctgacccagccagaggcctcccgcggagccgggactgcagagtcgacctgggctccgaggtgtacaggatgctgcgggagccagccgagcccgtggccgcggagcccaagcagtcaggctccttccgctacttgcagggcatgctagaggccggcgagggcggggattggcccgggcctggcggcccccggaacctcaagcccacggccagcaagctgggcgctccgctgagcggcctgcaggggctgcccgagtgcacgcgctgcggccacggcatcgtgggcaccatcgtcaaggcacgggacaagctctaccatcccgagtgcttcatgtgcagtgactgcggcctgaacctcaagcagcgtggttacttctttctggacgagcggctctactgtgagagccacgccaaggcgcgcgtgaagccgcccgagggctacgacgtggtggcggtgtaccccaatgccaaggtggaactcgtctgagctgggaccctgctcccacgcctgcttcttaaggtccctgctcggccggtgtaaatatgtttcaccctgtccctctaataaagctcctctgctccaccttgaacctgtcacctggcctgccaccctcctgcgcaggccatgcatggctcccgagtacagtagtatctgcttaggtgccaggcatgtcctaggctctgggtgcagtagtgagcaggacgggtaccatgctgccctgaagggggccacagcctgggtggaaggcagacctgaatcacaacgggccagctctagtaatacgaaggtgaggtctgggatgctgcgtgcggcgcgacgacaggaggtatgacctgggtggggtcagggaaagtcttagctgagaactaagagatgagggaggcacaaactctgcacgggggaactgtgtgtgcaaaggtgagctgggggcgagaaaggcctctgtggccgtcatcggcactagcgggttgggggtggtggtggggtgctggcagcctcaggagcgatcgctcccctggagagggtgattgagtgtggagatcaccggggccgccgcgggccgtctgcacttctgttccaggtttttctggcattttctgttccaggtttcttccacccacgagcactttattctcctccgagacccccttttcttccccttcctctctcccccaccagggggcgcgcttaaatttccagacagagaccagaaggaaggtttagaaagaaaagaacacttgcccagggcagctttgccctccaagaggctccctcctgtctctaagtcaattccacccctcctcgaagtcccggcttccacccctctcctcagagtcccggcgtttacctcgtggtgtgtttgccttgggcctttcatgccccggctgcacacatcgtctgtgaattgtggctgttcactcccgaggatgtgtcctagactccgggtcgcgtggatctaccctctagtttacttgctcgggagaagaaactgactcgttttatttagtgcctatttagcgagcccagagtaacgtacatttgtgctgttttcaattttgtgctatcgcaaatcacaaaaaaactgttatcaattcacattcatcatcagcacgagacccatttccttgtgctcctgccagctcaggatattatgtttcttttttcatttttgccagtctgttaagtaaaatgtcatatgcgtttgttttaa

SEQ ID NO: 164057 - DNA, 1006 bp, Homo sapiens
  Payload ID: 12300
  Gene Symbol: PDLIM4
  Gene Name: PDZ and LIM domain 4
  Uniprot ID: P50479
  ENST ID: ENST00000379018
  CDS Start-End: 29-769
caggctccggctgcggctccagcccgcgatgccccattccgtgaccctgcgcgggccttcgccctggggcttccgcctggtgggcggccgggacttcagcgcgcccctcaccatctcacgggtccatgctggcagcaaggctgcattggctgccctgtgcccaggagacctgatccaggccatcaatggtgagagcacagagctcatgacacacctggaggcacagaaccgcatcaagggctgccacgatcacctcacactgtctgtgagcaggcctgagggtaggagctggcccagtgcccctgatgacagcaaggctcaggcacacaggatccacatcgatcctgagatccaggacggcagcccaacaaccagcaggcggccctcaggcaccgggactgggccagaagatggcagaccaagcctgggatctccatatggacaaccccctcgctttccagtccctcacaatggcagcagcgaggccaccctgccagcccagatgagcaccctgcatgtgtctccaccccccagcgctgacccagccagaggcctcccgcggagccgggactgcagagtcgacctgggctccgaggtgtacaggatgctgcgggagccagccgagcccgtggccgcggagcccaagcagtcaggctccttccgctacttgcagggcatgctagaggccggcgagggcggggcaccatcgtcaaggcacgggacaagctctaccatcccgagtgcttcatgtgcagtgactgcggcctgaacctcaagcagcgtggttacttctttctggacgagcggctctactgtgagagccacgccaaggcgcgcgtgaagccgcccgagggctacgacgtggtggcggtgtaccccaatgccaaggtggaactcgtctgagctgggaccctgctcccacgcctgcttcttaaggtccctgctcggccggtgtaaatatgtttcaccctgtccctctaataaagctcctctgctccaccttgaa

SEQ ID NO: 164058 - DNA, 538 bp, Homo sapiens
  Payload ID: 12300
  Gene Symbol: PDLIM4
  Gene Name: PDZ and LIM domain 4
  ENST ID: ENST00000418373
  CDS Start-End: 176-538
tccaggagttcccaccagtaggagctcccacccaaaagaatggggtcactggcagcttttgaaccagctgggcactggctggagaggctgggtccatgctggcagcaaggctgcattggctgccctgtgcccaggagacctgatccaggccatcaatggtgagagcacagagctcatgacacacctggaggcacagaaccgcatcaagggctgccacgatcacctcacactgtctgtgagcaggcctgagggtaggagctggcccagtgcccctgatgacagcaaggctcaggcacacaggatccacatcgatcctgagatccaggacggcagcccaacaaccagcaggcggccctcaggcaccgggactgggccagaagatggcagaccaagcctgggatctccatatggacaaccccctcgctttccagtccctcacaatggcagcagcgaggccaccctgccagcccagatgagcaccctgcatgtgtctccaccccccagcgctgacccagccagaggcctcccgcggagccgg

SEQ ID NO: 164059 - DNA, 6083 bp, Homo sapiens
  Payload ID: 12301
  Gene Symbol: PDLIM5
  Gene Name: PDZ and LIM domain 5
  Uniprot ID: Q96HC4
  ENST ID: ENST00000317968
  CDS Start-End: 137-1927
gttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagggagaacctaaagaagtagttaaacctgtgcccattacatctcctgctgtgtccaaagtcacttccacaaacaacatggcctacaataaggcaccacggccttttggttctgtgtcttcaccaaaagtcacatccatcccatcaccatcgtctgccttcaccccagcccatgcgaccacctcatcacatgcttccccttcacccgtggctgccgtcactcctcccctgttcgctgcatctggactgcatgctaatgccaatcttagtgctgaccagtctccatctgcactgagcgctggtaaaactgcagttaatgtcccacggcagcccacagtcaccagcgtgtgttccgagacttctcaggagctagcagagggacagagaagaggatcccagggtgacagtaaacagcaaaatggcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaataactctcaggagccttctccgcagttggcttcctcggtagcttccacacggagcatgcccgagagcctggacagcccaacctctggcagaccaggggttaccagcctcacagctgcagctgccttcaagcctgtaggatccactggcgtcatcaagtcaccaagctggcaacggccaaaccaaggagtaccttccactggaagaatctcaaacagcgctacttactcaggatcagtggcaccagccaactcagctttgggacaaacccagccaagtgaccaggacactttagtgcaaagagctgagcacattccagcagggaaacgaactccgatgtgcgcccattgtaaccaggtcatcagaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggagaagtcatcagtgcgttgaaacaaacttggcatgtttcctgttttgtgtgtgtagcctgtggaaagcccattcggaacaatgtttttcacttggaggatggtgaaccctactgtgagactgattattatgccctctttggtactatatgccatggatgtgaatttcccatagaagctggtgacatgttcctggaagctctgggctacacctggcatgacacttgctttgtatgctcagtgtgttgtgaaagtttggaaggtcagacctttttctccaagaaggacaagcccctgtgtaagaaacatgctcattctgtgaatttttgaaagtcaacagttcaggagaagagaaggaatttgaagagaaaaaggaaaattaaaattactaattaatttttagattcaatatttatatggagttttgaaaaataatagtggccctgaaggaataaattccagctttaaaaaccaagtctgaggaaatatttggcttcataaagtaaagagacggtttggcatttattattactttttcctgtattttatgcccataaaataagctttataaaaaccaatttcctgatggactattaaattcatcttagaataaattagtgaagaatttaattttagaataaataatccaatctgaaataattataccttctttccttgttaggtagttatgagtaaatctgcaaaaggcaatgaaaatgccttaaattttatcaataacagaattattgtatttaaaaaaaaactaatacttatctttaaaatagtaaataggattttaaacagagaattttatcagtaataggtgtcagtttttaaaaaattgcttgtaggctgagcgcggtggctcacgcctgtaatcccagcactttgggaggccaaggtgggtggaccacatgaggtcaggagtttgagatcagcctggccaacatggtgaaaccccatctctactaaaaatacaaaaattagccggacgcagtggcacgcgcctgtaatcccagctactcaagaggctgaggcacgagaatcacttgaacccgggagggagaggttgcagtgagccaagatcgtaccactgcactccagcctgggtgacagagtgagactctgtctccaaaaaaaaactttgcttgtatattatttttgccttacagtggatcattctagtaggaaaggacaataagattttttatcaaaatgtgtcatgccagtaagagatgttatattcttttctcatttcttccccacccaaaaataagctaccatatagcttataagtctcaaatttttgccttttactaaaatgtgattgtttctattcattgtgtatgcttcatcacctatattaggcaaattccatttttttcccttgtgctaaggtaaagatttaattaaataattttggcctctcatagttttctctctctttaaagagaataaatagagggccaggtgtggtggctcacgcctgtgatcccagcactttgggaggccaagacgggcggatcatgaggtcaagagatcaagatcatcctggccaacatggtgaaaccctgtctctactaaaaatacaaaaatgagctgggcatggtggggcgtgcctgtagtcccatgtacttgggaggctgaggcaggaaaattcttgaacccaggagacggaagttgcagtgagctgagatcacaccactgcactccagcctggtgacagagcaagactccggctcttaaaaaaaaaaaaaaaaaaaaaaaaagagagagagagaataaatagaaaagaatgtggctgggaattgtgaatcagaagattataccccccaattgtttttcaatccccttttctcaaataataaattagttaaatcagtttctgagttatgccactggctgatgaagagttgagaggtctctttgcagaatgatctttttgtttcgttttgtttcttcttctgcatttaaaaattaaaagattggtttgaggatgtgatgaaattgagactttttgtggttttctctcaataataagtgaaccaatttcaaatgtgatcacaaagtttggaaagcttttattcacagaggttgggtagtgttgggaggggagtttaattactcagattggcctgttatttgatttcctcctttgggaaaagaattatgtagataccacatggagacagggaaacaattgtggtaaaactgtggatcctgttgctatttgcccagtgagaaaacagattctggtatttgatttggtttttctctttgtttccagaatggatgaaagtccatgaacctcctaagttataatttaaatttgtttggggcaaggtgattttatagtcgagacagagccctaggtccttcctgccccatcactcacttacgacatcacttccattgtgtgcatgtttgttatagaggaggttttaggctacaatatttgtttaacctccctaagaactttcaaggcatctgtcctgaaagctgttaatttatggtctagcagatttatattatatgcagataataattaactggggataaaagaatggcaaggggtgacacaaagtagcaaactgaatacttctccaatagcaaccccaagctacctcctcaccctgcatcttggagggaggcaggaaatttcttttgaaataaagtgctggagctgaattctgcattatttatcgttgctgctgaaaccacctataaaagacttgctggctaatgtgcattgtcatataatgtacactgtcacatctttacagtcttgtatgttatagaatacaaaataagttgatggttttgtttggtgtgagctttttgtttgtttgtttagttttgccttcataggttatatgccaagatagtatttgataagtcaatgacatttggatgttttcttcaaagaattttatttgacccagatttcttataaagttatcttacattaaggatgtcattttcatcagaccttctttctacatattattcatgaagcataatgttgcatttctccaaattttatgcctgaaagggtagtgttgcttcctaaggtatcatgttgtctttgtgctttgtccatctcttccgtggcgaagctttatatctgttcctaaaacagttaatcctgtgaaataaatattgaacataatccagaagaatctctctgtttcccttggggaatgccatatttaattcaccagcagtaatcctttaataactggcagagcactttattcttctggtgagctccctgaatatttatttttctgattataaattttctatattagtagcattttttaattattacttcttcactatagagcatttacttttagtctctagatgtatattttggaatgctgtacttggcataacatagattaaaatcataatgcatgactaaaaactccttggatttatttcccattttaaaatttttagcggtaagttcagatttataatctttctctagacttccatggtctgaatgttgcctgctgaagtagcaacctaaaaagtatcccctgcttatgcttgtccagttggccctccatgtccataggcttcgcatctgtgattcagcccactgtgggtcaaaaatatttggggaaaaaaatggatggttgcgcctttgctgaacatgtacaaacttttttttgtcattaaacaatatagtataacaactatttacaaagcatttacattgtattagctattataggtaatctagagatgatttaaagtgtatggtaggatgtgcataggttatatgcaaatactacaccattttctataagggacttgaacatcatggactttagtatcctagggggttcttggaacccatcacccataggggcaccataggacaactatagtaccgtgtttatttcctattaattcaggttccgtttagagtctaaaactaaaacctaatcatttagtcacagtgtaaaaacaaatggaaataacagctcaaatcttcaaaatattactatagcattatgtttaaaataatctacaacaaaaatgtaccattttcaagcagtactacattaggagcccttttatagaaaataatttcttctttacccccgttccagtgtgaatctagtattctgttaacatttgtgtggcatttggagtttgtcatccccattgaagggagagccttctcagacatgaagcaagggaaacatactgaatagttttacacaaatttgatctggcttccatttgtccccctcatttcccaaatgtttaaatgtattggatttggattctcaatgtataagttgccttatctgttaatgtctatcttctgtctctttaattttgtatatctgctgttttgcttttggatacattttctaattagaagtcacatgataaatataatcagtatagtaataataccataatgtgcacatactcaataaataaatgactgcattgttgtaaa

SEQ ID NO: 164060 - DNA, 1960 bp, Homo sapiens
  Payload ID: 12301
  Gene Symbol: PDLIM5
  Gene Name: PDZ and LIM domain 5
  Uniprot ID: Q96HC4
  ENST ID: ENST00000318007
  CDS Start-End: 182-826
gtgtcctgggtcgggggtggggcgagggagagccaggaggcggaagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagaaaacacaagtgacaaataaccctggcactgtgaaaatcccacctaaacgcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaaggaaaagataccccttcacgtctttagtcccaaatacacaaaattacgtgactggcaccatgaagtttcagcacgtgctcttaacgtacagtgatttatgagccttgccccccaagcagccagcacataccttttcatttactttttttttttcaacttcatagcaaaatctgtattaaatttgccttatgaaaaaatagaactttttctatacttttctaacaatttcctattgttgtgagaaaaggaagatgaacatgttttgtgctagttggtagctcacaaatgtaaaaccaaaaaaaaaaaaaaatagaaaattaagggactagatctatttgtggatttgtatctgtttttgttgtgattagggtagtaatcttggaaaacgaattattttcataagttgaatttggttagttggttggttgaagcagaggataatgagcaaataaagtccttgtctaatttggaaaatactttctttatattattaacatctcccaagattactttttaagttcattattatgttacattcaaagttgattgtaaattattctaaataagtaaatataaggaggcaagaataaacaaagactttattaaagaagagtgcgtgcattgtagatttaggtatcttttaaagtaggtactattcaggatggctctatgaagaggaggaggtccagatttggctcctgaaaaaggaaagaagagaattttacccctatttgcaatggagaaatacagtattctttggtttggttggatttgcaaatcctatttcctatcaaaggaaatatctctagtggatatttttagaatatagacaatttctaggtattaactaataagatatggaaaagatagctttgctttttttaatcagaagaacataaaataaattacaatatgaatgattgtgagacatcagagaaatattttacttagtgacgtaaactactgtgcactgctgctattcctaggaagctgtgttttgggcaatacatggaagctaaatatatgaccagaaatgctttctgccttgtaatatagtgtattatatattagagctaaatttagtaataaatgcattttgaagtttggaaaagtattgtaataaagttgcctttaacttagctttgtacttgttctgtttccttgaggctagacacagtgccatccaggacttattacagtataactgggtaaaataaacaattctctg

SEQ ID NO: 164061 - DNA, 1189 bp, Homo sapiens
  Payload ID: 12301
  Gene Symbol: PDLIM5
  Gene Name: PDZ and LIM domain 5
  Uniprot ID: Q96HC4
  ENST ID: ENST00000359265
  CDS Start-End: 153-563
gagccaggaggcggaagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtgctggagtgcagtggcgcaatctcggctcaccacaacctccatctcccgagttcaagcgattctcctgcctcagcctcccgagtagctgggattacaggcatgtgccaccacgcctggctaattttgtatttttagtagagaccaagtttccctatgttggtcaggctggtcttgaactcccgacctcaggtgatctgcccacctcggcctcccaaagtgctaagattacaggcgtgagccaccgtgcctggcccacactgttttatactttgcttttttttgcaacaatttaccctgagatcattctctattaatatataaggaggtatgtgtgtttttttaaaacaattgtataattttattttataaggaaagtgacatttaaccaatcccctactgaagagtatttgtggcatttccatattactgttacagtggtacagtgaataccaaatataagtacatacatatatatgtgaatatatgtatctacgtcattttgaaaggttgtgccaatttacacttttgtgcaacgcatgaaaatactatttttgtgccagtcttaccaacaaacttggatatttatcaagtgctgtgaatgcatcatctcatttaattatcataccaacatgcaaaatagtgatattattcccattgtatataactgtgctgtgcgctcacatgactgtatggaagagctggctttccaacagttatgctgtgctgcctctttaataattcactttaccttaaatttagttagttgtttctttaatcagatatttagaagattgtcattttggttaataatatatgtgtatgtataaatatatatacacacacatactctgcatcttgtatgtgtatccaacttcattttgaaagattaaaaataagtttgtaacgcctaaatatccttattaaaatactgcaaatccca

SEQ ID NO: 164062 - DNA, 2020 bp, Homo sapiens
  Payload ID: 12301
  Gene Symbol: PDLIM5
  Gene Name: PDZ and LIM domain 5
  Uniprot ID: Q96HC4
  ENST ID: ENST00000380180
  CDS Start-End: 182-886
gtgtcctgggtcgggggtggggcgagggagagccaggaggcggaagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagcccacagtcaccagcgtgtgttccgagacttctcaggagctagcagagggacagagaagaggatcccagggtgacagtaaacagcaaaatgggaaaatcccacctaaacgcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaaggaaaagataccccttcacgtctttagtcccaaatacacaaaattacgtgactggcaccatgaagtttcagcacgtgctcttaacgtacagtgatttatgagccttgccccccaagcagccagcacataccttttcatttactttttttttttcaacttcatagcaaaatctgtattaaatttgccttatgaaaaaatagaactttttctatacttttctaacaatttcctattgttgtgagaaaaggaagatgaacatgttttgtgctagttggtagctcacaaatgtaaaaccaaaaaaaaaaaaaaatagaaaattaagggactagatctatttgtggatttgtatctgtttttgttgtgattagggtagtaatcttggaaaacgaattattttcataagttgaatttggttagttggttggttgaagcagaggataatgagcaaataaagtccttgtctaatttggaaaatactttctttatattattaacatctcccaagattactttttaagttcattattatgttacattcaaagttgattgtaaattattctaaataagtaaatataaggaggcaagaataaacaaagactttattaaagaagagtgcgtgcattgtagatttaggtatcttttaaagtaggtactattcaggatggctctatgaagaggaggaggtccagatttggctcctgaaaaaggaaagaagagaattttacccctatttgcaatggagaaatacagtattctttggtttggttggatttgcaaatcctatttcctatcaaaggaaatatctctagtggatatttttagaatatagacaatttctaggtattaactaataagatatggaaaagatagctttgctttttttaatcagaagaacataaaataaattacaatatgaatgattgtgagacatcagagaaatattttacttagtgacgtaaactactgtgcactgctgctattcctaggaagctgtgttttgggcaatacatggaagctaaatatatgaccagaaatgctttctgccttgtaatatagtgtattatatattagagctaaatttagtaataaatgcattttgaagtttggaaaagtattgtaataaagttgcctttaacttagctttgtacttgttctgtttccttgaggctagacacagtgccatccaggacttattacagtataactgggtaaaataaacaattctctg

SEQ ID NO: 164063 - DNA, 5713 bp, Homo sapiens
  Payload ID: 12301
  Gene Symbol: PDLIM5
  Gene Name: PDZ and LIM domain 5
  ENST ID: ENST00000437932
  CDS Start-End: 738-1553
gtgtcctgggtcgggggtggggcgagggagagccaggaggcggaagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaataactctcaggagccttctccgcagttggcttcctcggtagcttccacacggagcatgcccgagagcctggacagcccaacctctggcagaccaggggttaccagcctcacagctgcagctgccttcaagcctgtaggatccactggcgtcatcaagtcaccaagctggcaacggccaaaccaaggagtaccttccactggaagaatctcaaacagcgctacttactcaggatcagtggcaccagccaactcagctttgggacaaacccagccaagtgaccaggacactttagtgcaaagagctgagcacattccagcagggaaacgaactccgatgtgcgcccattgtaaccaggtcatcagaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggagaagtcatcagtgcgttgaaacaaacttggcatgtttcctgttttgtgtgtgtagcctgtggaaagcccattcggaacaatgtttttcacttggaggatggtgaaccctactgtgagactgattattatgccctctttggtactatatgccatggatgtgaatttcccatagaagctggtgacatgttcctggaagctctgggctacacctggcatgacacttgctttgtatgctcagtgtgttgtgaaagtttggaaggtcagacctttttctccaagaaggacaagcccctgtgtaagaaacatgctcattctgtgaatttttgaaagtcaacagttcaggagaagagaaggaatttgaagagaaaaaggaaaattaaaattactaattaatttttagattcaatatttatatggagttttgaaaaataatagtggccctgaaggaataaattccagctttaaaaaccaagtctgaggaaatatttggcttcataaagtaaagagacggtttggcatttattattactttttcctgtattttatgcccataaaataagctttataaaaaccaatttcctgatggactattaaattcatcttagaataaattagtgaagaatttaattttagaataaataatccaatctgaaataattataccttctttccttgttaggtagttatgagtaaatctgcaaaaggcaatgaaaatgccttaaattttatcaataacagaattattgtatttaaaaaaaaactaatacttatctttaaaatagtaaataggattttaaacagagaattttatcagtaataggtgtcagtttttaaaaaattgcttgtaggctgagcgcggtggctcacgcctgtaatcccagcactttgggaggccaaggtgggtggaccacatgaggtcaggagtttgagatcagcctggccaacatggtgaaaccccatctctactaaaaatacaaaaattagccggacgcagtggcacgcgcctgtaatcccagctactcaagaggctgaggcacgagaatcacttgaacccgggagggagaggttgcagtgagccaagatcgtaccactgcactccagcctgggtgacagagtgagactctgtctccaaaaaaaaactttgcttgtatattatttttgccttacagtggatcattctagtaggaaaggacaataagattttttatcaaaatgtgtcatgccagtaagagatgttatattcttttctcatttcttccccacccaaaaataagctaccatatagcttataagtctcaaatttttgccttttactaaaatgtgattgtttctattcattgtgtatgcttcatcacctatattaggcaaattccatttttttcccttgtgctaaggtaaagatttaattaaataattttggcctctcatagttttctctctctttaaagagaataaatagagggccaggtgtggtggctcacgcctgtgatcccagcactttgggaggccaagacgggcggatcatgaggtcaagagatcaagatcatcctggccaacatggtgaaaccctgtctctactaaaaatacaaaaatgagctgggcatggtggggcgtgcctgtagtcccatgtacttgggaggctgaggcaggaaaattcttgaacccaggagacggaagttgcagtgagctgagatcacaccactgcactccagcctggtgacagagcaagactccggctcttaaaaaaaaaaaaaaaaaaaaaaaaagagagagagagaataaatagaaaagaatgtggctgggaattgtgaatcagaagattataccccccaattgtttttcaatccccttttctcaaataataaattagttaaatcagtttctgagttatgccactggctgatgaagagttgagaggtctctttgcagaatgatctttttgtttcgttttgtttcttcttctgcatttaaaaattaaaagattggtttgaggatgtgatgaaattgagactttttgtggttttctctcaataataagtgaaccaatttcaaatgtgatcacaaagtttggaaagcttttattcacagaggttgggtagtgttgggaggggagtttaattactcagattggcctgttatttgatttcctcctttgggaaaagaattatgtagataccacatggagacagggaaacaattgtggtaaaactgtggatcctgttgctatttgcccagtgagaaaacagattctggtatttgatttggtttttctctttgtttccagaatggatgaaagtccatgaacctcctaagttataatttaaatttgtttggggcaaggtgattttatagtcgagacagagccctaggtccttcctgccccatcactcacttacgacatcacttccattgtgtgcatgtttgttatagaggaggttttaggctacaatatttgtttaacctccctaagaactttcaaggcatctgtcctgaaagctgttaatttatggtctagcagatttatattatatgcagataataattaactggggataaaagaatggcaaggggtgacacaaagtagcaaactgaatacttctccaatagcaaccccaagctacctcctcaccctgcatcttggagggaggcaggaaatttcttttgaaataaagtgctggagctgaattctgcattatttatcgttgctgctgaaaccacctataaaagacttgctggctaatgtgcattgtcatataatgtacactgtcacatctttacagtcttgtatgttatagaatacaaaataagttgatggttttgtttggtgtgagctttttgtttgtttgtttagttttgccttcataggttatatgccaagatagtatttgataagtcaatgacatttggatgttttcttcaaagaattttatttgacccagatttcttataaagttatcttacattaaggatgtcattttcatcagaccttctttctacatattattcatgaagcataatgttgcatttctccaaattttatgcctgaaagggtagtgttgcttcctaaggtatcatgttgtctttgtgctttgtccatctcttccgtggcgaagctttatatctgttcctaaaacagttaatcctgtgaaataaatattgaacataatccagaagaatctctctgtttcccttggggaatgccatatttaattcaccagcagtaatcctttaataactggcagagcactttattcttctggtgagctccctgaatatttatttttctgattataaattttctatattagtagcattttttaattattacttcttcactatagagcatttacttttagtctctagatgtatattttggaatgctgtacttggcataacatagattaaaatcataatgcatgactaaaaactccttggatttatttcccattttaaaatttttagcggtaagttcagatttataatctttctctagacttccatggtctgaatgttgcctgctgaagtagcaacctaaaaagtatcccctgcttatgcttgtccagttggccctccatgtccataggcttcgcatctgtgattcagcccactgtgggtcaaaaatatttggggaaaaaaatggatggttgcgcctttgctgaacatgtacaaacttttttttgtcattaaacaatatagtataacaactatttacaaagcatttacattgtattagctattataggtaatctagagatgatttaaagtgtatggtaggatgtgcataggttatatgcaaatactacaccattttctataagggacttgaacatcatggactttagtatcctagggggttcttggaacccatcacccataggggcaccataggacaactatagtaccgtgtttatttcctattaattcaggttccgtttagagtctaaaactaaaacctaatcatttagtcacagtgtaaaaacaaatggaaataacagctcaaatcttcaaaatattactatagcattatgtttaaaataatctacaacaaaaatgtaccattttcaagcagtactacattaggagcccttttatagaaaataatttcttctttacccccgttccagtgtgaatctagtattctgttaacatttgtgtggcatttggagtttgtcatccccattgaagggagagccttctcagacatgaagcaagggaaacatactgaatagttttacacaaatttgatctggcttccatttgtccccctcatttcccaaatgtttaaatgtattggatttggattctcaatgtataagttgccttatctgttaatgtctatcttctgtctctttaattttgtatatctgctgttttgcttttggatacattttctaattagaagtcacatgataaatataatcagtatagtaataataccataatgtgcacatactcaataaataaatgactgcattgttgtaaatgag

SEQ ID NO: 164064 - DNA, 907 bp, Homo sapiens
  Payload ID: 12301
  Gene Symbol: PDLIM5
  Gene Name: PDZ and LIM domain 5
  ENST ID: ENST00000506632
  CDS Start-End: 1-695
atgccagcaagaagagactgattgaggatactgaagactggcgtccaaggactggaacaactcagtctcgctctttccgaatccttgcccagatcactgggactgaacatttgaaagaatctgaagccgataatacaaagaaggcaaataactctcaggagccttctccgcagttggcttcctcggtagcttccacacggagcatgcccgagagcctggacagcccaacctctggcagaccaggggttaccagcctcacagctgcagctgccttcaagcctgtaggatccactggcgtcatcaagtcaccaagctggcaacggccaaaccaaggagtaccttccactggaagaatctcaaacagcgctacttactcaggatcagtggcaccagccaactcagctttgggacaaacccagccaagtgaccaggacactttagtgcaaagagctgagcacattccagcagggaaacgaactccgatgtgcgcccattgtaaccaggtcatcagaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggatagagacggggtttcaccgtgttagccaggatggtctcgatctcctgaactcgtgatccgcccgcctcggcctcccaaagtgctgggattacaggaagtcatcagtgcgttgaaacaaacttggcatgtttcctgttttgtgtgtgtagcctgtggaaagcccattcggaacaatgtttttcacttggaggatggtgaaccctactgtgagactg

SEQ ID NO: 164065 - DNA, 554 bp, Homo sapiens
  Payload ID: 12301
  Gene Symbol: PDLIM5
  Gene Name: PDZ and LIM domain 5
  ENST ID: ENST00000509357
  CDS Start-End: 1-258
ctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaataactctcaggagccttctccgcagttggcttcctcggtagcttccacacggagcatgcccgagagcctggacagcccaacctctggcagaccaggggttaccagcctcacagctgcagctgccttcaagcctgtaggatccactggcg

SEQ ID NO: 164066 - DNA, 538 bp, Homo sapiens
  Payload ID: 12301
  Gene Symbol: PDLIM5
  Gene Name: PDZ and LIM domain 5
  ENST ID: ENST00000504489
  CDS Start-End: 97-213
acttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctcactttctggtggaggtgatagccaacagtaagatggccaaaagctacttacccttgaagaggaaatgaagggcttggagctccaactagatagcctatgaataattgagatttggctttttacctcattatggatttagtttgaatgtattctgtgtatatattttaaggatatgttttcatgatgatgatgatagcactgatgagaggagtaattaaagcttctatttattgagacttgactatatgtcaggtactgtttcactttcatcaccagtaggtaattattactattatataagtttctaaaaggtttgtttttgcatattcaaataaatatgaat

SEQ ID NO: 164067 - DNA, 2081 bp, Homo sapiens
  Payload ID: 12301
  Gene Symbol: PDLIM5
  Gene Name: PDZ and LIM domain 5
  Uniprot ID: Q96HC4
  ENST ID: ENST00000503974
  CDS Start-End: 104-1555
gcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagcccacagtcaccagcgtgtgttccgagacttctcaggagctagcagagggacagagaagaggatcccagggtgacagtaaacagcaaaatgggaaaatcccacctaaacgcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaataactctcaggagccttctccgcagttggcttcctcggtagcttccacacggagcatgcccgagagcctggacagcccaacctctggcagaccaggggttaccagcctcacagctgcagctgccttcaagcctgtaggatccactggcgtcatcaagtcaccaagctggcaacggccaaaccaaggagtaccttccactggaagaatctcaaacagcgctacttactcaggatcagtggcaccagccaactcagctttgggacaaacccagccaagtgaccaggacactttagtgcaaagagctgagcacattccagcagggaaacgaactccgatgtgcgcccattgtaaccaggtcatcagaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggagaagtcatcagtgcgttgaaacaaacttggcatgtttcctgttttgtgtgtgtagcctgtggaaagcccattcggaacaatgtttttcacttggaggatggtgaaccctactgtgagactgattattatgccctctttggtactatatgccatggatgtgaatttcccatagaagctggtgacatgttcctggaagctctgggctacacctggcatgacacttgctttgtatgctcagtgtgttgtgaaagtttggaaggtcagacctttttctccaagaaggacaagcccctgtaatggatgaaagtccatgaacctcctaagttataatttaaatttgtttggggcaaggtgattttatagtcgagacagagccctaggtccttcctgccccatcactcacttacgacatcacttccattgtgtgcatgtttgttatagaggaggttttaggctacaatatttgtttaacctccctaagaactttcaaggcatctgtcctgaaagctgttaatttatggtctagcagatttatattatatgcagataataattaactggggataaaagaatggcaaggggtgacacaaagtagcaaactgaatacttctccaatagcaaccccaagctacctcctcaccctgcatcttggagggaggcaggaaatttcttttgaaataaagtgctggagctgaattctgcattatttatcgttgctgctgaaaccacctataaaagacttgctggctaatgtgcattgtcatataatgtacactgtcacatctttacagtcttgtatgttatagaatacaaaataagttga

SEQ ID NO: 164068 - DNA, 3356 bp, Homo sapiens
  Payload ID: 12301
  Gene Symbol: PDLIM5
  Gene Name: PDZ and LIM domain 5
  Uniprot ID: Q96HC4
  ENST ID: ENST00000514743
  CDS Start-End: 45-1922
agcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagcccacagtcaccagcgtgtgttccgagacttctcaggagctagcagagggacagagaagaggatcccagggtgacagtaaacagcaaaatgggaaaatcccacctaaacgcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaagtttgacagtgctctggaagacctacctaagagtggacctcaccctcctgcaactcctcaggtgttaactattggtagccaagtggccacactttctaaagtagcaactacttattctagtttaagcagctccacaggaaatgtggaagattctttcgaaggttttcgaaacttttctaccttctcttctcctgctagatatagtgctgcagttctgagcagcgcagctgctactgtgtctgctgttattgctacaaaaaccaggctctacactcctgaaagatatcactcactcctggatgcactttgcatcagccctgtctccaagcctttagctttttcctatctgcagtcctcaaggaaatcaactggctctatccatgttaagaaaacaagtaactctcaggagccttctccgcagttggcttcctcggtagcttccacacggagcatgcccgagagcctggacagcccaacctctggcagaccaggggttaccagcctcacagctgcagctgccttcaagcctgtaggatccactggcgtcatcaagtcaccaagctggcaacggccaaaccaaggagtaccttccactggaagaatctcaaacagcgctacttactcaggatcagtggcaccagccaactcagctttgggacaaacccagccaagtgaccaggacactttagtgcaaagagctgagcacattccagcagggaaacgaactccgatgtgcgcccattgtaaccaggtcatcagaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggagaagtcatcagtgcgttgaaacaaacttggcatgtttcctgttttgtgtgtgtagcctgtggaaagcccattcggaacaatgtttttcacttggaggatggtgaaccctactgtgagactgattattatgccctctttggtactatatgccatggatgtgaatttcccatagaagctggtgacatgttcctggaagctctgggctacacctggcatgacacttgctttgtatgctcagtgtgttgtgaaagtttggaaggtcagacctttttctccaagaaggacaagcccctgtgtaagaaacatgctcattctgtgaatttttgaaagtcaacagttcaggagaagagaaggaatttgaagagaaaaaggaaaattaaaattactaattaatttttagattcaatatttatatggagttttgaaaaataatagtggccctgaaggaataaattccagctttaaaaaccaagtctgaggaaatatttggcttcataaagtaaagagacggtttggcatttattattactttttcctgtattttatgcccataaaataagctttataaaaaccaatttcctgatggactattaaattcatcttagaataaattagtgaagaatttaattttagaataaataatccaatctgaaataattataccttctttccttgttaggtagttatgagtaaatctgcaaaaggcaatgaaaatgccttaaattttatcaataacagaattattgtatttaaaaaaaaactaatacttatctttaaaatagtaaataggattttaaacagagaattttatcagtaataggtgtcagtttttaaaaaattgcttgtaggctgagcgcggtggctcacgcctgtaatcccagcactttgggaggccaaggtgggtggaccacatgaggtcaggagtttgagatcagcctggccaacatggtgaaaccccatctctactaaaaatacaaaaattagccggacgcagtggcacgcgcctgtaatcccagctactcaagaggctgaggcacgagaatcacttgaacccgggagggagaggttgcagtgagccaagatcgtaccactgcactccagcctgggtgacagagtgagactctgtctccaaaaaaaaactttgcttgtatattatttttgccttacagtggatcattctagtaggaaaggacaataagattttttatcaaaatgtgtcatgccagtaagagatgttatattcttttctcatttcttccccacccaaaaataagctaccatatagcttataagtctcaaatttttgccttttactaaaatgtgattgtttctattcattgtgtatgcttcatcacctatattaggcaaattccatttttttcccttgtgctaaggtaaagatttaattaaataattttggcctctcatagttttctctctctttaaagagaataaatagagggccaggtgtggtggctcacgcctgtgatcccagcactttgggaggccaagacgggcggatcatgaggtcaagagatcaagatcatcctggccaacatggtgaaaccctgtctctactaaaaatacaaaaatgagctgggcatggtggggcgtgcctgtagtcccatgtacttgggaggctgaggcaggaaaattcttgaacccaggagacggaagttgcagtgagctgagatcacaccactgcactccagcctggtgacagagcaagactccggctcttaaaaaaaaaaaaaaaaaaaa

SEQ ID NO: 164069 - DNA, 372 bp, Homo sapiens
  Payload ID: 12301
  Gene Symbol: PDLIM5
  Gene Name: PDZ and LIM domain 5
  ENST ID: ENST00000512274
  CDS Start-End: 119-262
gacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtgtaagtaaactttacaaattttattatagatgttcattcagtgcttagtcctcgggctgagttgtttaattctctgttgacctgtactctacttattatcattgctcctgggatttgatcttggcaaatttgattatctataataaaggatgagggga

SEQ ID NO: 164070 - DNA, 1794 bp, Homo sapiens
  Payload ID: 12301
  Gene Symbol: PDLIM5
  Gene Name: PDZ and LIM domain 5
  Uniprot ID: Q96HC4
  ENST ID: ENST00000508216
  CDS Start-End: 45-749
agcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagcccacagtcaccagcgtgtgttccgagacttctcaggagctagcagagggacagagaagaggatcccagggtgacagtaaacagcaaaatgggaaaatcccacctaaacgcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaaggaaaagataccccttcacgtctttagtcccaaatacacaaaattacgtgactggcaccatgaagtttcagcacgtgctcttaacgtacagtgatttatgagccttgccccccaagcagccagcacataccttttcatttactttttttttttcaacttcatagcaaaatctgtattaaatttgccttatgaaaaaatagaactttttctatacttttctaacaatttcctattgttgtgagaaaaggaagatgaacatgttttgtgctagttggtagctcacaaatgtaaaaccaaaaaaaaaaaaaaatagaaaattaagggactagatctatttgtggatttgtatctgtttttgttgtgattagggtagtaatcttggaaaacgaattattttcataagttgaatttggttagttggttggttgaagcagaggataatgagcaaataaagtccttgtctaatttggaaaatactttctttatattattaacatctcccaagattactttttaagttcattattatgttacattcaaagttgattgtaaattattctaaataagtaaatataaggaggcaagaataaacaaagactttattaaagaagagtgcgtgcattgtagatttaggtatcttttaaagtaggtactattcaggatggctctatgaagaggaggaggtccagatttggctcctgaaaaaggaaagaagagaattttacccctatttgcaatggagaaatacagtattctttggtttggttggatttgcaaatcctatttcctatcaaaggaaatatctctagtggatatttttagaatatagacaatttctaggtattaactaataagatatggaaaagatagctttgctttttttaatcagaagaacataaaataaattacaatatgaatgattgtgagacatcagagaaatattttacttagtgacgtaaactactgtgcactgctgctattcctaggaagctgtgttttgggcaatacatggaagctaaatatatgaccagaaatgctttctgccttgtaatatagtgtattatatattagagctaaatttagtaataaatgcattttgaagtttggaaaagtattgtaataaagttgcctttaactta

SEQ ID NO: 164071 - DNA, 794 bp, Homo sapiens
  Payload ID: 12301
  Gene Symbol: PDLIM5
  Gene Name: PDZ and LIM domain 5
  ENST ID: ENST00000513341
  CDS Start-End: 1-590
taaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagcccacagtcaccagcgtgtgttccgagacttctcaggagctagcagagggacagagaagaggatcccagggtgacagtaaacagcaaaatggcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaaggaaaagataccccttcacgtctttagtcccaaatacacaaaattacgtgactggcaccatgaagtttcagcacgtgctcttaacgtacagtgatttatgagccttgccccccaagcagccagcacataccttttcatttactttttttttttcaacttcatagcaaaatctgtattaaatttgccttatgaaaaaatagaactttttctatacttttctaacaatttcctattgttgtgagaaaaggaagatgaacatgttttgtgctagttggtagctcacaaatgtaaaaccaaa

SEQ ID NO: 164072 - DNA, 2979 bp, Homo sapiens
  Payload ID: 12301
  Gene Symbol: PDLIM5
  Gene Name: PDZ and LIM domain 5
  Uniprot ID: Q96HC4
  ENST ID: ENST00000542407
  CDS Start-End: 83-1546
gtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagcccacagtcaccagcgtgtgttccgagacttctcaggagctagcagagggacagagaagaggatcccagggtgacagtaaacagcaaaatggcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaataactctcaggagccttctccgcagttggcttcctcggtagcttccacacggagcatgcccgagagcctggacagcccaacctctggcagaccaggggttaccagcctcacagctgcagctgccttcaagcctgtaggatccactggcgtcatcaagtcaccaagctggcaacggccaaaccaaggagtaccttccactggaagaatctcaaacagcgctacttactcaggatcagtggcaccagccaactcagctttgggacaaacccagccaagtgaccaggacactttagtgcaaagagctgagcacattccagcagggaaacgaactccgatgtgcgcccattgtaaccaggtcatcagaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggagaagtcatcagtgcgttgaaacaaacttggcatgtttcctgttttgtgtgtgtagcctgtggaaagcccattcggaacaatgtttttcacttggaggatggtgaaccctactgtgagactgattattatgccctctttggtactatatgccatggatgtgaatttcccatagaagctggtgacatgttcctggaagctctgggctacacctggcatgacacttgctttgtatgctcagtgtgttgtgaaagtttggaaggtcagacctttttctccaagaaggacaagcccctgtgtaagaaacatgctcattctgtgaatttttgaaagtcaacagttcaggagaagagaaggaatttgaagagaaaaaggaaaattaaaattactaattaatttttagattcaatatttatatggagttttgaaaaataatagtggccctgaaggaataaattccagctttaaaaaccaagtctgaggaaatatttggcttcataaagtaaagagacggtttggcatttattattactttttcctgtattttatgcccataaaataagctttataaaaaccaatttcctgatggactattaaattcatcttagaataaattagtgaagaatttaattttagaataaataatccaatctgaaataattataccttctttccttgttaggtagttatgagtaaatctgcaaaaggcaatgaaaatgccttaaattttatcaataacagaattattgtatttaaaaaaaaactaatacttatctttaaaatagtaaataggattttaaacagagaattttatcagtaataggtgtcagtttttaaaaaattgcttgtaggctgagcgcggtggctcacgcctgtaatcccagcactttgggaggccaaggtgggtggaccacatgaggtcaggagtttgagatcagcctggccaacatggtgaaaccccatctctactaaaaatacaaaaattagccggacgcagtggcacgcgcctgtaatcccagctactcaagaggctgaggcacgagaatcacttgaacccgggagggagaggttgcagtgagccaagatcgtaccactgcactccagcctgggtgacagagtgagactctgtctccaaaaaaaaactttgcttgtatattatttttgccttacagtggatcattctagtaggaaaggacaataagattttttatcaaaatgtgtcatgccagtaagagatgttatattcttttctcatttcttccccacccaaaaataagctaccatatagcttataagtctcaaatttttgccttttactaaaatgtgattgtttctattcattgtgtatgcttcatcacctatattaggcaaattccatttttttcccttgtgctaaggtaaagatttaattaaataattttggcctctcatagttttctctctctttaaagagaataaatagagggccaggtgtggtggctcacgcctgtgatcccagcactttgggaggccaagacgggcggatcatgaggtcaagagatcaagatcatcctggccaacatggtgaaaccctgtctctactaaaaatacaaaaatgagctgggcatggtggggcgtgcctgtagtcccatgtacttgggaggctgaggcaggaaaattcttgaacccaggagacggaagttgcagtgagctgagatcacaccactgcactccagcctggtgacagagcaagactccggctcttaaaaaaaaaaaaaaaaaaa

SEQ ID NO: 164073 - DNA, 6219 bp, Homo sapiens
  Payload ID: 12301
  Gene Symbol: PDLIM5
  Gene Name: PDZ and LIM domain 5
  Uniprot ID: Q96HC4
  ENST ID: ENST00000615540
  CDS Start-End: 182-2059
gtgtcctgggtcgggggtggggcgagggagagccaggaggcggaagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagcccacagtcaccagcgtgtgttccgagacttctcaggagctagcagagggacagagaagaggatcccagggtgacagtaaacagcaaaatgggaaaatcccacctaaacgcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaagtttgacagtgctctggaagacctacctaagagtggacctcaccctcctgcaactcctcaggtgttaactattggtagccaagtggccacactttctaaagtagcaactacttattctagtttaagcagctccacaggaaatgtggaagattctttcgaaggttttcgaaacttttctaccttctcttctcctgctagatatagtgctgcagttctgagcagcgcagctgctactgtgtctgctgttattgctacaaaaaccaggctctacactcctgaaagatatcactcactcctggatgcactttgcatcagccctgtctccaagcctttagctttttcctatctgcagtcctcaaggaaatcaactggctctatccatgttaagaaaacaagtaactctcaggagccttctccgcagttggcttcctcggtagcttccacacggagcatgcccgagagcctggacagcccaacctctggcagaccaggggttaccagcctcacagctgcagctgccttcaagcctgtaggatccactggcgtcatcaagtcaccaagctggcaacggccaaaccaaggagtaccttccactggaagaatctcaaacagcgctacttactcaggatcagtggcaccagccaactcagctttgggacaaacccagccaagtgaccaggacactttagtgcaaagagctgagcacattccagcagggaaacgaactccgatgtgcgcccattgtaaccaggtcatcagaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggagaagtcatcagtgcgttgaaacaaacttggcatgtttcctgttttgtgtgtgtagcctgtggaaagcccattcggaacaatgtttttcacttggaggatggtgaaccctactgtgagactgattattatgccctctttggtactatatgccatggatgtgaatttcccatagaagctggtgacatgttcctggaagctctgggctacacctggcatgacacttgctttgtatgctcagtgtgttgtgaaagtttggaaggtcagacctttttctccaagaaggacaagcccctgtgtaagaaacatgctcattctgtgaatttttgaaagtcaacagttcaggagaagagaaggaatttgaagagaaaaaggaaaattaaaattactaattaatttttagattcaatatttatatggagttttgaaaaataatagtggccctgaaggaataaattccagctttaaaaaccaagtctgaggaaatatttggcttcataaagtaaagagacggtttggcatttattattactttttcctgtattttatgcccataaaataagctttataaaaaccaatttcctgatggactattaaattcatcttagaataaattagtgaagaatttaattttagaataaataatccaatctgaaataattataccttctttccttgttaggtagttatgagtaaatctgcaaaaggcaatgaaaatgccttaaattttatcaataacagaattattgtatttaaaaaaaaactaatacttatctttaaaatagtaaataggattttaaacagagaattttatcagtaataggtgtcagtttttaaaaaattgcttgtaggctgagcgcggtggctcacgcctgtaatcccagcactttgggaggccaaggtgggtggaccacatgaggtcaggagtttgagatcagcctggccaacatggtgaaaccccatctctactaaaaatacaaaaattagccggacgcagtggcacgcgcctgtaatcccagctactcaagaggctgaggcacgagaatcacttgaacccgggagggagaggttgcagtgagccaagatcgtaccactgcactccagcctgggtgacagagtgagactctgtctccaaaaaaaaactttgcttgtatattatttttgccttacagtggatcattctagtaggaaaggacaataagattttttatcaaaatgtgtcatgccagtaagagatgttatattcttttctcatttcttccccacccaaaaataagctaccatatagcttataagtctcaaatttttgccttttactaaaatgtgattgtttctattcattgtgtatgcttcatcacctatattaggcaaattccatttttttcccttgtgctaaggtaaagatttaattaaataattttggcctctcatagttttctctctctttaaagagaataaatagagggccaggtgtggtggctcacgcctgtgatcccagcactttgggaggccaagacgggcggatcatgaggtcaagagatcaagatcatcctggccaacatggtgaaaccctgtctctactaaaaatacaaaaatgagctgggcatggtggggcgtgcctgtagtcccatgtacttgggaggctgaggcaggaaaattcttgaacccaggagacggaagttgcagtgagctgagatcacaccactgcactccagcctggtgacagagcaagactccggctcttaaaaaaaaaaaaaaaaaaaaaaaaagagagagagagaataaatagaaaagaatgtggctgggaattgtgaatcagaagattataccccccaattgtttttcaatccccttttctcaaataataaattagttaaatcagtttctgagttatgccactggctgatgaagagttgagaggtctctttgcagaatgatctttttgtttcgttttgtttcttcttctgcatttaaaaattaaaagattggtttgaggatgtgatgaaattgagactttttgtggttttctctcaataataagtgaaccaatttcaaatgtgatcacaaagtttggaaagcttttattcacagaggttgggtagtgttgggaggggagtttaattactcagattggcctgttatttgatttcctcctttgggaaaagaattatgtagataccacatggagacagggaaacaattgtggtaaaactgtggatcctgttgctatttgcccagtgagaaaacagattctggtatttgatttggtttttctctttgtttccagaatggatgaaagtccatgaacctcctaagttataatttaaatttgtttggggcaaggtgattttatagtcgagacagagccctaggtccttcctgccccatcactcacttacgacatcacttccattgtgtgcatgtttgttatagaggaggttttaggctacaatatttgtttaacctccctaagaactttcaaggcatctgtcctgaaagctgttaatttatggtctagcagatttatattatatgcagataataattaactggggataaaagaatggcaaggggtgacacaaagtagcaaactgaatacttctccaatagcaaccccaagctacctcctcaccctgcatcttggagggaggcaggaaatttcttttgaaataaagtgctggagctgaattctgcattatttatcgttgctgctgaaaccacctataaaagacttgctggctaatgtgcattgtcatataatgtacactgtcacatctttacagtcttgtatgttatagaatacaaaataagttgatggttttgtttggtgtgagctttttgtttgtttgtttagttttgccttcataggttatatgccaagatagtatttgataagtcaatgacatttggatgttttcttcaaagaattttatttgacccagatttcttataaagttatcttacattaaggatgtcattttcatcagaccttctttctacatattattcatgaagcataatgttgcatttctccaaattttatgcctgaaagggtagtgttgcttcctaaggtatcatgttgtctttgtgctttgtccatctcttccgtggcgaagctttatatctgttcctaaaacagttaatcctgtgaaataaatattgaacataatccagaagaatctctctgtttcccttggggaatgccatatttaattcaccagcagtaatcctttaataactggcagagcactttattcttctggtgagctccctgaatatttatttttctgattataaattttctatattagtagcattttttaattattacttcttcactatagagcatttacttttagtctctagatgtatattttggaatgctgtacttggcataacatagattaaaatcataatgcatgactaaaaactccttggatttatttcccattttaaaatttttagcggtaagttcagatttataatctttctctagacttccatggtctgaatgttgcctgctgaagtagcaacctaaaaagtatcccctgcttatgcttgtccagttggccctccatgtccataggcttcgcatctgtgattcagcccactgtgggtcaaaaatatttggggaaaaaaatggatggttgcgcctttgctgaacatgtacaaacttttttttgtcattaaacaatatagtataacaactatttacaaagcatttacattgtattagctattataggtaatctagagatgatttaaagtgtatggtaggatgtgcataggttatatgcaaatactacaccattttctataagggacttgaacatcatggactttagtatcctagggggttcttggaacccatcacccataggggcaccataggacaactatagtaccgtgtttatttcctattaattcaggttccgtttagagtctaaaactaaaacctaatcatttagtcacagtgtaaaaacaaatggaaataacagctcaaatcttcaaaatattactatagcattatgtttaaaataatctacaacaaaaatgtaccattttcaagcagtactacattaggagcccttttatagaaaataatttcttctttacccccgttccagtgtgaatctagtattctgttaacatttgtgtggcatttggagtttgtcatccccattgaagggagagccttctcagacatgaagcaagggaaacatactgaatagttttacacaaatttgatctggcttccatttgtccccctcatttcccaaatgtttaaatgtattggatttggattctcaatgtataagttgccttatctgttaatgtctatcttctgtctctttaattttgtatatctgctgttttgcttttggatacattttctaattagaagtcacatgataaatataatcagtatagtaataataccataatgtgcacatactcaataaataaatgactgcattgttgtaaatgag

SEQ ID NO: 164074 - DNA, 554 bp, Homo sapiens
  Payload ID: 12301
  Gene Symbol: PDLIM5
  Gene Name: PDZ and LIM domain 5
  ENST ID: ENST00000510099
  CDS Start-End: 25-554
attccagaagatgctccttttggaatggtcataaagctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagggagaacctaaagaagtagttaaacctgtgcccattacatctcctgctgtgtccaaagtcacttccacaaacaacatggcctacaataaggcaccacggccttttggttctgtgtcttcaccaaaagtcacatccatcccatcaccatcgtctgccttcaccccagcccatgcgaccacctcatcacatgcttccccttcacccgtggctgccgtcactcctcccctgttcgctgcatctggactgcatgctaatgccaatcttagtgctgaccagtctccatctgcactgagcgctggtaaaactgcagttaatgtcccacg

SEQ ID NO: 164075 - DNA, 1853 bp, Homo sapiens
  Payload ID: 12301
  Gene Symbol: PDLIM5
  Gene Name: PDZ and LIM domain 5
  ENST ID: ENST00000627587
  CDS Start-End: 96-215
cttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtagcatctgctgcacccaagcctgagccggttcctgttcaaaagggagaacctaaagaagtagttaaacctgtgcccattacatctcctgctgtgtccaaagtcacttccacaaacaacatggcctacaataaggcaccacggccttttggttctgtgtcttcaccaaaagtcacatccatcccatcaccatcgtctgccttcaccccagcccatgcgaccacctcatcacatgcttccccttcacccgtggctgccgtcactcctcccctgttcgctgcatctggactgcatgctaatgccaatcttagtgctgaccagtctccatctgcactgagcgctggtaaaactgcagttaatgtcccacggcagcccacagtcaccagcgtgtgttccgagacttctcaggagctagcagagggacagagaagaggatcccagggtgacagtaaacagcaaaatggcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaataactctcaggagccttctccgcagttggcttcctcggtagcttccacacggagcatgcccgagagcctggacagcccaacctctggcagaccaggggttaccagcctcacagctgcagctgccttcaagcctgtaggatccactggcgtcatcaagtcaccaagctggcaacggccaaaccaaggagtaccttccactggaagaatctcaaacagcgctacttactcaggatcagtggcaccagccaactcagctttgggacaaacccagccaagtgaccaggacactttagtgcaaagagctgagcacattccagcagggaaacgaactccgatgtgcgcccattgtaaccaggtcatcagaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggagaagtcatcagtgcgttgaaacaaacttggcatgtttcctgttttgtgtgtgtagcctgtggaaagcccattcggaacaatgtttttcacttggaggatggtgaaccctactgtgagactgattattatgccctctttggtactatatgccatggatgtgaatttcccatagaagctggtgacatgttcctggaagctctgggctacacctggcatgacacttgctttgtatgctcagtgtgttgtgaaagtttggaaggtcagacctttttctccaagaaggacaagcccctgtgtaagaaacatgctcattctgtgaatttttgaaagtcaacagttcaggagaagagaaggaatttgaagagaaaaaggaaaattaaaattactaattaatttttagattcaatatttatatggagttttgaaaaataatagtggccctgaag

SEQ ID NO: 164076 - DNA, 977 bp, Homo sapiens
  Payload ID: 12302
  Gene Symbol: PDLIM7
  Gene Name: PDZ and LIM domain 7 (enigma)
  Uniprot ID: Q9NR12
  ENST ID: ENST00000355572
  CDS Start-End: 58-726
ctccctggagcccgacgcagagcagcgccctggccgggccaagcaggagccggcatcatggattccttcaaagtagtgctggaggggccagcaccttggggcttccggctgcaagggggcaaggacttcaatgtgcccctctccatttcccggctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcagggcccagccggttcagagcaaaccgcagaaggcctccgcccccgccgcggaccctccgcggtacacctttgcacccagcgtctccctcaacaagacggcccggccctttggggcgcccccgcccgctgacagcgccccgcagcagaatggacagccgctccgaccgctggtcccagatgccagcaagcagcggctgatggagaacacagaggactggcggccgcggccggggacaggccagtcgcgttccttccgcatccttgcccacctcacaggcaccgagttcatgcaagacccggatgaggagcacctgaagaaatcaagggaaaagtatgtcctggagctgcagagcccacgctacacccgcctccgggactggcaccaccagcgctctgcccacgtgctcaacgtgcagtcgtagcccggccctctccagccggctgccctctctgcctccctctttctgttcctcctgcccagggcacccccttagtgcctccagcttctgcctacctcaccccccctttcgtgcccctggcctgagcctcctgctggcctggccctggccgcccacctgggttcatctgacactgccttccctctttgccctgtggtactgctgtctgccaggtctgtgctgccttgggcatggaataaacattctcagccctg

SEQ ID NO: 164077 - DNA, 1689 bp, Homo sapiens
  Payload ID: 12302
  Gene Symbol: PDLIM7
  Gene Name: PDZ and LIM domain 7 (enigma)
  Uniprot ID: Q9NR12
  ENST ID: ENST00000355841
  CDS Start-End: 68-1441
cccaacgaggctccctggagcccgacgcagagcagcgccctggccgggccaagcaggagccggcatcatggattccttcaaagtagtgctggaggggccagcaccttggggcttccggctgcaagggggcaaggacttcaatgtgcccctctccatttcccggctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcagggcccagccggttcagagcaaaccgcagaaggcctccgcccccgccgcggaccctccgcggtacacctttgcacccagcgtctccctcaacaagacggcccggccctttggggcgcccccgcccgctgacagcgccccgcagcagaatggacagccgctccgaccgctggtcccagatgccagcaagcagcggctgatggagaacacagaggactggcggccgcggccggggacaggccagtcgcgttccttccgcatccttgcccacctcacaggcaccgagttcatgcaagacccggatgaggagcacctgaagaaatcaagccaggtgcccaggacagaagccccagccccagcctcatctacaccccaggagccctggcctggccctaccgcccccagccctaccagccgcccgccctgggctgtggaccctgcgtttgccgagcgctatgccccggacaaaacgagcacagtgctgacccggcacagccagccggccacgcccacgccgctgcagagccgcacctccattgtgcaggcagctgccggaggggtgccaggagggggcagcaacaacggcaagactcccgtgtgtcaccagtgccacaaggtcatccggggccgctacctggtggcgctgggccacgcgtaccacccggaggagtttgtgtgtagccagtgtgggaaggtcctggaagagggtggcttctttgaggagaagggcgccatcttctgcccaccatgctatgacgtgcgctatgcacccagctgtgccaagtgcaagaagaagattacaggcgagatcatgcacgccctgaagatgacctggcacgtgcactgctttacctgtgctgcctgcaagacgcccatccggaacagggccttctacatggaggagggcgtgccctattgcgagcgagactatgagaagatgtttggcacgaaatgccatggctgtgacttcaagatcgacgctggggaccgcttcctggaggccctgggcttcagctggcatgacacctgcttcgtctgtgcgatatgtcagatcaacctggaaggaaagaccttctactccaagaaggacaggcctctctgcaagagccatgccttctctcatgtgtgagccccttctgcccacagctgccgcggtggcccctagcctgaggggcctggagtcgtggccctgcatttctgggtagggctggcaatggttgccttaaccctggctcctggcccgagcctggggctccctgggccctgccccacccaccttatcctcccaccccactccctccaccaccacagcacaccggtgctggccacaccagccccctttcacctccagtgccacaataaacctgtacccagctg

SEQ ID NO: 164078 - DNA, 1567 bp, Homo sapiens
  Payload ID: 12302
  Gene Symbol: PDLIM7
  Gene Name: PDZ and LIM domain 7 (enigma)
  Uniprot ID: Q9NR12
  ENST ID: ENST00000359895
  CDS Start-End: 46-1317
cgacgcagagcagcgccctggccgggccaagcaggagccggcatcatggattccttcaaagtagtgctggaggggccagcaccttggggcttccggctgcaagggggcaaggacttcaatgtgcccctctccatttcccggctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcagggcccagccggttcagagcaaaccgcagaaggtgcagacccctgacaaacagccgctccgaccgctggtcccagatgccagcaagcagcggctgatggagaacacagaggactggcggccgcggccggggacaggccagtcgcgttccttccgcatccttgcccacctcacaggcaccgagttcatgcaagacccggatgaggagcacctgaagaaatcaagccaggtgcccaggacagaagccccagccccagcctcatctacaccccaggagccctggcctggccctaccgcccccagccctaccagccgcccgccctgggctgtggaccctgcgtttgccgagcgctatgccccggacaaaacgagcacagtgctgacccggcacagccagccggccacgcccacgccgctgcagagccgcacctccattgtgcaggcagctgccggaggggtgccaggagggggcagcaacaacggcaagactcccgtgtgtcaccagtgccacaaggtcatccggggccgctacctggtggcgctgggccacgcgtaccacccggaggagtttgtgtgtagccagtgtgggaaggtcctggaagagggtggcttctttgaggagaagggcgccatcttctgcccaccatgctatgacgtgcgctatgcacccagctgtgccaagtgcaagaagaagattacaggcgagatcatgcacgccctgaagatgacctggcacgtgcactgctttacctgtgctgcctgcaagacgcccatccggaacagggccttctacatggaggagggcgtgccctattgcgagcgagactatgagaagatgtttggcacgaaatgccatggctgtgacttcaagatcgacgctggggaccgcttcctggaggccctgggcttcagctggcatgacacctgcttcgtctgtgcgatatgtcagatcaacctggaaggaaagaccttctactccaagaaggacaggcctctctgcaagagccatgccttctctcatgtgtgagccccttctgcccacagctgccgcggtggcccctagcctgaggggcctggagtcgtggccctgcatttctgggtagggctggcaatggttgccttaaccctggctcctggcccgagcctggggctccctgggccctgccccacccaccttatcctcccaccccactccctccaccaccacagcacaccggtgctggccacaccagccccctttcacctccagtgccacaataaacctgtacccagctgtg

SEQ ID NO: 164079 - DNA, 671 bp, Homo sapiens
  Payload ID: 12302
  Gene Symbol: PDLIM7
  Gene Name: PDZ and LIM domain 7 (enigma)
  ENST ID: ENST00000393546
  CDS Start-End: 86-671
agaacactggcggccgatcccaacgaggctccctggagcccgacgcagagcagcgccctggccgggccaagcaggagccggcatcatggattccttcaaagtagtgctggaggggccagcaccttggggcttccggctgcaagggggcaaggacttcaatgtgcccctctccatttcccggctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcagggcccagccggttcagagcaaaccgcagaaggcccccaccttaccctgcccgcccgccctgcccggctgtgtctctgcccaggcctccgcccccgccgcggaccctccgcggtacacctttgcacccagcgtctccctcaacaagacggcccggccctttggggcgcccccgcccgctgacagcgccccgcagcagaatggacagccgctccgaccgctggtcccagatgccagcaagcagcggctgatggagaacacagaggactggcggccgcggccggggacaggccagtcgcgttccttccgcatccttgcccacctcacaggcaccgagttca

SEQ ID NO: 164080 - DNA, 1226 bp, Homo sapiens
  Payload ID: 12302
  Gene Symbol: PDLIM7
  Gene Name: PDZ and LIM domain 7 (enigma)
  Uniprot ID: Q9NR12
  ENST ID: ENST00000393551
  CDS Start-End: 68-931
cccaacgaggctccctggagcccgacgcagagcagcgccctggccgggccaagcaggagccggcatcatggattccttcaaagtagtgctggaggggccagcaccttggggcttccggctgcaagggggcaaggacttcaatgtgcccctctccatttcccggctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcagggcccagccggttcagagcaaaccgcagaaggcctccgcccccgccgcggaccctccgcggtacacctttgcacccagcgtctccctcaacaagacggcccggccctttggggcgcccccgcccgctgacagcgccccgcagcagaatggacagccgctccgaccgctggtcccagatgccagcaagcagcggctgatggagaacacagaggactggcggccgcggccggggacaggccagtcgcgttccttccgcatccttgcccacctcacaggcaccgagttcatgcaagacccggatgaggagcacctgaagaaatcaaggccctaccgcccccagccctaccagccgcccgccctgggctgtggaccctgcgtttgccgagcgctatgccccggacaaaacgagcacagtgctgacccggcacagccagccggccacgcccacgccgctgcagagccgcacctccattgtgcaggcagctgccggaggggtgccaggagggggcagcaacaacggcaagactcccgtgtgtcaccagtgccacaaggtcatccggggccgctacctggtggcgctgggccacgcgtaccacccggaggagtttgtgtgtagccagtgtgggaaggtcctggaagagggtggcttctttgaggagaagggcgccatcttctgcccaccatgctatgacgtgcgctatgcacccagctgtgccaagtgcaagaagaagattacaggcgtgagtagggctggctggcggggaggtggtcccaagcctgtcagtgggaacgagggctgctgggaaacccacagtccaggtctctccccgagtgagccctccgggtccttaccagcgtaataaatgggctgctgtactggcctcaccctgcattagtcaggatgctcttaa

SEQ ID NO: 164081 - DNA, 636 bp, Homo sapiens
  Payload ID: 12302
  Gene Symbol: PDLIM7
  Gene Name: PDZ and LIM domain 7 (enigma)
  ENST ID: ENST00000506537
  CDS Start-End: 366-636
ccggcccctgactcacccggccgcccgaggctccaggctggcttggggggaggccgcgccagtttagtccctcggcccacccctggttgcaaagaacctcaagcctggattcaggcacccctcaccgttccagtcccaaggggaggggggctgctcctgtctttccaaagtgaggtccgccagccagcagcccaggccagcctgacaaaatacctgcctcctatggcttgggcgtgctcaggggctgcccgtgcctgcctggcccctgtccaaggctggtatcctgagctggcccggcctgcctgcctgcccgcccaccatgctggccactcaccttctcttctctcctctcaggagccggcatcatggattccttcaaagtagtgctggaggggccagcaccttggggcttccggctgcaagggggcaaggacttcaatgtgcccctctccatttcccggctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcagggcccagccggttcagagcaaac

SEQ ID NO: 164082 - DNA, 451 bp, Homo sapiens
  Payload ID: 12302
  Gene Symbol: PDLIM7
  Gene Name: PDZ and LIM domain 7 (enigma)
  ENST ID: ENST00000503827
  CDS Start-End: 1-362
ccatttcccggctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcagggcccagccggttcagagcaaaccgcagaaggcgccccacttccacccaggcccccaccttaccctgcccgcccgccctgcccggctgtgtctctgcccaggcctccgcccccgccgcggaccctccgcggtacacctttgcacccagcgtctccctcaacaagacggcccggccctttggggcgcccccgcccgctgacagcgccccgcagcagaatgggtgcagacccctgacaaacagccgctccgaccgctggtcccagatgccagcaagcagcggctgatgga

SEQ ID NO: 164083 - DNA, 759 bp, Homo sapiens
  Payload ID: 12302
  Gene Symbol: PDLIM7
  Gene Name: PDZ and LIM domain 7 (enigma)
  ENST ID: ENST00000506161
  CDS Start-End: 240-759
ggggaggccgcgccagtttagtccctcggcccacccctggttgcaaagaacctcaagcctggattcaggcacccctcaccgttccagtcccaaggggaggggggctgctcctgtctttccaaagtgaggtccgccagccagcagcccaggccagcctgacaaaatacctgcctcctatggcttgggcgtgctcaggggctgcccgtgcctgcctggcccctgtccaaggagccggcatcatggattccttcaaagtagtgctggaggggccagcaccttggggcttccggctgcaagggggcaaggacttcaatgtgcccctctccatttcccggctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcagggcccagccggttcagagcaaaccgcagaaggcctccgcccccgccgcggaccctccgcggtacacctttgcacccagcgtctccctcaacaagacggcccggccctttggggcgcccccgcccgctgacagcgccccgcagcagaatggacagccgctccgaccgctggtcccagatgccagcaagcagcggctgatggagaacacagaggactggcggccgcggccggggacaggccagtcgcgttccttccgcatccttgcccacctca

SEQ ID NO: 164084 - DNA, 931 bp, Homo sapiens
  Payload ID: 12302
  Gene Symbol: PDLIM7
  Gene Name: PDZ and LIM domain 7 (enigma)
  ENST ID: ENST00000505074
  CDS Start-End: 71-931
gatcccaacgaggctccctggagcccgacgcagagcagcgccctggccgggccaagcaggagccggcatcatggattccttcaaagtagtgctggaggggccagcaccttggggcttccggctgcaagggggcaaggacttcaatgtgcccctctccatttcccggctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcagggcccagccggttcagagcaaaccgcagaaggcctccgcccccgccgcggaccctccgcggtacacctttgcacccagcgtctccctcaacaagacggcccggccctttggggcgcccccgcccgctgacagcgccccgcagcagaatggacagccgctccgaccgctggtcccagatgccagcaagcagcggctgatggagaacacagaggactggcggccgcggccggggacaggccagtcgcgttccttccgcatccttgcccacctcacaggcaccgagttcatgcaagacccggatgaggagcacctgaagaaatcaagatggcttcctggcatgaggggaaccccaggagctgcctcagaagcgggagccctgcctcgtctcccagctagagaccgcacaccagctaactggacattgctaggagaagctgcccttcccatccctaccccagtgggacctggaatccaactcggcagtttccacgcccccagtcatctcccgtggggccagcaggacccaggttggggggtggggccatgtcaggaagctcagccatgcagggccttgaatggcagatcttgcagccaggtgcccaggacagaagcc

SEQ ID NO: 164085 - DNA, 1686 bp, Homo sapiens
  Payload ID: 12302
  Gene Symbol: PDLIM7
  Gene Name: PDZ and LIM domain 7 (enigma)
  Uniprot ID: Q9NR12
  ENST ID: ENST00000493815
  CDS Start-End: 46-507
cgacgcagagcagcgccctggccgggccaagcaggagccggcatcatggattccttcaaagtagtgctggaggggccagcaccttggggcttccggctgcaagggggcaaggacttcaatgtgcccctctccatttcccggctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcagggcccagccggttcagagcaaaccgcagaaggcctccgcccccgccgcggaccctccgcggtacacctttgcacccagcgtctccctcaacaagacggcccggccctttggggcgcccccgcccgctgacagcgccccgcagcagaatgggtgcagacccctgacaaacagccgctccgaccgctggtcccagatgccagcaagcagcggctgatggagaacacagaggactggcggccgcggccggggacaggccagtcgcgttccttccgcatccttgcccacctcacaggcaccgagttcatgcaagacccggatgaggagcacctgaagaaatcaagccaggtgcccaggacagaagccccagccccagcctcatctacaccccaggagccctggcctggccctaccgcccccagccctaccagccgcccgccctgggctgtggaccctgcgtttgccgagcgctatgccccggacaaaacgagcacagtgctgacccggcacagccagccggccacgcccacgccgctgcagagccgcacctccattgtgcaggcagctgccggaggggtgccaggagggggcagcaacaacggcaagactcccgtgtgtcaccagtgccacaaggtcatccggggccgctacctggtggcgctgggccacgcgtaccacccggaggagtttgtgtgtagccagtgtgggaaggtcctggaagagggtggcttctttgaggagaagggcgccatcttctgcccaccatgctatgacgtgcgctatgcacccagctgtgccaagtgcaagaagaagattacaggcgagatcatgcacgccctgaagatgacctggcacgtgcactgctttacctgtgctgcctgcaagacgcccatccggaacagggccttctacatggaggagggcgtgccctattgcgagcgagactatgagaagatgtttggcacgaaatgccatggctgtgacttcaagatcgacgctggggaccgcttcctggaggccctgggcttcagctggcatgacacctgcttcgtctgtgcgatatgtcagatcaacctggaaggaaagaccttctactccaagaaggacaggcctctctgcaagagccatgccttctctcatgtgtgagccccttctgcccacagctgccgcggtggcccctagcctgaggggcctggagtcgtggccctgcatttctgggtagggctggcaatggttgccttaaccctggctcctggcccgagcctggggctccctgggccctgccccacccaccttatcctcccaccccactccctccaccaccacagcacaccggtgctggccacaccagccccctttcacctccagtgccacaataaacctgtacccagctgtg

SEQ ID NO: 164086 - DNA, 1904 bp, Homo sapiens
  Payload ID: 12302
  Gene Symbol: PDLIM7
  Gene Name: PDZ and LIM domain 7 (enigma)
  Uniprot ID: Q9NR12
  ENST ID: ENST00000486828
  CDS Start-End: 86-661
agaacactggcggccgatcccaacgaggctccctggagcccgacgcagagcagcgccctggccgggccaagcaggagccggcatcatggattccttcaaagtagtgctggaggggccagcaccttggggcttccggctgcaagggggcaaggacttcaatgtgcccctctccatttcccggctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcagggcccagccggttcagagcaaaccgcagaaggcctccgcccccgccgcggaccctccgcggtacacctttgcacccagcgtctccctcaacaagacggcccggccctttggggcgcccccgcccgctgacagcgccccgcagcagaatggacagccgctccgaccgctggtcccagatgccagcaagcagcggctgatggagaacacagaggactggcggccgcggccggggacaggccagtcgcgttccttccgcatccttgcccacctcacaggcaccgagttcatgcaagacccggatgaggagcacctgaagaaatcaagctagagaccgcacaccagctaactggacattgctaggagaagctgcccttcccatccctaccccagtgggacctggaatccaactcggcagtttccacgcccccagtcatctcccgtggggccagcaggacccaggttggggggtggggccatgtcaggaagctcagccatgcagggccttgaatggcagatcttgcagccaggtgcccaggacagaagccccagccccagcctcatctacaccccaggagccctggcctggccctaccgcccccagccctaccagccgcccgccctgggctgtggaccctgcgtttgccgagcgctatgccccggacaaaacgagcacagtgctgacccggcacagccagccggccacgcccacgccgctgcagagccgcacctccattgtgcaggcagctgccggaggggtgccaggagggggcagcaacaacggcaagactcccgtgtgtcaccagtgccacaaggtcatccggggccgctacctggtggcgctgggccacgcgtaccacccggaggagtttgtgtgtagccagtgtgggaaggtcctggaagagggtggcttctttgaggagaagggcgccatcttctgcccaccatgctatgacgtgcgctatgcacccagctgtgccaagtgcaagaagaagattacaggcgagatcatgcacgccctgaagatgacctggcacgtgcactgctttacctgtgctgcctgcaagacgcccatccggaacagggccttctacatggaggagggcgtgccctattgcgagcgagactatgagaagatgtttggcacgaaatgccatggctgtgacttcaagatcgacgctggggaccgcttcctggaggccctgggcttcagctggcatgacacctgcttcgtctgtgcgatatgtcagatcaacctggaaggaaagaccttctactccaagaaggacaggcctctctgcaagagccatgccttctctcatgtgtgagccccttctgcccacagctgccgcggtggcccctagcctgaggggcctggagtcgtggccctgcatttctgggtagggctggcaatggttgccttaaccctggctcctggcccgagcctggggctccctgggccctgccccacccaccttatcctcccaccccactccctccaccaccacagcacaccggtgctggccacaccagccccctttcacctccagtgccacaataaacctgtacccagc

SEQ ID NO: 164087 - DNA, 2118 bp, Homo sapiens
  Payload ID: 12303
  Gene Symbol: PBK
  Gene Name: PDZ binding kinase
  Uniprot ID: Q96KB5
  ENST ID: ENST00000301905
  CDS Start-End: 465-1433
ataatcacgacacattcaacacagatgtgagcgtttggagagagcttcagccttcagcacaggcaactgtgttctattcaccgggctgtgctcctcggaagggctggtggttcctgtaaaagtttgtgctccccgcgcctttccttccttccctcgtctttggcgcctgcgggcaccgggagtcctgggagagggaggaggaacggcgaatcggcggggcgtgtccttcacgccgccccgtagctcggggccgaagctggcgcagcgcgcgactttttgaaagccaggagggttcgaattgcaacggcagctgccgggcgtatgtgttggtgctagaggcagctgcagggtctcgctgggggccgctcgggaccaattttgaagaggtacttggccacgacttattttcacctccgacctttccttccaggcggtgagactctggactgagagtggctttcacaatggaagggatcagtaatttcaagacaccaagcaaattatcagaaaaaaagaaatctgtattatgttcaactccaactataaatatcccggcctctccgtttatgcagaagcttggctttggtactggggtaaatgtgtacctaatgaaaagatctccaagaggtttgtctcattctccttgggctgtaaaaaagattaatcctatatgtaatgatcattatcgaagtgtgtatcaaaagagactaatggatgaagctaagattttgaaaagccttcatcatccaaacattgttggttatcgtgcttttactgaagccaatgatggcagtctgtgtcttgctatggaatatggaggtgaaaagtctctaaatgacttaatagaagaacgatataaagccagccaagatccttttccagcagccataattttaaaagttgctttgaatatggcaagagggttaaagtatctgcaccaagaaaagaaactgcttcatggagacataaagtcttcaaatgttgtaattaaaggcgattttgaaacaattaaaatctgtgatgtaggagtctctctaccactggatgaaaatatgactgtgactgaccctgaggcttgttacattggcacagagccatggaaacccaaagaagctgtggaggagaatggtgttattactgacaaggcagacatatttgcctttggccttactttgtgggaaatgatgactttatcgattccacacattaatctttcaaatgatgatgatgatgaagataaaacttttgatgaaagtgattttgatgatgaagcatactatgcagcgttgggaactaggccacctattaatatggaagaactggatgaatcataccagaaagtaattgaactcttctctgtatgcactaatgaagaccctaaagatcgtccttctgctgcacacattgttgaagctctggaaacagatgtctagtgatcatctcagctgaagtgtggcttgcgtaaataactgtttattccaaaatatttacatagttactatcagtagttattagactctaaaattggcatatttgaggaccatagtttcttgttaacatatggataactatttctaatatgaaatatgcttatattggctataagcacttggaattgtactgggttttctgtaaagttttagaaactagctacataagtactttgatactgctcatgctgacttaaaacactagcagtaaaacgctgtaaactgtaacattaaattgaatgaccattacttttattaatgatctttcttaaatattctatattttaatggatctactgacattagcactttgtacagtacaaaataaagtctacatttgtttaaaacactgaaccttttgctgatgtgtttatcaaatgataactggaagctgaggagaatatgcctcaaaaagagtagctccttggatacttcagactctggttacagattgtcttgatctcttggatctcctcagatctttggtttttgctttaatttattaaatgtattttccatactgagtttaaaatttattaatttgtaccttaagcatttcccagctgtgtaaaaacaataaaactcaaataggatgataaagaataaaggacactttgggtaccagaag

SEQ ID NO: 164088 - DNA, 748 bp, Homo sapiens
  Payload ID: 12303
  Gene Symbol: PBK
  Gene Name: PDZ binding kinase
  ENST ID: ENST00000521226
  CDS Start-End: 295-748
ggagggttcgaattgcaacggcagctgccgggcgtatgtgttggtgctagaggcagctgcagggtctcgctgggggccgctcgggaccaattttgaagaggtacttggccacgacttattttcacctccgacctttccttccaggcggtgagactctggactgagagtggctttcacaatggaagggatcagtaatttcaagacaccaagcaaattatcagaaaaaaagaaatctggtaagatagcagattattatgttcaactccaactataaatatcccggcctctccgtttatgcagaagcttggctttggtactggggtaaatgtgtacctaatgaaaagatctccaagaggtttgtctcattctccttgggctgtaaaaaagattaatcctatatgtaatgatcattatcgaagtgtgtatcaaaagagactaatggatgaagctaagattttgaaaagccttcatcatccaaacattgttggttatcgtgcttttactgaagccaatgatggcagtctgtgtcttgctatggaatatggaggtgaaaagtctctaaatgacttaatagaagaacgatataaagccagccaagatccttttccagcagccataattttaaaagttgctttgaatatggcaagagggttaaagtatctgcaccaagaaaagaaactgcttcatggagacataaagtcttcaaatgttgtaattaaaggcgattttgaaacaattaaaatctgtg

SEQ ID NO: 164089 - DNA, 819 bp, Homo sapiens
  Payload ID: 12303
  Gene Symbol: PBK
  Gene Name: PDZ binding kinase
  ENST ID: ENST00000524266
  CDS Start-End: 153-344
gccgggcgtatgtgttggtgctagaggcagctgcagggtctcgctgggggccgctcgggaccaattttgaagaggtacttggccacgacttattttcacctccgacctttccttccaggcggtgagactctggactgagagtggctttcacaatggaagggatcagtaatttcaagacaccaagcaaattatcagaaaaaaagaaatctgtattatgttcaactccaactataaatatcccggcctctccgtttatgcagaagcttggctttggtactggggtaaatgtgtacctaatgaaaagtatctgcaccaagaaaagaaactgcttcatggagacataaagtcttcaaatgttgtaattaaaggcgattttgaaacaattaaaatctgtgatgtaggagtctctctaccactggatgaaaatatgactgtgactgaccctgaggcttgttacattggcacagagccatggaaacccaaagaagctgtggaggagaatggtgttattactgacaaggcagacatatttgcctttggccttactttgtgggaaatgatgactttatcgattccacacattaatctttcaaatgatgatgatgatgaagataaaacttttgatgaaagtgattttgatgatgaagcatactatgcagcgttgggaactaggccacctattaatatggaagaactggatgaatcataccagaaagtaattgaactcttctctgtatgcactaatgaagaccctaaagatcgtccttctgctgcacacattgttgaagctctggaaacagatgtctagtgatcatctca

SEQ ID NO: 164090 - DNA, 1499 bp, Homo sapiens
  Payload ID: 12303
  Gene Symbol: PBK
  Gene Name: PDZ binding kinase
  Uniprot ID: Q96KB5
  ENST ID: ENST00000522944
  CDS Start-End: 394-1395
attcaacacagatgtgagcgtttggagagagcttcagccttcagcacaggcaactgtgttctattcaccgggctgtgctcctcggaagggctggtggttcctgtaaaagtttgtgctccccgcgcctttccttccttccctcgtctttggcgcctgcgggcaccgggagtcctgggagagggaggaggaacggcgaatcggcggggcgtgtccttcacgccgccccgtagctcggggccgaagctggcgcagcgcgcgactttttgaaagccaggagggttcgaattgcaacggcagctgccgggcgtatgtgttggtgctagaggcagctgcagggtctcgctgggggccgctcgggaccaattttgaagaggactgagagtggctttcacaatggaagggatcagtaatttcaagacaccaagcaaattatcagaaaaaaagaaatctgtattatgttcaactccaactataaatatcccggcctctccgtttatgcagaagcttggctttggtactggggtaaatgtgtacctaatgaaaagatctccaagaggtttgtctcattctccttgggctgtaaaaaagattaatcctatatgtaatgatcattatcgaagtgtgtatcaaaagagactaatggatgaagctaagattttgaaaagccttcatcatccaaacattgttggttatcgtgcttttactgaagccaatgatggcagtctgtgtcttgctatggaatatggaggtgaaaagtctctaaatgacttaatagaagaacgatataaagccagccaagatccttttccagcagccataattttaaaagttgctttgaatatggcaagagggttaaagtatctgcaccaagaaaagaaactgcttcatggagacataaagtcttcaaatgttgtaattaaaggcgattttgaaacaattaaaatctgtgatgtaggagtctctctaccactggatgaaaatatgactgctcctgccttcataaccatcttgcttgtttcagtgactgaccctgaggcttgttacattggcacagagccatggaaacccaaagaagctgtggaggagaatggtgttattactgacaaggcagacatatttgcctttggccttactttgtgggaaatgatgactttatcgattccacacattaatctttcaaatgatgatgatgatgaagataaaacttttgatgaaagtgattttgatgatgaagcatactatgcagcgttgggaactaggccacctattaatatggaagaactggatgaatcataccagaaagtaattgaactcttctctgtatgcactaatgaagaccctaaagatcgtccttctgctgcacacattgttgaagctctggaaacagatgtctagtgatcatctcagctgaagtgtggcttgcgtaaataactgtttattccaaaatatttacatagttactatcagtagttattagactctaaaattggcatatttga

SEQ ID NO: 164091 - DNA, 2084 bp, Homo sapiens
  Payload ID: 12304
  Gene Symbol: PDZK1
  Gene Name: PDZ domain containing 1
  Uniprot ID: Q5T2W1
  ENST ID: ENST00000344770
  CDS Start-End: 74-1633
ggtctcattctgttgcccaggctggagtgcagtggtgcgatctcggctcacagcaacctctctgcctccagaaatgacctccaccttcaacccccgagaatgtaaactgtccaagcaagaagggcaaaactatggcttcttcctgcgaattgagaaggacaccgagggccacctggtccgggtggttgagaagtgtagcccagcagagaaggctggccttcaagatggagacagagttcttaggatcaatggtgtctttgtggacaaagaagaacatatgcaggttgtggatctggtcagaaagagtgggaattcagtgactttactagttctggatggggattcctatgagaaagcagtgaaaacacgggtggacttgaaagagttgggtcaaagtcagaaggagcaaggtttgagtgataatatactttcccctgtgatgaatggaggtgtgcaaacttggacccagccccggctctgctatctcgtgaaggaaggaggcagctatggcttctctctgaaaactgtccaaggtaaaaagggggtgtacatgactgatattacacctcaaggtgtggctatgagagctggagttctggctgatgatcacttgattgaagtgaatggagagaatgtagaggatgccagccatgaggaagtggttgaaaaggtgaagaagtcaggaagccgtgtcatgttcctgctggtggacaaagaaactgacaagcgtcatgttgagcagaagatacaattcaaaagagaaacagccagtttgaaactgttaccccaccagccccgaattgtggagatgaagaaaggaagcaatggctatggtttctatctgagggcaggctcagaacagaaaggtcaaatcatcaaggacatagattctggaagtccagcagaggaggctggcttgaagaacaatgatctggtagttgctgtcaacggcgagtctgtggaaaccctggatcatgacagtgtggtagaaatgattagaaagggtggagatcagacttcactgttggtggtagacaaagagacggacaacatgtacagactggctcatttttctccatttctctactatcaaagtcaagaactgcccaatggctctgtcaaggaggctccagctcctactcccacttctctggaagtctcaagtccaccagatactacagaggaagtagatcataagcctaaactctgcaggctggctaaaggtgaaaatggctatggctttcacttaaatgcgattcggggtctgccaggctcattcatcaaagaggtacagaagggcggtcctgctgacttggctgggctagaggatgaggatgtcatcattgaagtgaatggggtgaatgtgctagatgaaccctatgagaaggtggtggatagaatccagagcagtgggaagaatgtcacacttctagtctgtggaaagaaggcctatgattatttccaagctaagaaaatccctattgtttcctccctggctgatccacttgacacccctccagattctaaagaaggaatagtggtggagtcaaaccatgactcgcacatggcaaaagaacgggcccacagtacagcctcacattcttcttccaattctgaagatacagagatgtgatgaaaacaagtaatagctttggctgtttatttgatagctgtttctgggtatttaataggaatcctttctcaaggaatgagttgtgacctgtttactgtctctttagaagaaaaactccactggaaaccattcaccatgtgtgattgtcttctgttatcatttgtcttacaggcggctattgcagacggctaatttatgcttaacttaggaagagataaggcaagagctagatttttttcatgtgatcttttccaagcttcaacttaacttaactacatttctctgtatgatgatgtctcttacttctacaggttccttgagcaccaaagatgattcataactctgtataggtgacagctgcttataaaagcatcttagcagataagcctattaaaattgtgcttttgtaacaatgttgtggttgctagaataaataccattaacaaatgcc

SEQ ID NO: 164092 - DNA, 2230 bp, Homo sapiens
  Payload ID: 12304
  Gene Symbol: PDZK1
  Gene Name: PDZ domain containing 1
  Uniprot ID: Q5T2W1
  ENST ID: ENST00000417171
  CDS Start-End: 87-1646
tccagtgagttgcaagcttaatgctcacctgcagagacagaattcctgagtgaacgaacagagcagctcctcttccatctccagaaatgacctccaccttcaacccccgagaatgtaaactgtccaagcaagaagggcaaaactatggcttcttcctgcgaattgagaaggacaccgagggccacctggtccgggtggttgagaagtgtagcccagcagagaaggctggccttcaagatggagacagagttcttaggatcaatggtgtctttgtggacaaagaagaacatatgcaggttgtggatctggtcagaaagagtgggaattcagtgactttactagttctggatggggattcctatgagaaagcagtgaaaacacgggtggacttgaaagagttgggtcaaagtcagaaggagcaaggtttgagtgataatatactttcccctgtgatgaatggaggtgtgcaaacttggacccagccccggctctgctatctcgtgaaggaaggaggcagctatggcttctctctgaaaactgtccaaggtaaaaagggggtgtacatgactgatattacacctcaaggtgtggctatgagagctggagttctggctgatgatcacttgattgaagtgaatggagagaatgtagaggatgccagccatgaggaagtggttgaaaaggtgaagaagtcaggaagccgtgtcatgttcctgctggtggacaaagaaactgacaagcgtcatgttgagcagaagatacaattcaaaagagaaacagccagtttgaaactgttaccccaccagccccgaattgtggagatgaagaaaggaagcaatggctatggtttctatctgagggcaggctcagaacagaaaggtcaaatcatcaaggacatagattctggaagtccagcagaggaggctggcttgaagaacaatgatctggtagttgctgtcaacggcgagtctgtggaaaccctggatcatgacagtgtggtagaaatgattagaaagggtggagatcagacttcactgttggtggtagacaaagagacggacaacatgtacagactggctcatttttctccatttctctactatcaaagtcaagaactgcccaatggctctgtcaaggaggctccagctcctactcccacttctctggaagtctcaagtccaccagatactacagaggaagtagatcataagcctaaactctgcaggctggctaaaggtgaaaatggctatggctttcacttaaatgcgattcggggtctgccaggctcattcatcaaagaggtacagaagggcggtcctgctgacttggctgggctagaggatgaggatgtcatcattgaagtgaatggggtgaatgtgctagatgaaccctatgagaaggtggtggatagaatccagagcagtgggaagaatgtcacacttctagtctgtggaaagaaggcctatgattatttccaagctaagaaaatccctattgtttcctccctggctgatccacttgacacccctccagattctaaagaaggaatagtggtggagtcaaaccatgactcgcacatggcaaaagaacgggcccacagtacagcctcacattcttcttccaattctgaagatacagagatgtgatgaaaacaagtaatagctttggctgtttatttgatagctgtttctgggtatttaataggaatcctttctcaaggaatgagttgtgacctgtttactgtctctttagaagaaaaactccactggaaaccattcaccatgtgtgattgtcttctgttatcatttgtcttacaggcggctattgcagacggctaatttatgcttaacttaggaagagataaggcaagagctagatttttttcatgtgatcttttccaagcttcaacttaacttaactacatttctctgtatgatgatgtctcttacttctacaggttccttgagcaccaaagatgattcataactctgtataggtgacagctgcttataaaagcatcttagcagataagcctattaaaattgtgcttttgtaacaatgttgtggttgctagaataaataccattaacaaatgccttttgagtatgcttgatagtgcttttgttttggattcactttttatgctttaaccttcatttgcctctagaaacccaaaacacaataaagtacagaataagaccttagtaataaaattcagaattttcttaaa

SEQ ID NO: 164093 - DNA, 1897 bp, Homo sapiens
  Payload ID: 12304
  Gene Symbol: PDZK1
  Gene Name: PDZ domain containing 1
  Uniprot ID: Q5T2W1
  ENST ID: ENST00000451928
  CDS Start-End: 87-1313
tccagtgagttgcaagcttaatgctcacctgcagagacagaattcctgagtgaacgaacagagcagctcctcttccatctccagaaatgacctccaccttcaacccccgagaatgtaaactgtccaagcaagaagggcaaaactatggcttcttcctgcgaattgagaaggacaccgagggccacctggtccgggtggttgagaagtgtagcccagcagagaaggctggccttcaagatggagacagagttcttaggatcaatggtgtctttgtggacaaagaagaacatatgcaggttgtggatctggtcagaaagagtgggaattcagtgactttactagttctggatggggattcctatgagaaagcagtgaaaacacgggtggacttgaaagagttgggtcaaagtcagaaggagcaaggtttgagtgataatatactttcccctgtgatgaatggaggtgtgcaaacttggacccagccccggctctgctatctcgtgaaggaaggaggcagctatggcttctctctgaaaactgtccaaggtcaaatcatcaaggacatagattctggaagtccagcagaggaggctggcttgaagaacaatgatctggtagttgctgtcaacggcgagtctgtggaaaccctggatcatgacagtgtggtagaaatgattagaaagggtggagatcagacttcactgttggtggtagacaaagagacggacaacatgtacagactggctcatttttctccatttctctactatcaaagtcaagaactgcccaatggctctgtcaaggaggctccagctcctactcccacttctctggaagtctcaagtccaccagatactacagaggaagtagatcataagcctaaactctgcaggctggctaaaggtgaaaatggctatggctttcacttaaatgcgattcggggtctgccaggctcattcatcaaagaggtacagaagggcggtcctgctgacttggctgggctagaggatgaggatgtcatcattgaagtgaatggggtgaatgtgctagatgaaccctatgagaaggtggtggatagaatccagagcagtgggaagaatgtcacacttctagtctgtggaaagaaggcctatgattatttccaagctaagaaaatccctattgtttcctccctggctgatccacttgacacccctccagattctaaagaaggaatagtggtggagtcaaaccatgactcgcacatggcaaaagaacgggcccacagtacagcctcacattcttcttccaattctgaagatacagagatgtgatgaaaacaagtaatagctttggctgtttatttgatagctgtttctgggtatttaataggaatcctttctcaaggaatgagttgtgacctgtttactgtctctttagaagaaaaactccactggaaaccattcaccatgtgtgattgtcttctgttatcatttgtcttacaggcggctattgcagacggctaatttatgcttaacttaggaagagataaggcaagagctagatttttttcatgtgatcttttccaagcttcaacttaacttaactacatttctctgtatgatgatgtctcttacttctacaggttccttgagcaccaaagatgattcataactctgtataggtgacagctgcttataaaagcatcttagcagataagcctattaaaattgtgcttttgtaacaatgttgtggttgctagaataaataccattaacaaatgccttttgagtatgcttgatagtgcttttgttttggattcactttttatgctttaaccttcatttgcctctagaaacccaaaacacaataaagtacagaataagaccttagtaataaaattcagaattttcttaaa

SEQ ID NO: 164094 - DNA, 1010 bp, Homo sapiens
  Payload ID: 12304
  Gene Symbol: PDZK1
  Gene Name: PDZ domain containing 1
  ENST ID: ENST00000443667
  CDS Start-End: 218-1010
gcaaggcagcaggatggaggggtttgtaaaaatgccttccacctaccctgctgggcttgcccgagaggctctgagtgtgtgaaggggaagacaattatcgctaggctggagaatagaaagagcaccatcagtccagtgagttgcaagcttaatgctcacctgcagagacagaattcctgagtgaacgaacagagcagctcctcttccatctccagaaatgacctccaccttcaacccccgagaatgtaaactgtccaagcaagaagggcaaaactatggcttcttcctgcgaattgagaaggacaccgagggccacctggtccgggtggttgagaagtgtagcccagcagagaaggctggccttcaagatggagacagagttcttaggatcaatggtgtctttgtggacaaagaagaacatatgcaggttgtggatctggtcagaaagagtgggaattcagtgactttactagttctggatggggattcctatgagaaagcagtgaaaacacgggtggacttgaaagagttgggtcaaagtcagaaggagcaaggtttgagtgataatatactttcccctgtgatgaatggaggtgtgcaaacttggacccagccccggctctgctatctcgtgaaggaaggaggcagctatggcttctctctgaaaactgtccaaggtaaaaagggggtgtacatgactgatattacacctcaaggtgtggctatgagagctggagttctggctgatgatcacttgattgaagtgaatggagagaatgtagaggatgccagccatgaggaagtggttgaaaaggtgaagaagtcaggaagccgtgtcatgttcctgctggtggacaaagaaactgacaagcgtcatgttgagcagaagatacaattcaaaagagaaacagccagtttgaaactgttaccccaccagccccgaattgtggagatgaagaaaggaagcaatggctatggtttctatctgagggcaggctcagaacagaaag

SEQ ID NO: 164095 - DNA, 1043 bp, Homo sapiens
  Payload ID: 12305
  Gene Symbol: PDZD11
  Gene Name: PDZ domain containing 11
  Uniprot ID: Q5EBL8
  ENST ID: ENST00000239666
  CDS Start-End: 134-556
ggagggtcagctcgttgcaccctggcccggcctcttttcgaccctgcggagcatccgcttccggttcccagactgaattgtcagtgagcggagtctgaggtcgctgtggactgcccactgggccttgcccgagatggacagccggattccttatgatgactacccggtggttttcttgcctgcctatgagaatcctccagcatggattcctcctcatgagagggtacaccacccggactacaacaatgagttgacccagtttctgccccgaaccatcacactgaagaagcctcctggagctcagttgggatttaacatccgaggaggaaaggcctcccagctaggcatcttcatctccaaggtgattcctgactctgatgcacatagagcaggactgcaggaaggggaccaagttctagctgtgaatgatgtggatttccaagatattgagcacagcaaggctgttgagatcctgaagacagctcgtgaaatcagcatgcgtgtgcgcttctttccctacaattatcatcgccaaaaagagaggactgtgcactagaaagttgcagcccacagcccttcatgtggactctgtcatgacatgctaactagacttcaggggagccacttctgttttcagcccctccctggaatagtgagttgggaggatggggagacagctaaccaactgcattacccaaaccatattgcacttttagttccctagttttctaggtgagcttcattccctgaaaggaggatgatgatatctaggcataacctagcctgtgaggaacctagttaggaaagacaactgacatttattgaatatcatgcactagtcccttacatatgtcatattttaattatagaaatcagtagcaaaaagaatcttggggattttccatctgacttccctggccatcttatcccatccttgcactaccagaagattcatacacttttgagactccagtgagacgctgttttcaccccttcctcctcctagcctctctcccaaaaagtaaaacacaatgctgaagaaa

SEQ ID NO: 164096 - DNA, 784 bp, Homo sapiens
  Payload ID: 12305
  Gene Symbol: PDZD11
  Gene Name: PDZ domain containing 11
  Uniprot ID: Q5EBL8
  ENST ID: ENST00000374454
  CDS Start-End: 172-594
ttttcgaccctgcggagcatccgcttccggttcccagactgaattgtcagtgagcggagtctgaggtcgctgtggactgcccactggattgtgaaaaatgaggtcctctttctagagtacctgacaggttgcttggcatccagaagatgtttagctaaggccttgcccgagatggacagccggattccttatgatgactacccggtggttttcttgcctgcctatgagaatcctccagcatggattcctcctcatgagagggtacaccacccggactacaacaatgagttgacccagtttctgccccgaaccatcacactgaagaagcctcctggagctcagttgggatttaacatccgaggaggaaaggcctcccagctaggcatcttcatctccaaggtgattcctgactctgatgcacatagagcaggactgcaggaaggggaccaagttctagctgtgaatgatgtggatttccaagatattgagcacagcaaggctgttgagatcctgaagacagctcgtgaaatcagcatgcgtgtgcgcttctttccctacaattatcatcgccaaaaagagaggactgtgcactagaaagttgcagcccacagcccttcatgtggactctgtcatgacatgctaactagacttcaggggagccacttctgttttcagcccctccctggaatagtgagttgggaggatggggagacagctaaccaactgcattacccaaaccatattgcacttttagttccctagttttctaggtgagcttcattcc

SEQ ID NO: 164097 - DNA, 11704 bp, Homo sapiens
  Payload ID: 12306
  Gene Symbol: PDZD2
  Gene Name: PDZ domain containing 2
  Uniprot ID: O15018
  ENST ID: ENST00000438447
  CDS Start-End: 389-8908
gcgggagcctcggccaagccgcgagcaggtgtgaatgagcccagggaaggacacacggccactgctggagggatcctccattcctgtgtcatttgcatgggtcctgctgtgaaatgaacctggcagggacttgttagacacttccttccttccctcattgagcactccagtgccattgttccacagttgttctaattgggtcctagcttcctcctgccaaggcaaacagcatagtctcgagtaggtgtccctaggctcatctgccagcctgaacatgaacacaggcaaagctgatgatggccagggaccccaggggacgtggggccctgtggggtctggcccccaggagcaagacctctgatgatgctggtgtctgggagtgagcaccatgcccatcacccaggacaatgccgtgctgcacctgcccctcctctaccagtggctgcagaacagcctgcaggaaggtggggatgggccggagcagcggctctgccaggcggccatccagaagctgcaggagtacatccagctgaactttgctgtggatgagagtacggtcccacctgatcacagcccccccgaaatggagatctgtactgtgtacctcaccaaggagctgggggacacagagactgtgggcctgagttttgggaacatccctgttttcggggactatggtgaaaagcgcagggggggcaagaagaggaaaacccaccagggtcctgtgctggatgtgggctgcatctgggtgacagagctgaggaagaacagcccagcagggaagagtgggaaggtccgactgcgggatgagatcctctcactgaatgggcagctgatggttggagttgatgtcagtggggccagttacctggctgagcagtgctggaatggcggctttatctacctgatcatgctgcgtcgctttaagcacaaagcccactccacttataatggcaacagtagcaacagctctgaaccaggagaaacacctaccttggagctgggtgaccgaactgcgaaaaaggggaaacgaaccagaaagtttggggtcatctccaggcctcctgccaacaaggcccctgaagaatccaagggcagcgctggctgtgaggtgtccagtgaccccagcactgagctggagaacggccctgaccctgaacttggaaacggccatgtctttcagctagaaaatggcccagattctctcaaggaggtggctggaccccatctagagaggtcagaagtggacagagggacagagcatagaattccaaagacagatgctcctctgaccacaagcaatgacaaacgccgcttctcaaaaggtgggaagacggacttccaatcgagtgactgcctggcacgggaggaagttggccgaatatggaagatggagctgctcaaagaatcggatgggctgggaattcaggttagtggaggccgaggatcaaagcgctcacctcacgctatcgttgtcactcaagtgaaggaaggaggtgccgctcacagggatggcaggctgtccttaggagatgagctgctggtaatcaatggtcatttactggtcgggctctcccacgaggaagcagtggccattcttcgctccgccacgggaatggtgcagcttgtggtggccagcaaggaaaactccgcagaggacctcctcaggttaacatctaagagcttgccagatctgaccagctcggtagaagatgtgtcctcctggactgataacgaagaccaggaggcagacggggaagaggacgaaggaaccagctcttctgtccagagagcaatgcctgggacagatgaaccccaagatgtgtgcggtgctgaggaatccaaggggaacttggaaagtcccaaacagggcagcaataaaatcaagctcaagagtcgcctttcagggggtgtacaccgccttgagtcagttgaagaatataacgagctgatggtgcggaatggggacccccggatccggatgttggaggtctcccgagatggccggaaacactccctcccgcagctgctggactcttccagtgcctcacaggaataccacattgtgaagaagtctacccgctccttaagcacgactcaggtggaatctccttggaggctcattcggccatccgtcatctcgatcattgggttgtacaaagaaaaaggcaagggccttggctttagtattgctggaggtcgagactgcattcgtggacagatggggatttttgtcaagaccatcttcccaaatggatcagctgcagaggacggaagacttaaagaaggggatgaaatcctagatgtaaatggaataccaataaagggcttgacatttcaagaagccattcatacctttaagcaaatccggagtggattatttgttttaacggtacgcacaaagttggtgagccccagcctcacaccctgctcgacacccacacacatgagcagatccgcctccccgaacttcaataccagtgggggagcctcagcgggaggttccgatgaaggcagttcttcatccctgggtcggaagacccctgggcccaaggacaggatcgtcatggaagtaacactcaacaaagagccaagagttggattaggcattggtgcctgctgcttggctctggaaaacagtcctcctggcatctacattcacagccttgctccaggatcagtggccaagatggagagcaacctgagccgcggggatcaaatcctggaagtgaactccgtcaacgtccgccatgctgctttaagcaaagtccacgccatcttgagtaaatgccctccaggacccgttcgccttgtcatcggccggcaccctaatccaaaggtttccgagcaggaaatggatgaagtcatagcacgcagcacttatcaggagagcaaagaggccaattcctctcctggcttaggtacccccttgaagagtccctctcttgcaaaaaaggactcccttatttctgaatctgaactctcccagtactttgcccacgatgtccctggccccttgtcagacttcatggtggccggttctgaggacgaggatcacccgggaagtggctgcagcacgtcggaggagggcagcctgcctcccagcacctccactcacaaggagcctggaaaacccagagccaacagcctcgtgactcttgggagccatcgggcttctgggctcttccacaagcaggtgacagttgccagacaagccagtctccccggaagcccacaggccctccgaaaccctctcctccgccagaggaaggtaggctgctacgatgccaacgatgccagtgatgaggaagagtttgacagagaaggggactgcatttcactcccaggggccctcccgggtcccatcaggcctctgtcagaggatgacccgaggcgtgtctcaatttcctcttccaagggcatggacgtccacaaccaagaggaacgaccccggaaaacactggtgagcaaggccatctcggcacctcttcttggtagctcagtggacttagaggagagtatcccagagggcatggtggatgctgcgtcctatgcagccaacctcacggactctgcagaggcccccaaggggagccctggaagctggtggaagaaggaactgtcaggatcaagtagcgcacccaaattggaatacacagtccgtacagacacccagagtccgacgaacactgggagccccagttccccccagcagaaaagtgaaggcctgggctccaggcacagaccagtggccagggtaagcccccactgcaagagatccgaggctgaggccaagcccagtggctcacagacagtgaacctgactggcagagccaatgatccatgcgatctggactcgagagtccaggccacttctgtcaaagtgactgtcgctggctttcagccaggtggagctgtggagaaggaatctctgggaaagctgaccactggagatgcttgtgtctctaccagctgtgaactagccagtgctctgtcccatctggatgccagccacctcacagagaacctgcccaaagctgcatcagagctggggcaacaacccatgactgaactggacagctcctcagacctcatctcttccccagggaagaagggggccgctcatcctgaccccagcaagacctctgtagacacagggcaagtcagtcggccagagaatcccagccagcctgcatcgcccagggtcaccaagtgcaaggccaggtctccagtcaggctcccccatgagggcagcccctccccgggggagaaagcagcggctccccctgactacagcaagactcgatcagcatcggaaaccagcacaccccacaataccaggagggtggctgccctcaggggagcgggacctggagcagagggaatgacaccagctggtgctgtcctgccaggagaccccctcacatcccaggagcagagacagggagctccaggtaaccacagtaaggctctggaaatgacaggaatccatgcacctgaaagctcccaggagccttccctgctggagggagcagattctgtgtcctcaagggcaccgcaggccagcctctccatgctgccatccactgacaacaccaaagaagcatgtggccatgtctcggggcactgctgcccaggggggagtagagagagccctgtgacggacattgacagcttcatcaaggagctggatgcttctgcagcaaggtctccgtcttcccagacgggggacagtggctctcaggagggcagtgctcagggccacccaccagccggggctggaggtgggagctcctgccgtgccgaaccagtcccggggggccagacctcctccccgaggagggcctgggctgctggtgcccccgcctacccacaatgggcctcccagccttcggttttagattcaattaatcccgacaaacattttactgtgaacaaaaactttctgagcaactactctagaaattttagcagttttcatgaagacagcacctccctatcaggcctgggtgacagcacggagccgtctctgtcatccatgtatggcgatgctgaggattcttcttctgaccctgagtcactcactgaagccccacgagcttctgccagggacggctggtcccctcctcgttcccgtgtgtctttgcacaaggaagatccttcggagtcagaagaggaacagattgagatttgttccacacgtggctgccccaatccaccctcgagtcctgctcatcttcccacccaggctgccatctgtcctgcctcagccaaagttctgtcattaaaatacagcactccgagagagtcggtggccagtccccgtgagaaggccgcctgcttgccaggctcatacacttcaggcccagactcttcccagccatcatcactcttggagatgagctctcaggagcatgaaactcatgcggacataagcacttcacagaaccacaggccctcgtgtgcagaagaaaccacagaagtcaccagcgctagctcagccatggaaaacagtccgctgtctaaagtagccaggcattttcacagtccgcccatcattctcagctcccccaacatggtaaatggcttggaacatgacctgctagatgacgaaaccctgaatcaatacgaaacaagcattaatgcagctgccagtctgtcctccttcagtgtggatgtccctaagaatggagaatctgttttggaaaacctccacatctctgaaagtcaagacctggatgacttgctacagaaaccaaaaatgatcgctaggaggcccatcatggcctggtttaaagaaataaataaacataaccaaggcacacatttgaggagcaaaaccgagaaggaacaacctctaatgcctgccagaagtcccgactccaagattcagatggtgagttcaagccaaaaaaagggcgttactgtgcctcatagccctcctcagccgaaaacaaacctggaaaataaggacctgtctaagaagagtccggcagaaatgcttctgactaatggtcagaaggcaaagtgtggtccgaagctgaagaggctcagcctcaagggcaaggccaaagtcaactctgaggcccctgctgcgaatgctgtgaaggctggggggacggaccacaggaaacccttgatctcaccccagacctcccacaaaacactttctaaggcagtgtcacagcggctccatgtagccgaccacgaggaccctgacagaaacaccacagctgcccccaggtccccccagtgtgtgctggaaagcaagccacctcttgccacctctgggccactgaaaccctcagtgtctgacacgagcatcaggacatttgtctcgcccctgacctctcccaagcctgttcctgagcaaggcatgtggagcaggttccacatggctgtcctctctgaacccgacagaggttgcccaaccacccctaaatctcctaagtgtagagcagagggcagggcgccccgtgctgactccgggccggtgagtccggcagcgtctaggaacggcatgtccgtggcagggaacagacagagtgagccgcgcctggccagccatgtggcagcagacacagcccaacccaggccgactggcgaaaaaggaggcaacataatggccagcgatcgcctcgaaagaacaaaccagctgaaaatcgtggagatttctgctgaagcagtgtcagagactgtatgtggtaacaagccagctgaaagcgacagacggggagggtgcttggcccagggcaactgtcaggagaagagtgaaatcaggctctatcgccaggtcgcagaatcatccacaagtcatccatcctcactcccatctcatgcctcccaggcagagcaggaaatgtcacgatcattcagcatggcaaaactggcgtcctcctcctcctcccttcaaacagccattagaaaggcagaatactcccagggaaaatcaagcctgatgtcagactcccgaggggtgcccagaaacagcattccagggggcccctcgggggaggaccatctctacttcaccccaaggccagcgaccaggacctactccatgccagcccagttctcaagccattttggacgggagggtcaccccccacacagcctgggtcgctctcgggacagccaggtccctgtgacaagcagtgttgtccccgaggcaaaggcatccagaggtggtcttcccagcctggctaatggacagggcatatatagtgtaaagccgctgctggacacatcgaggaatcttccagccacagatgaaggggatatcatttcagtccaggagacgagctgcctagtcacagacaaaatcaaagtcaccagacgacactactgctatgagcagaactggccccatgaatctacctcatttttctctgtgaagcagcggatcaagtcttttgagaacctggccaatgctgaccggcctgtagccaagtccggggcttccccatttttgtcggtgagctccaagcctcccattgggaggcggtcttccggcagcattgtttccgggagcctgggccacccaggtgacgcagcagcaaggttgttgagacgcagcttgagttcctgcagcgaaaaccaaagcgaagccggcaccctcctgccccagatggccaagtctccctcaatcatgacactgaccatctctcggcagaacccaccagagaccagtagcaagggctctgattcggaactaaagaaatcacttggtcctttgggaattcccaccccaacgatgaccctggcttctcctgttaagaggaacaagtcctcggtacgccacacgcagccctcgcccgtgtcccgctccaagctccaggagctgagagccttgagcatgcctgaccttgacaagctctgcagcgaggattactcagcagggccgagcgccgtgctcttcaaaactgagctggagatcacccccaggaggtcacctggccctcctgctggaggcgtttcgtgtcccgagaagggcgggaacagggcctgtccaggaggaagtggccctaaaaccagtgctgctgagacacccagttcagccagtgatacgggtgaagctgcccaggatctgccttttagaagaagctggtcagttaatttggatcaacttctagtctcagcgggggaccagcaaagattacagtctgttttatcgtcagtgggatcgaaatctaccatcctaactctcattcaggaagcgaaagcacaatcagagaatgaagaagatgtttgcttcatagtcttgaatagaaaagaaggctcaggtctgggattcagtgtggcaggagggacagatgtggagccaaaatcaatcacggtccacagggtgttttctcagggggcggcttctcaggaagggactatgaaccgaggggatttccttctgtcagtcaacggcgcctcactggctggcttagcccacgggaatgtcctgaaggttctgcaccaggcacagctgcacaaagatgccctcgtggtcatcaagaaagggatggatcagcccaggccctctgcccggcaggagcctcccacagccaatgggaagggtttgctgtccagaaagaccatccccctggagcctggcattgggagaagtgtggctgtacacgatgctctgtgtgttgaagtgctgaagacctcggctgggctgggactgagtctggatgggggaaaatcatcggtgacgggagatgggcccttggtcattaaaagagtgtacaaaggtggtgcggctgaacaagctggaataatagaagctggagatgaaattcttgctattaatgggaaacctctggttgggctcatgcactttgatgcctggaatattatgaagtctgtcccagaaggacctgtgcagttattaattagaaagcataggaattcttcatgaattttaacaagaatcattttctcagttctcttctttctttagcaaatcagagtgacttctttaaaccacaggttgttgaaatggccaacactggtacagacacggactataaaaatctccaagcttgtgcttacacatgaagcctgacttaactgtatgtgcaacagcaatgaaattaactccagaagccttccacctgcgtcacccaggccgggagggttccttcgttccagtgcctgtcccctacctttatgttatgtttactgatggggatacaagatgtgacacacccttctttatttgaaacaaacaaacatttagctagacctttgcttccttcttgccagctctcccaacatacccaatcctggtgatcagggaactaaaagtctgagggggacacaaatgtcacacctaagaggacaatcaatcattttgtatgattttgtaagtaaatgacagaatgcttttaggcacattcaatggaaggaggagatgtaggtctgtatatgttaccctgaaaagagaataagacttacttaaaaaaatgaattatgacctgttaggctgagctcaggaattgtccaaaaaggaaaaagcaaaataattaattgagagtattttttagtgagtgtaatgtataatgtacgtatgcaaagttcaactcaataggttattgatcaccatgaagtattgatcattttctatctcaaaagtgtaagccataaggctgttttacagaatagcacttctgataagctgtattaaatagccatgagcttcactgcttagagggagcagaaaggtcaacatctaaaagcaccttacaactagtttttgaacctgtcttgataagtgcttgaattcaagactggtcagtccaagagcagacaaaaatatcacaagtcagtcagtcactgggtttccatttctgaattttatgcactccaaccatgaatttaaactaaatttttagaaatcaagtatctttctaagtgtccttggatttatagacaatgtatgtacaatccaaatagaggagcttaatggaatccttttaggagactggttggtttttttccctctttcccaacatgtttaagaaatgtaacattctaagtattggatctcttttcttgacctagtataatgacaactgcagtgacttaagtttttgctgttttcgttttcccgctttgcaatttcctccttttgccaaaaatgttttcctacagaagactgtcgtgactcacgctacttgggaaactcactctggccactcctcctctggtggcatgagctgcttcccagtagctattccgattggatattccgttcgtcgtcacatagctggcttttctctcctcatgatgtaccttattttcttaggtaaataattccaaactctcatcgggtcataaagaggaggagaaacagggtgagtcaaggtaaaggagcagaaatgtagttacaagccaggtcgtcttcagtggcacaaaccaacccgttgagccctgacaacatgagtggagagtgcatttgccatacctgtgtgcatgacactaagattttatgttggagatacttctttaaataacctacagcttgggtctatggctgtgacccccagattcatggaggggctttagccatcagctttgtacatcatcatttttctgaatgaccaatcccactaaacatctttgaagtcggcctagagaggtccttcagatgagagagaaatagctggcttgtctgagtccagatttctcatcaactggcaatacaaaggaaaatatggtacaggagttagttagaaaggtcttattgattttacttctacttttcactacagttacaggtagaatactgtaggaagtcagtgcaaggtgcatgcttgattgatagatattgattgattgtttttcagtctctggggtcagttttgtggtttctgctttcttgcctaaatcaaagactatttcaagtcaacaacactgaaaactgcttttcgcctccactcttacagctgtgcctaataataattaattaataaacgcacagccctatgtgaacagacaggaatttcttgtgcaatgtggagcaaatggaatggtctccttccgcaagtctttttaatcctcatatctggagtacaagggtagacctctggcttaccacatacactatgctaaagtcatcagccactgctactacatcttgccagaaggtttccctcgccaacaaacagttgaaatttaagggaagaagcaaaagctaaactgtctttgaccctaagatagatagaaagctatttatttgtcttcagtgttcaaggcatgactagtatttctaattagcctaataaattcccacactttctgaagtgaacactaatggtattgtcctactaaaactgtcattgtttctttttttttaactggtcagtcattcacaataagctatgagggtaaataaatatgtgttataacaagtaaaccgtagttgcaagaatataccatgaagattaaagtaggctgggtttcatttccatcttcccacacatctcattgaatttgatggttgacttaattggcaccataactttgtatgatattatacattaacctttatttatgtaaagtaaaatgccttatatattaaagagtaagtgcaataatatgaaatagcctgtacattttaaaaatgttgtcaccaagttatataaatccacatctctgtaaacaaccttttttaagtaattttaaaaaaaataaacactctgcttactacttg

SEQ ID NO: 164098 - DNA, 536 bp, Homo sapiens
  Payload ID: 12306
  Gene Symbol: PDZD2
  Gene Name: PDZ domain containing 2
  ENST ID: ENST00000513910
  CDS Start-End: 496-536
agaagtgtggcgtcttggtccaggatgcaggtccctgattcgggttggacgtggtcatcaaacccagaaattgaaggatcttgggcctgccttgatgttcatttctctcatctataaaattgaaggctggaggaggtgtgaatgagcccagggaaggacacacggccactgctggagggatcctccattcctgtgtcatttgcatgggtcctgctgtgaaatgaacctggcagggacttgttagacacttccttccttccctcattgagcactccagtgccattgttccacagttgttctaattgggtcctagcttcctcctgccaaggcaaacagcatagtctcgagtaggtgtccctaggctcatctgccagcctgaacatgaacacaggcaaagctgatgatggccagggaccccaggggacgtggggccctgtggggtctggcccccaggagcaagacctctgatgatgctggtgtctgggagtgagcaccatgcccatcacccaggacaatgccgtgctgcacctgcccct

SEQ ID NO: 164099 - DNA, 2204 bp, Homo sapiens
  Payload ID: 12307
  Gene Symbol: PDZD3
  Gene Name: PDZ domain containing 3
  Uniprot ID: Q86UT5
  ENST ID: ENST00000322712
  CDS Start-End: 10-1485
gatccagctatggagaaagccgcagatctgcaggacacagcctcgttaactctgaagtttaagtttaacccaaagctgggcattgataatcctgtcctctccctggccgaagaccacgacccctatgatccctggagcctggagcggcctcgcttctgtttactgagcaaagaggagggcaagagttttggcttccacctgcagcaggagctgggcagggctgggcatgtggtgtgcagggtggacccaggcacctctgcccagcgccagggtcttcaggaaggagacaggatcctggcggtgaacaatgatgttgtggaacacgaagactatgcggtggtggtacgccgcatccgggccagcagccctcgggtgttgctgacagtattggcacggcatgcacatgacgtggcccgagctcagctgggagaagatgcccacctctgtcccaccctaggcccaggggtccggccccggctgtgccacatagtgaaagatgagggtggttttggcttcagtgtcacccatggcaatcagggtcctttctggttggtgctaagtactggaggagcagctgagcgggcaggggtgccccccggggcccggctgctggaagtgaatgggctttggcagagtggacagcaggtgaccttgctggtggcagggccagaggtggaagaacagtgtcgccagctgggattgcccctggctgcacccctggcagagggctgggcactgcccaccaagccccgctgcctgcacctggagaaagggccccagggttttgggttcctgctccgggaggaaaagggccttgacggtcgccctggacagttcctgtgggaggtggacccgggactgccagccaagaaggctgggatgcaggctggggaccggctggtggctgtggctggggagagcgtggaggggctgggccatgaggagacagtgtccaggatccaggggcagggctcctgtgtctccctcactgtcgtcgaccctgaggcggaccgcttcttcagcatggttcgcctgtccccactcctcttcttggagaacacagaggctcccgcctcgccccggggcagcagctcagcctcactggttgagacagaggacccttcacttgaagacacaagcgtgccttctgtccctcttggctcccgacagtgcttcctgtaccctgggcctggtggcagctatggcttccgactcagttgtgtggccagtgggcctcgtctcttcatctcccaggtgactccaggaggctcagctgcccgggctgggctgcaagtgggagacgtgattctggaagtgaacgggtatcctgttgggggacagaatgacctggagaggcttcagcagctgcctgaggctgagccacccctctgcctgaagctggcagccaggtctctgcggggcttggaagcctggattccccctggggctgcagaggactgggctctggcctcggatctactgtagagcacccctgcttggtacagacatactcaggggctaccgtgtcttcactctccagcctgaggtggtgaaggcaggatgctctctctaagccagaccagagggactcagacaccaccgatcacaggctggcccaggtgctccctcccttcctgcaggcccacctgccagcagagggtgtggttggaggcctcagacaggtccctgaaggagtctgaggctccagaggatgtcatatgggagttttagagagctgtgtcccaaggatgaaggtgtggctgtgggtctggctaggattgaagccatctggaccttttctagatatgactccaggacccttgagtgtaatgcaaaaatttggagaccagctatgcctgccctctgtgggtgccttagcattgcgggagggtggtgcttggtcaccgttgcatttgttatagaaatggccattcgccataaatctgactgcctgtgtttgtgttggtgggggtaaggggcagtggtgtgaagggaccaaaagggcctcaggctcaaggggtgggatgcggctcctgcaggagagaggttgagacctggtcaaatttatttcctatcaatcactgaatctcagggataatgggtcaacccagaactgagatgtctgtatgacagccactcctaaaaataaacaacaacaaaaacaaaaaaagaagaaaactaaataaaaataaaaataaaaataa

SEQ ID NO: 164100 - DNA, 2252 bp, Homo sapiens
  Payload ID: 12307
  Gene Symbol: PDZD3
  Gene Name: PDZ domain containing 3
  Uniprot ID: Q86UT5
  ENST ID: ENST00000355547
  CDS Start-End: 16-1533
gttgctgatccagctatggagaaagccgcagatctgcaggacacagcctcgttaactctgaagtttaagtttaacccaaagctgggcattgataatcctgtcctctccctggccgaagaccacgacccctatgatccctggagcctggagcggcctcgcttctgtttactgagcaaagaggagggcaagagttttggcttccacctgcagcaggagctgggcagggctgggcatgtggtgtgcagggtggacccaggcacctctgcccagcgccagggtcttcaggaaggagacaggatcctggcggtgaacaatgatgttgtggaacacgaagactatgcggtggtggtacgccgcatccgggccagcagccctcgggtgttgctgacagtattggcacggcatgcacatgacgtggcccgagctcagctgggagaagatgcccacctctgtcccaccctaggcccaggggtccggccccggctgtgccacatagtgaaagatgagggtggttttggcttcagtgtcacccatggcaatcagggtcctttctggttggtgctaagtactggaggagcagctgagcgggcaggggtgccccccggggcccggctgctggaagtgaatggggtcagtgtggagaagttcactcacaaccaactcaccaggaagctttggcagagtggacagcaggtgaccttgctggtggcagggccagaggtggaagaacagtgtcgccagctgggattgcccctggctgcacccctggcagagggctgggcactgcccaccaagccccgctgcctgcacctggagaaagggccccagggttttgggttcctgctccgggaggaaaagggccttgacggtcgccctggacagttcctgtgggaggtggacccgggactgccagccaagaaggctgggatgcaggctggggaccggctggtggctgtggctggggagagcgtggaggggctgggccatgaggagacagtgtccaggatccaggggcagggctcctgtgtctccctcactgtcgtcgaccctgaggcggaccgcttcttcagcatggttcgcctgtccccactcctcttcttggagaacacagaggctcccgcctcgccccggggcagcagctcagcctcactggttgagacagaggacccttcacttgaagacacaagcgtgccttctgtccctcttggctcccgacagtgcttcctgtaccctgggcctggtggcagctatggcttccgactcagttgtgtggccagtgggcctcgtctcttcatctcccaggtgactccaggaggctcagctgcccgggctgggctgcaagtgggagacgtgattctggaagtgaacgggtatcctgttgggggacagaatgacctggagaggcttcagcagctgcctgaggctgagccacccctctgcctgaagctggcagccaggtctctgcggggcttggaagcctggattccccctggggctgcagaggactgggctctggcctcggatctactgtagagcacccctgcttggtacagacatactcaggggctaccgtgtcttcactctccagcctgaggtggtgaaggcaggatgctctctctaagccagaccagagggactcagacaccaccgatcacaggctggcccaggtgctccctcccttcctgcaggcccacctgccagcagagggtgtggttggaggcctcagacaggtccctgaaggagtctgaggctccagaggatgtcatatgggagttttagagagctgtgtcccaaggatgaaggtgtggctgtgggtctggctaggattgaagccatctggaccttttctagatatgactccaggacccttgagtgtaatgcaaaaatttggagaccagctatgcctgccctctgtgggtgccttagcattgcgggagggtggtgcttggtcaccgttgcatttgttatagaaatggccattcgccataaatctgactgcctgtgtttgtgttggtgggggtaaggggcagtggtgtgaagggaccaaaagggcctcaggctcaaggggtgggatgcggctcctgcaggagagaggttgagacctggtcaaatttatttcctatcaatcactgaatctcagggataatgggtcaacccagaactgagatgtctgtatgacagccactcctaaaaataaacaacaacaaaaacaaaaaaagaagaaaactaaataaaaataaaaataaaaataa

SEQ ID NO: 164101 - DNA, 2996 bp, Homo sapiens
  Payload ID: 12307
  Gene Symbol: PDZD3
  Gene Name: PDZ domain containing 3
  Uniprot ID: Q86UT5
  ENST ID: ENST00000531114
  CDS Start-End: 550-2265
actgggttgctgatccagctatggagaaagccgcaggtaggaggccaggagaaatcctctgcaggggactttgggacaggcagggggccgacttggaggctgaagctttgggaccagggcacacttgattttggggcttggagccctgaggcaggtaaacaagtcaggagaaaagtaatgagttgatatgtctgtcttcctggtccacaccctgtactgatatgctcagatttatgtgccaaggacttggggggagagaaagggaggggaccgcacaatagtcctgtgtgtatggcagtgagaagagaagacccctttggagcagaaaggagggggcatgccctgagtttgggggtttccctgagtccttttagtttatgccaatggaagaggcacatctggggagaagaatgtgactctcctcctctcacccacttctttgcccagtagatctgcaggacacagcctcgttaactctgaagtttaagtttaacccaaagctgggcattgataatcctgtcctctccctggccgaagaccacgacccctatggtaactccctcaccccctggcaaccattccctatccctggaggcaccacggctccacacggcctccgatctccttggtaaccactcactcggtctccctctgataacagccttggttgggagtagagataggaggggccgggtgttttctcctgtcccagtccctctgcccacgaaccccaccacccaacacccaaccaggcagaaactgcccagcaccctatcaggacacagggtctgccaggcacacggcgaacctgtacttgggctgtgccctctcctcccccttttctgctgcccacctcaccctccagatccctggagcctggagcggcctcgcttctgtttactgagcaaagaggagggcaagagttttggcttccacctgcagcaggagctgggcagggctgggcatgtggtgtgcagggtggacccaggcacctctgcccagcgccagggtcttcaggaaggagacaggatcctggcggtgaacaatgatgttgtggaacacgaagactatgcggtggtggtacgccgcatccgggccagcagccctcgggtgttgctgacagtattggcacggcatgcacatgacgtggcccgagctcagctgggagaagatgcccacctctgtcccaccctaggcccaggggtccggccccggctgtgccacatagtgaaagatgagggtggttttggcttcagtgtcacccatggcaatcagggtcctttctggttggtgctaagtactggaggagcagctgagcgggcaggggtgccccccggggcccggctgctggaagtgaatggggtcagtgtggagaagttcactcacaaccaactcaccaggaagctttggcagagtggacagcaggtgaccttgctggtggcagggccagaggtggaagaacagtgtcgccagctgggattgcccctggctgcacccctggcagagggctgggcactgcccaccaagccccgctgcctgcacctggagaaagggccccagggttttgggttcctgctccgggaggaaaagggccttgacggtcgccctggacagttcctgtgggaggtggacccgggactgccagccaagaaggctgggatgcaggctggggaccggctggtggctgtggctggggagagcgtggaggggctgggccatgaggagacagtgtccaggatccaggggcagggctcctgtgtctccctcactgtcgtcgaccctgaggcggaccgcttcttcagcatggttcgcctgtccccactcctcttcttggagaacacagaggctcccgcctcgccccggggcagcagctcagcctcactggttgagacagaggacccttcacttgaagacacaagcgtgccttctgtccctcttggctcccgacagtgcttcctgtaccctgggcctggtggcagctatggcttccgactcagttgtgtggccagtgggcctcgtctcttcatctcccaggtgactccaggaggctcagctgcccgggctgggctgcaagtgggagacgtgattctggaagtgaacgggtatcctgttgggggacagaatgacctggagaggcttcagcagctgcctgaggctgagccacccctctgcctgaagctggcagccaggtctctgcggggcttggaagcctggattccccctggggctgcagaggactgggctctggcctcggatctactgtagagcacccctgcttggtacagacatactcaggggctaccgtgtcttcactctccagcctgaggtggtgaaggcaggatgctctctctaagccagaccagagggactcagacaccaccgatcacaggctggcccaggtgctccctcccttcctgcaggcccacctgccagcagagggtgtggttggaggcctcagacaggtccctgaaggagtctgaggctccagaggatgtcatatgggagttttagagagctgtgtcccaaggatgaaggtgtggctgtgggtctggctaggattgaagccatctggaccttttctagatatgactccaggacccttgagtgtaatgcaaaaatttggagaccagctatgcctgccctctgtgggtgccttagcattgcgggagggtggtgcttggtcaccgttgcatttgttatagaaatggccattcgccataaatctgactgcctgtgtttgtgttggtgggggtaaggggcagtggtgtgaagggaccaaaagggcctcaggctcaaggggtgggatgcggctcctgcaggagagaggttgagacctggtcaaatttatttcctatcaatcactgaatctcagggataatgggtcaacccagaactgagatgtctgtatgacagccactcctaaaaataaacaacaacaaaaacaaaaaaagaagaaaactaaataaaaataaaaataaaaataagatccacttctc

SEQ ID NO: 164102 - DNA, 573 bp, Homo sapiens
  Payload ID: 12307
  Gene Symbol: PDZD3
  Gene Name: PDZ domain containing 3
  ENST ID: ENST00000533688
  CDS Start-End: 16-375
gttgctgatccagctatggagaaagccgcagatctgcaggacacagcctcgttaactctgaagtttaagtttaacccaaagctgggcattgataatcctgtcctctccctggccgaagaccacgacccctatgatccctggagcctggagcggcctcgcttctgtttactgagcaaagaggagggcaagagttttggcttccacctgcagcaggagctgggcagggctgggcatgtggtgtgcagggtggacccaggcacctctgcccagcgccagggtcttcaggaaggagacaggatcctggcggtgaacaatgatgttgtggaacacgaagactatgcggtggcaatcagggtcctttctggttggtgctaagtactggaggagcagctgagcgggcaggggtgccccccggggcccggctgctggaagtgaatggggtcagtgtggagaagttcactcacaaccaactcaccaggaagctttggcagagtggacagcaggtgaccttgctggtggcagggccagaggtggaagaacagtgtcgccagctgggattgcccctggctgcac

SEQ ID NO: 164103 - DNA, 1882 bp, Homo sapiens
  Payload ID: 12307
  Gene Symbol: PDZD3
  Gene Name: PDZ domain containing 3
  ENST ID: ENST00000525131
  CDS Start-End: 136-1614
actgggttgctgatccagctatggagaaagccgcagatctgcaggacacagcctcgttaactctgaagtttaagtttaacccaaagctgggcattgataatcctgtcctctccctggccgaagaccacgacccctatggtaactccctcaccccctggcaaccattccctatccctggaggcaccacggctccacacggcctccgatctccttgatccctggagcctggagcggcctcgcttctgtttactgagcaaagaggagggcaagagttttggcttccacctgcagcaggagctgggcagggctgggcatgtggtgtgcagggtggacccaggcacctctgcccagcgccagggtcttcaggaaggagacaggatcctggcggtgaacaatgatgttgtggaacacgaagactatgcggtggtggtacgccgcatccgggccagcagccctcgggtgttgctgacagtattggcacggcatgcacatgacgtggcccgagctcagctgggagaagatgcccacctctgtcccaccctaggcccaggggtccggccccggctgtgccacatagtgaaagatgagggtggttttggcttcagtgtcacccatggcaatcagggtcctttctggttggtgctaagtactggaggagcagctgagcgggcaggggtgccccccggggcccggctgctggaagtgaatggggtcagtgtggagaagttcactcacaaccaactcaccaggaagctttggcagagtggacagcaggtgaccttgctggtggcagggccagaggtggaagaacagtgtcgccagctgggattgcccctggctgcacccctggcagagggctgggcactgcccaccaagccccgctgcctgcacctggagaaagggccccagggttttgggttcctgctccgggaggaaaagggccttgacggtcgccctggacagttcctgtgggaggtggacccgggactgccagccaagaaggctgggatgcaggctggggaccggctggtggctgtggctggggagagcgtggaggggctgggccatgaggagacagtgtccaggatccaggggcagggctcctgtgtctccctcactgtcgtcgaccctgaggcggaccgcttcttcagcatggttcgcctgtccccactcctcttcttggagaacacagaggctcccgcctcgccccggggcagcagctcagcctcactggttgagacagaggacccttcacttgaagacacaagcgtgccttctgtccctcttggctcccgacagtgcttcctgtaccctgggcctggtggcagctatggcttccgactcagttgtgtggccagtgggcctcgtctcttcatctcccaggtgactccaggaggctcagctgcccgggctgggctgcaagtgggagacgtgattctggaagtgaacgggtatcctgttgggggacagaatgacctggagaggcttcagcagctgcctgaggctgagccacccctctgcctgaagctggcagccaggtctctgcggggcttggaagcctggattccccctggggctgcagaggactgggctctggcctcggatctactgtagagcacccctgcttggtacagacatactcaggggctaccgtgtcttcactctccagcctgaggtggtgaaggcaggatgctctctctaagccagaccagagggactcagacaccaccgatcacaggctggcccaggtgctccctcccttcctgcaggcccacctgccagcagagggtgtggttggaggcctcagacaggtccctgaaggagtctgaggctccagaggatgtcatatgggagttttagagagctgtgtcccaaggatgaa

SEQ ID NO: 164104 - DNA, 3689 bp, Homo sapiens
  Payload ID: 12308
  Gene Symbol: PDZD4
  Gene Name: PDZ domain containing 4
  Uniprot ID: Q76G19
  ENST ID: ENST00000164640
  CDS Start-End: 193-2502
agcgaagagttaacctgaggggcgagccgctgcccccacctcgggggcgtgcccccctcccccgctaggcggcccgccccccgcgccagggtatggcccctggccccggcccgggacccgaggtcccgcgcccgggtcagtgaaaggcgtcttcccgttcccgccctccgcctcctctcgccggccagcaacatgggatgtaatatgtgcgtggtccagaaaccggaggagcagtacaaagtgatgctgcaggtgaacgggaaggagctctccaagctgtctcaggagcaaactctgcaggccctgcgctcctccaaggagcccctggtgatccaggtgctgagacgcagcccccgcctccggggggacagctcctgtcacgacctgcagctggtggacagtggcactcagaccgacatcaccttcgagcatatcatggcgctgggcaagctgcgtccgcccaccccgcccatggtcatcctggagccccccccaatcagccatgagtattatgacccggcggagtttatggagggcggcccgcaggaggcagaccgcttggatgagctggagtatgaggaggtggagctgtataaaagcagccaccgggacaagctgggcctgatggtttgctaccgcacggacgacgaggaggacctgggcatttatgtcggagaggtaaatcccaacagcattgcagccaaagacggccggatccgtgagggagaccgcatcatccagattaacggtgtagacgtccagaaccgggaagaggcggtggccatcctgagccaggaagagaacaccaacatctccctgctggtggcccgacctgagagtcagctggcgaaaaggtggaaggacagcgaccgggatgacttcctggatgactttggctctgagaatgagggggagctgcgtgctcgtaaactgaaatcaccccctgcccagcagcccggaaacgaagaggagaagggggctcccgatgccggcccaggcctgagcaacagccaggagctggacagcggggtgggccggactgacgagagcacccggaacgaagagagctctgagcacgacctgctgggggacgaacccccgagctccaccaacaccccgggaagcctgcgcaagtttggcctgcaaggggacgccctgcagagccgggacttccatttcagcatggactctctgctggccgagggggcggggctgggagggggcgacgtcccgggcctcacggatgaggagtatgagcgctaccgtgagctcctggagatcaagtgccacctggagaacggcaaccagctgggcctcctctttccccgggcctccggaggcaacagcgccctggacgtcaaccgcaacgagagcctgggccacgagatggccatgctggaggaggagctaaggcacctggaattcaagtgccgcaacatactgcgggcgcagaagatgcagcagctgcgtgagcgctgcatgaaggcctggctgctggaggaggagagcctctacgacctggcggccagcgagcccaagaagcacgagctgtccgacatctccgagctgcccgagaagtcggacaaggacagcaccagcgcctacaacactggggagagctgccgcagcaccccgctgcttgtggagcccctgcccgagagccccctgcggcgggccatggccggcaactccaacttgaaccggacccctcccggccccgctgttgccacccccgccaaggcagctcctccaccggggagccccgccaagttccggtccctctcccgggatcctgaggccggccggaggcagcacgcggaggagcgcggccgccgcaaccccaagacggggttgaccctggagcgtgtgggccctgaaagcagcccttacctctcgcggcgccaccgcggccagggccaggagggcgagcactaccacagctgcgtgcagctggccccgacgcgaggcctggaggagctgggccacggccccctgagcttggccggtggccctcgggtgggcggggtggcggccgcggccactgaagcaccgcgcatggagtggaaagtgaaggtgcgcagcgacggaacccgctacgtggccaagcggcccgtgcgagatcggctgctgaaagcccgtgccctgaagatccgggaggagcgcagcggtatgacgaccgacgacgacgcggtgagcgagatgaagatgggccgctactggagcaaggaggagcggaagcagcacctgatccgggcccgtgagcagcggaagcggcgcgagttcatgatgcagagccggctggagtgcctgcgggagcagcagaatggcgacagcaagcccgagctcaacatcattgccctgagccaccgcaaaaccatgaagaagcggaacaagaagatcctggacaactggatcaccatccaggagatgctggcccacggcgcgcgctccgccgatggcaagcgggtctacaaccctcttctctcagtcaccaccgtgtgagctgcccgggcgggtacacggcccaggcccagggaaccccctggggccccggccctcactctcctatagagattgtgtgtgtgtgtgtgtgcgcgcgcgcgtgctcgctgtgcgcacgcacacatctcctcgtctgggtgtgcgcacagggctttgttagcagagagaagcccctgaggagaagggacgcttttcttccttctgcccaagtaaagtgaccatgccagtggccagcactgggggcacacctgtgatgggcaccccttcagctgtgcgtgtgcattccccatcccccatgctcttgcgtgtgcttgcacgtgcacgcacacacacacccagtgctctctccacccgacccgtgtacttgcagacagggaagctgagctgaaaggagcacaagagagtgtccggcttcgctgctgagcgcggcctctccccgccgctgcgcactgcagttatttgtagacaaaggcacccctgatttttgtggtttttctccctttctgtgcttgccaatagttgttttgttttgtggacctgccctgggggctggcagctccttcaggcagcctggcagaagtggaactcccctctccactgatggctgggaagggagttggggaggaagagtgggagggagggctggggatggatgggagggaaggggagggaaaggtgggaggaatgggaagcagctgttctggtggcttccactctgaggtgtgggaacggggagcctctggggggcacctgtttccccagtgactcagagagagcaagactgcaggaacggaggggtcctgcagggtgtccaccaagaagtcacagagcccgttctgcgccccacaccatctggagcaggggcttctcttctgagtgaactgaggaaggtgcttagatggtgagggctctagaaaccaagccccatgagcagcagtggaagacctcgggccatgcggcctggggaggacttggtggcgatccgcaacctggaccccagtgagaggcggtgggctgactgggaaggagaggcccccaacctcctcaggatttgcacgtgtgaactaggctgcctgtggggtgccccttaggcttggagagccccagattggaggcagacagactgcaccaccccttccccccctgcatctcaagaataaagcaagctgcctttgtacttggttgaa

SEQ ID NO: 164105 - DNA, 3763 bp, Homo sapiens
  Payload ID: 12308
  Gene Symbol: PDZD4
  Gene Name: PDZ domain containing 4
  ENST ID: ENST00000393758
  CDS Start-End: 251-2578
cgctgccctttttctcctggccgggtgcgagggagcatgcccgcgcctggcctcggccagcgaagagttaacctgaggggcgagccgctgcccccacctcgggggcgtgcccccctcccccgctaggcggcccgccccccgcgccagggtatggcccctggccccggcccgggacccgaggtcccgcgcccgggtcagtgaaaggcgtcttcccgttcccgccctccgcctcctctcgccggccagcaacatgggatgtaatatgtgcgtggtccagaaaccggaggagcagtacaaagtgatgctgcaggtgaacgggaaggagctctccaagctgtctcaggagcaaactctgcaggccctgcgctcctccaaggagcccctggtgatccaggtgctgagacgcagcccccgcctccggggggacagctcctgtcacgacctgcagctggtggacagtggcactcagaccgacatcaccttcgagcatatcatggcgctgggcaagctgcgtccgcccaccccgcccatggtcatcctggagccgtacgtcctctctgagctccccccaatcagccatgagtattatgacccggcggagtttatggagggcggcccgcaggaggcagaccgcttggatgagctggagtatgaggaggtggagctgtataaaagcagccaccgggacaagctgggcctgatggtttgctaccgcacggacgacgaggaggacctgggcatttatgtcggagaggtaaatcccaacagcattgcagccaaagacggccggatccgtgagggagaccgcatcatccagattaacggtgtagacgtccagaaccgggaagaggcggtggccatcctgagccaggaagagaacaccaacatctccctgctggtggcccgacctgagagtcagctggcgaaaaggtggaaggacagcgaccgggatgacttcctggatgactttggctctgagaatgagggggagctgcgtgctcgtaaactgaaatcaccccctgcccagcagcccggaaacgaagaggagaagggggctcccgatgccggcccaggcctgagcaacagccaggagctggacagcggggtgggccggactgacgagagcacccggaacgaagagagctctgagcacgacctgctgggggacgaacccccgagctccaccaacaccccgggaagcctgcgcaagtttggcctgcaaggggacgccctgcagagccgggacttccatttcagcatggactctctgctggccgagggggcggggctgggagggggcgacgtcccgggcctcacggatgaggagtatgagcgctaccgtgagctcctggagatcaagtgccacctggagaacggcaaccagctgggcctcctctttccccgggcctccggaggcaacagcgccctggacgtcaaccgcaacgagagcctgggccacgagatggccatgctggaggaggagctaaggcacctggaattcaagtgccgcaacatactgcgggcgcagaagatgcagcagctgcgtgagcgctgcatgaaggcctggctgctggaggaggagagcctctacgacctggcggccagcgagcccaagaagcacgagctgtccgacatctccgagctgcccgagaagtcggacaaggacagcaccagcgcctacaacactggggagagctgccgcagcaccccgctgcttgtggagcccctgcccgagagccccctgcggcgggccatggccggcaactccaacttgaaccggacccctcccggccccgctgttgccacccccgccaaggcagctcctccaccggggagccccgccaagttccggtccctctcccgggatcctgaggccggccggaggcagcacgcggaggagcgcggccgccgcaaccccaagacggggttgaccctggagcgtgtgggccctgaaagcagcccttacctctcgcggcgccaccgcggccagggccaggagggcgagcactaccacagctgcgtgcagctggccccgacgcgaggcctggaggagctgggccacggccccctgagcttggccggtggccctcgggtgggcggggtggcggccgcggccactgaagcaccgcgcatggagtggaaagtgaaggtgcgcagcgacggaacccgctacgtggccaagcggcccgtgcgagatcggctgctgaaagcccgtgccctgaagatccgggaggagcgcagcggtatgacgaccgacgacgacgcggtgagcgagatgaagatgggccgctactggagcaaggaggagcggaagcagcacctgatccgggcccgtgagcagcggaagcggcgcgagttcatgatgcagagccggctggagtgcctgcgggagcagcagaatggcgacagcaagcccgagctcaacatcattgccctgagccaccgcaaaaccatgaagaagcggaacaagaagatcctggacaactggatcaccatccaggagatgctggcccacggcgcgcgctccgccgatggcaagcgggtctacaaccctcttctctcagtcaccaccgtgtgagctgcccgggcgggtacacggcccaggcccagggaaccccctggggccccggccctcactctcctatagagattgtgtgtgtgtgtgtgtgcgcgcgcgcgtgctcgctgtgcgcacgcacacatctcctcgtctgggtgtgcgcacagggctttgttagcagagagaagcccctgaggagaagggacgcttttcttccttctgcccaagtaaagtgaccatgccagtggccagcactgggggcacacctgtgatgggcaccccttcagctgtgcgtgtgcattccccatcccccatgctcttgcgtgtgcttgcacgtgcacgcacacacacacccagtgctctctccacccgacccgtgtacttgcagacagggaagctgagctgaaaggagcacaagagagtgtccggcttcgctgctgagcgcggcctctccccgccgctgcgcactgcagttatttgtagacaaaggcacccctgatttttgtggtttttctccctttctgtgcttgccaatagttgttttgttttgtggacctgccctgggggctggcagctccttcaggcagcctggcagaagtggaactcccctctccactgatggctgggaagggagttggggaggaagagtgggagggagggctggggatggatgggagggaaggggagggaaaggtgggaggaatgggaagcagctgttctggtggcttccactctgaggtgtgggaacggggagcctctggggggcacctgtttccccagtgactcagagagagcaagactgcaggaacggaggggtcctgcagggtgtccaccaagaagtcacagagcccgttctgcgccccacaccatctggagcaggggcttctcttctgagtgaactgaggaaggtgcttagatggtgagggctctagaaaccaagccccatgagcagcagtggaagacctcgggccatgcggcctggggaggacttggtggcgatccgcaacctggaccccagtgagaggcggtgggctgactgggaaggagaggcccccaacctcctcaggatttgcacgtgtgaactaggctgcctgtggggtgccccttaggcttggagagccccagattggaggcagacagactgcaccaccccttccccccctgcatctcaagaataaagcaagctgcctttgtacttggttg

SEQ ID NO: 164106 - DNA, 3418 bp, Homo sapiens
  Payload ID: 12308
  Gene Symbol: PDZD4
  Gene Name: PDZ domain containing 4
  Uniprot ID: Q76G19
  ENST ID: ENST00000544474
  CDS Start-End: 251-2233
cgctgccctttttctcctggccgggtgcgagggagcatgcccgcgcctggcctcggccagcgaagagttaacctgaggggcgagccgctgcccccacctcgggggcgtgcccccctcccccgctaggcggcccgccccccgcgccagggtatggcccctggccccggcccgggacccgaggtcccgcgcccgggtcagtgaaaggcgtcttcccgttcccgccctccgcctcctctcgccggccagcaacatgggatgtaatatgtgcgtggtccagaaaccggaggagcagtacaaagtgatgctgcaggaggtggagctgtataaaagcagccaccgggacaagctgggcctgatggtttgctaccgcacggacgacgaggaggacctgggcatttatgtcggagaggtaaatcccaacagcattgcagccaaagacggccggatccgtgagggagaccgcatcatccagattaacggtgtagacgtccagaaccgggaagaggcggtggccatcctgagccaggaagagaacaccaacatctccctgctggtggcccgacctgagagtcagctggcgaaaaggtggaaggacagcgaccgggatgacttcctggatgactttggctctgagaatgagggggagctgcgtgctcgtaaactgaaatcaccccctgcccagcagcccggaaacgaagaggagaagggggctcccgatgccggcccaggcctgagcaacagccaggagctggacagcggggtgggccggactgacgagagcacccggaacgaagagagctctgagcacgacctgctgggggacgaacccccgagctccaccaacaccccgggaagcctgcgcaagtttggcctgcaaggggacgccctgcagagccgggacttccatttcagcatggactctctgctggccgagggggcggggctgggagggggcgacgtcccgggcctcacggatgaggagtatgagcgctaccgtgagctcctggagatcaagtgccacctggagaacggcaaccagctgggcctcctctttccccgggcctccggaggcaacagcgccctggacgtcaaccgcaacgagagcctgggccacgagatggccatgctggaggaggagctaaggcacctggaattcaagtgccgcaacatactgcgggcgcagaagatgcagcagctgcgtgagcgctgcatgaaggcctggctgctggaggaggagagcctctacgacctggcggccagcgagcccaagaagcacgagctgtccgacatctccgagctgcccgagaagtcggacaaggacagcaccagcgcctacaacactggggagagctgccgcagcaccccgctgcttgtggagcccctgcccgagagccccctgcggcgggccatggccggcaactccaacttgaaccggacccctcccggccccgctgttgccacccccgccaaggcagctcctccaccggggagccccgccaagttccggtccctctcccgggatcctgaggccggccggaggcagcacgcggaggagcgcggccgccgcaaccccaagacggggttgaccctggagcgtgtgggccctgaaagcagcccttacctctcgcggcgccaccgcggccagggccaggagggcgagcactaccacagctgcgtgcagctggccccgacgcgaggcctggaggagctgggccacggccccctgagcttggccggtggccctcgggtgggcggggtggcggccgcggccactgaagcaccgcgcatggagtggaaagtgaaggtgcgcagcgacggaacccgctacgtggccaagcggcccgtgcgagatcggctgctgaaagcccgtgccctgaagatccgggaggagcgcagcggtatgacgaccgacgacgacgcggtgagcgagatgaagatgggccgctactggagcaaggaggagcggaagcagcacctgatccgggcccgtgagcagcggaagcggcgcgagttcatgatgcagagccggctggagtgcctgcgggagcagcagaatggcgacagcaagcccgagctcaacatcattgccctgagccaccgcaaaaccatgaagaagcggaacaagaagatcctggacaactggatcaccatccaggagatgctggcccacggcgcgcgctccgccgatggcaagcgggtctacaaccctcttctctcagtcaccaccgtgtgagctgcccgggcgggtacacggcccaggcccagggaaccccctggggccccggccctcactctcctatagagattgtgtgtgtgtgtgtgtgcgcgcgcgcgtgctcgctgtgcgcacgcacacatctcctcgtctgggtgtgcgcacagggctttgttagcagagagaagcccctgaggagaagggacgcttttcttccttctgcccaagtaaagtgaccatgccagtggccagcactgggggcacacctgtgatgggcaccccttcagctgtgcgtgtgcattccccatcccccatgctcttgcgtgtgcttgcacgtgcacgcacacacacacccagtgctctctccacccgacccgtgtacttgcagacagggaagctgagctgaaaggagcacaagagagtgtccggcttcgctgctgagcgcggcctctccccgccgctgcgcactgcagttatttgtagacaaaggcacccctgatttttgtggtttttctccctttctgtgcttgccaatagttgttttgttttgtggacctgccctgggggctggcagctccttcaggcagcctggcagaagtggaactcccctctccactgatggctgggaagggagttggggaggaagagtgggagggagggctggggatggatgggagggaaggggagggaaaggtgggaggaatgggaagcagctgttctggtggcttccactctgaggtgtgggaacggggagcctctggggggcacctgtttccccagtgactcagagagagcaagactgcaggaacggaggggtcctgcagggtgtccaccaagaagtcacagagcccgttctgcgccccacaccatctggagcaggggcttctcttctgagtgaactgaggaaggtgcttagatggtgagggctctagaaaccaagccccatgagcagcagtggaagacctcgggccatgcggcctggggaggacttggtggcgatccgcaacctggaccccagtgagaggcggtgggctgactgggaaggagaggcccccaacctcctcaggatttgcacgtgtgaactaggctgcctgtggggtgccccttaggcttggagagccccagattggaggcagacagactgcaccaccccttccccccctgcatctcaagaataaagcaagctgcctttgtacttggttg

SEQ ID NO: 164107 - DNA, 876 bp, Homo sapiens
  Payload ID: 12308
  Gene Symbol: PDZD4
  Gene Name: PDZ domain containing 4
  ENST ID: ENST00000480650
  CDS Start-End: 67-435
cgcgcccgggtcagtgaaaggcgtcttcccgttcccgccctccgcctcctctcgccggccagcaacatgggatgtaatatgtgcgtggtccagaaaccggaggagcagtacaaagtgatgctgcaggtgaacgggaaggagctctccaagctgtctcaggagcaaactctgcaggccctgcgctcctccaaggagcccctggtgatccaggtgctgagacgcagcccccgcctccggggggacagctcctgtcacgacctgcagctggtggacagtggcactcagaccgacatcaccttcgagcatatcatggcgctgggcaagctgcgtccgcccaccccgcccatggtcatcctggagccgtacgtcctctctgagctggccgagggaggaccctcctgtccgggacgtcgctgccggaagtgccagggttgagggcctcagctcctcctcctccatcctctctcctctgccgcctcacaagcatcactccttgaatcttcttgcatcccttgtctgtctcattcctctacctgctctgaatttcctccatctcttcagcttctttctttggcccgaccggaagaagggcctttcatccaggcctggtggctcatgaccgcccccccaatcagccatgagtattatgacccggcggagtttatggagggcggcccgcaggaggcagaccgcttggatgagctggagtatgaggaggtggagctgtataaaagcagccaccgggacaagctgggcctgatggtttgctaccgcacggacgacgaggaggacctgggcatttatgtcggagaggtaaatcccaacagcattgcagccaaagacggccggatccgtgagggagaccgcatcatccag

SEQ ID NO: 164108 - DNA, 2032 bp, Homo sapiens
  Payload ID: 12309
  Gene Symbol: PDZD7
  Gene Name: PDZ domain containing 7
  Uniprot ID: Q9H5P4
  ENST ID: ENST00000370215
  CDS Start-End: 227-1780
cggcagtagctctcgcctgcgggtggtttgacaaggctggcggcgccacaccagcgaccaggcctggagctcacacttctgagaggcatcgcaagcgagggccttcacgttactgagaccccagccccgcacagaggctcatggagctcgaagcacgcagggctggcctctccagagctagcagattccttctggacctgtagggtgccgccctagcccagccgccatggcgcagggtttcgcagtgggcttcgacccactgggcctaggagacctgagctccggctctctgagctccctctcctcccgaggccacctaggcagcgactcaggctccaccgcaacgcgatacctgctaaggaagcaacaacggctgctgaacgggcccccccgcggaatccgagcctcatcgcccatgggacgcgtcatcctcatcaactcccccatcgaagccaacagtgatgaaagtgacatcatccattcagtccgggtggagaagagtccagcagggaggctgggcttcagcgtgcgcgggggctcagagcatggcctgggcatcttcgtcagcaaagtggaggaaggcagcagtgcagagcgggctggcctgtgcgtgggggacaagatcacggaggtgaatgggctgagcctggagagcaccaccatgggtagcgccgtaaaggtgctgaccagcagcagccgcctgcacatgatggttcggcgcatgggccgtgtgccgggcatcaagttctccaaggagaagaccacgtgggtggatgtggtgaatcggcgcctggtagtggagaagtgcggttcaacaccctccgacaccagctcagaagatggtgtccggcgcatcgtccacctatacacaacctccgacgacttctgcctgggcttcaacatccgtgggggcaaggagtttggcctgggcatctatgtgtccaaagtggaccatggtgggctggccgaggagaatggcatcaaggtgggggaccaggtcctggcagccaacggtgtcaggtttgacgacatcagccacagccaggccgtggaggtgctgaagggccaaacgcacatcatgctgaccatcaaggagaccggccggtatcctgcctacaaggagatggtttctgagtactgctggctggaccgactgagcaacggggtgctgcagcagctgtccccggcctctgagagcagctccagcgtctcttcgtgcgcctccagcgccccctacagctcgggctccctgccgtcggaccgcatggacatctgcctcgggcaggaggagcccggcagccgcggcccaggctgggggcgggcggacacagccatgcagacggagcccgatgcgggaggccgggtggagacctggtgcagcgtgcggcccacagtcatcctcagggacaccgccatccgctcggacggcccccatcccggccgccgccttgactctgcgctctctgagtctcccaagacggctttgctgctggccctcagccgaccccggccccccatcacgcgctcccagagctatctgaccttgtgggaggagaagcagcagcggaagaaggagaagtcggggtcccctggggagaagggtgccctgcagcgctccaagacgctgatgaacctcttcttcaagggagggcggcaggggaggctagcgcgggacgggcgcagagaggcctggacactggacagcgggagcctggccaaaacttaccctcgcctggacatagagaaagagatgggggtttcaccctgttgcccaggctagtctcaaattcctggactgaagctatctacccgccttagtctcccaaagtgctaggattacagcgtgatctaccacacctggccaatcccaactactctggaagctgaagcagcaagatcacttgagcccaggagtttaagaccagcctgggcaacatagcaagaccctgtctctaaagaaaaaaaaaaagtaaaagaaaaataaagcacgtcttggctcagctgctgatttaagctgggtctaaacatctga

SEQ ID NO: 164109 - DNA, 624 bp, Homo sapiens
  Payload ID: 12309
  Gene Symbol: PDZD7
  Gene Name: PDZ domain containing 7
  ENST ID: ENST00000433616
  CDS Start-End: 1-624
gaccccggccccccatcacgcgctcccagagctatctgaccttgtgggaggagaagcagcagcggaagaaggagaagtcggggtcccctggggagaagggtgccctgcagcgctccaagacgctgatgaacctcttcttcaagggagggcggcaggggaggctagcgcgggacgggcgcagagaggcctggacactggacagcgggagcctggccaaaacttaccctcgcctggacatagagaaagcagggggcgtgggcccggtacagaagtttgtcacctggagactgagacgtgaccaggagaggggccgggccctgctgtctgccaggtctgggagtccctccagccagctgcctaatgtggatgagcaggttcaggcctgggagagccggcggcccctcattcaggacctggcccagaggctgctgactgatgacgaggtgctggctgtcacccgccactgctcccggtatgtgcacgagggaggcatagaggacctggtgaggcccctgctggccatcctcgacaggccggagaagctgctactgctgcaggacatcaggagtgtggtggcccccacagacctgggccgcttcgacagcatggtgatgcttgtggagc

SEQ ID NO: 164110 - DNA, 4433 bp, Homo sapiens
  Payload ID: 12309
  Gene Symbol: PDZD7
  Gene Name: PDZ domain containing 7
  ENST ID: ENST00000474125
  CDS Start-End: 199-600
tgacaaggctggcggcgccacaccagcgaccaggcctggagctcacacttctgagaggcatcgcaagcgagggccttcacgttactgagaccccagccccgcacagaggctcatggagctcgaagcacgcagggctggcctctccagagctagcagattccttctggacctgtagggtgccgccctagcccagccgccatggcgcagggtttcgcagtgggcttcgacccactgggcctaggagacctgagctccggctctctgagctccctctcctcccgaggccacctaggcagcgactcaggctccaccgcaacgcgatacctgctaaggaagcaacaacggctgctgaacgggcccccccgcggaatccgagcctcatcgcccatgggacgcgtcatcctcatcaactcccccatcgaagccaacagtgatgaaagtgacatcatccattcagtccgggtggagaagagtccagcagggaggctgggcttcagcgtgcgcgggggctcagagcatggcctgggcatcttcgtcagcaaagtggaggaaggcagcagtgcaggtaagcagaacccccaggctgaagtccacgcttaggatgtgactccaatctcagtgaatggcaggggatgctgctgtcagggacagacggaagagtccccagctctggagggcctgattgatggggagacagggccaaccctcaagtcagaatggtttaagggacagatccctaggcactgggaacactcagcccctgctctgacaatcctcactctgattgagaagctcagtttgaccccagggagctccatctgatgggggaggctcagccccaccctggggacccatgccagccactcccatcctgtggtgcagagcgggctggcctgtgcgtgggggacaagatcacggaggtgaatgggctgagcctggagagcaccaccatgggtagcgccgtaaaggtgctgaccagcagcagccgcctgcacatgatggttcggcgcatgggccgtgtgccgggcatcaagttctccaaggagaagaccacgtgggtggatgtggtgaatcggcgcctggtagtggagaagtgcggttcaacaccctccgacaccagctcagaagatggtgtccggcgcatcgtccacctatacacaacctccgacgacttctgcctgggcttcaacatccgtgggggcaaggagtttggcctgggcatctatgtgtccaagtgagggctgaggcaggaagtgtcttcgggtagaactgagaatggggtctggagtggggcctaggctgggatgtggggatggtcagcaagtgaggcctggccaaccacctgtctcagtgagggcctgggagggggcgggaggccccagtaggagggtcaaggaccttgactggtgcagtcttgtgtccaagagaagggggtctggagtggggtaacggagggcaggccaggggcctatcagactgacgcctgtctggcctcagagtggaccatggtgggctggccgaggagaatggcatcaaggtgggggaccaggtcctggcagccaacggtgtcaggtttgacgacatcagccacagccaggccgtggaggtgctgaagggccaaacgcacatcatgctgaccatcaaggagaccggccggtatcctgcctacaaggagatggtttctgagtactgctggctggaccgactgagcaacggggtgctgcagcagctgtccccggcctctgagagcagctccagcgtctcttcgtgcgcctccagcgccccctacagctcgggctccctgccgtcggaccgcatggacatctgcctcgggcaggaggagcccggcagccgcggcccaggctgggggcgggcggacacagccatgcagacggagcccgatgcgggaggccgggtggagacctggtgcagcgtgcggcccacagtcatcctcagggacaccgccatccgctcggacggcccccatcccggccgccgccttgactctgcgctctctgagtctcccaagacggctttgctgctggccctcagccgaccccggccccccatcacgcgctcccagagctatctgaccttgtgggaggagaagcagcagcggaagaaggagaagtcggggtcccctggggagaagggtgccctgcagcgctccaagacgctgatgaacctcttcttcaagggagggcggcaggggaggctagcgcgggacgggcgcagagaggcctggacactggacagcgggagcctggccaaaacttaccctcgcctggacatagagaaagtatgtgcacgagggaggcatagaggacctggtgaggcccctgctggccatcctcgacaggccggagaagctgctactgctgcaggacatcaggagtgtggtggcccccacagacctgggccgcttcgacagcatggtgatgcttgtggagctggaggcttttgaggccctcaagagcagggcagtccggcctcctgctttgagaccagcccggcaggacacgccacccaagcgtcaccttatcacccccgtgcctgccgcggaggcttctacctgctgccggtgaacggcttcccggaagaggaagataatggggagctgagggagcggctgggggccctcaaggtctccccaagtgcctctgcccctcgccacccccataaagggatcccccctctacaagacgtgccagtagatgccttcacccccctccgaattgcctgcacaccccctccccagctaccccccgtggctccccggcccctgcggcctaactggctgctgacagaacccctgagccgagagcaccctccgcagagccagatccggggccgggctcagagccgtagccgcagccgtagccgcagccgcagccgcagcagccggggtcaaggcaagtctccaggtagacgctccccatccccggtgcctacccctgcccccagcatgaccaatgggcgctaccacaagcctcggaaggccagaccccctctgccacgacctctggatggggaggcagccaaggtgggggccaagcaagggccctcggagagtggaactgaggggacggccaaggaggcagccatgaagaaccccagtggcgagctgaagacagtgacactgtccaagatgaagcagtccttaggtatcagcatttctgggggcattgagtccaaggtgcagcccatggtgaagatagagaagatcttccctgggggggccgctttcctcagtggggccctgcaggctggcttcgagcttgtggcagtggacggagagaatctagagcaggtgacccaccagcgtgcagtagacaccatccgtcgggcttatcgaaacaaggcccgggagcccatggagcttgtggtcagggtccccgggcccagcccacggccctcaccctctgactcatcagcccttactgatgggggccttcctgctgaccacttgcctgcccaccaaccccttgatgctgctccagttcctgcccactggctcccagaacctcccaccaatccccagactcctcccactgatgccaggctcctccagccaactcccagcccagccccctccccagccctccagactcctgattctaagcccgcaccctccccacgcatcccatgaccctccccctaacctcagattcacccactgactccagcatcccgttatccccaggacctctcctaccaacttcttcaggactctccagctcctgcccaccctgcctcctcccagtgccacactggtggctcacatctttccactttcttccctcctcagctgtcattaaggctctgccttagtgtccaaggacaaggtgctagtgggcagcctgtgtcacctgcactcactgctccccaacctcccaagccaggatagggggtgagaaagccaaggtctggagcttgggattggtgggcactttctcacatgctgtcccttatgagtcgcccaagcctccagggacacagactctcagacagggccctgaaggggtcaatgcatccattcctcaaccccaagcagcattctgtgcaaggaaacggatgaaaggcttttctagtccctgaaatcctgagagatcatttcacgttggggtccactaagacctcagacattctactggatttgtccttcctccatcaccttttctccccaagagagctctatgagggggaggagaatagccagcaaatggtgggggggggggggtcaaacaagttcctgtactctttatccagcacattcacattatttttaaacaaaaaaattttttttaattttttctttgggtttgtacaagaaatttacagtgtgaaaaatatacaagtgaaaacgaggccataaacctgggtgaagggagaggctgcttggtcacaaacacaaataaacaagacatttctga

SEQ ID NO: 164111 - DNA, 1057 bp, Homo sapiens
  Payload ID: 12309
  Gene Symbol: PDZD7
  Gene Name: PDZ domain containing 7
  ENST ID: ENST00000470414
  CDS Start-End: 208-753
cgggtggtttgacaaggctggcggcgccacaccagcgaccaggcctggagctcacacttctgagaggcatcgcaagcgagggccttcacgttactgagaccccagccccgcacagaggctcatggagctcgaagcacgcagggctggcctctccagagctagcagattccttctggacctgtagggtgccgccctagcccagccgccatggcgcagggtttcgcagtgggcttcgacccactgggcctaggagacctgagctccggctctctgagctccctctcctcccgaggccacctaggcagcgactcaggctccaccgcaacgcgatacctgctaaggaagcaacaacggctgctgaacgggcccccccgcggaatccgagcctcatcgcccatgggacgcgtcatcctcatcaactcccccatcgaagccaacagtgatgaaagtgacatcatccattcagtccgggtggagaagagtccagcagggaggctgggcttcagcgtgcgcgggggctcagagcatggcctgggcatcttcgtcagcaaagtggaggaaggcagcagtgcagagcgggctggcctgtgcgtgggggacaagatcacggaggtgaatgggctgagcctggagagcaccaccatgggtagcgccgtaaaggtgctgaccagcagcagccgcctgcacatgatggttcggcgcatgggccgtgtgccgggcatcaagttctccaaggagaagaccacgtggtgagcagcaactccctcatcctagccctggccttgccccagcccaccccaaccctaccaacacccaaaacccactggcaggagaggcttctgttcctcctgctcgctggctcaggaaacgcaggggatccaaaggcctgacctcaaaataaggagaggctgcatctttcccctgccctcctccaatagctctgctctcccagatcccagtggttctgctgccacattgccgctgctcctgctgtgaaacccagaggcaaaacaccacctctctacaggggtgctgtaaggattagaaatggggccta

SEQ ID NO: 164112 - DNA, 4135 bp, Homo sapiens
  Payload ID: 12309
  Gene Symbol: PDZD7
  Gene Name: PDZ domain containing 7
  Uniprot ID: Q9H5P4
  ENST ID: ENST00000619208
  CDS Start-End: 251-3352
agcgtgggtggggtttgccggctgcggcagtagctctcgcctgcgggtggtttgacaaggctggcggcgccacaccagcgaccaggcctggagctcacacttctgagaggcatcgcaagcgagggccttcacgttactgagaccccagccccgcacagaggctcatggagctcgaagcacgcagggctggcctctccagagctagcagattccttctggacctgtagggtgccgccctagcccagccgccatggcgcagggtttcgcagtgggcttcgacccactgggcctaggagacctgagctccggctctctgagctccctctcctcccgaggccacctaggcagcgactcaggctccaccgcaacgcgatacctgctaaggaagcaacaacggctgctgaacgggcccccccgcggaatccgagcctcatcgcccatgggacgcgtcatcctcatcaactcccccatcgaagccaacagtgatgaaagtgacatcatccattcagtccgggtggagaagagtccagcagggaggctgggcttcagcgtgcgcgggggctcagagcatggcctgggcatcttcgtcagcaaagtggaggaaggcagcagtgcagagcgggctggcctgtgcgtgggggacaagatcacggaggtgaatgggctgagcctggagagcaccaccatgggtagcgccgtaaaggtgctgaccagcagcagccgcctgcacatgatggttcggcgcatgggccgtgtgccgggcatcaagttctccaaggagaagaccacgtgggtggatgtggtgaatcggcgcctggtagtggagaagtgcggttcaacaccctccgacaccagctcagaagatggtgtccggcgcatcgtccacctatacacaacctccgacgacttctgcctgggcttcaacatccgtgggggcaaggagtttggcctgggcatctatgtgtccaaagtggaccatggtgggctggccgaggagaatggcatcaaggtgggggaccaggtcctggcagccaacggtgtcaggtttgacgacatcagccacagccaggccgtggaggtgctgaagggccaaacgcacatcatgctgaccatcaaggagaccggccggtatcctgcctacaaggagatggtttctgagtactgctggctggaccgactgagcaacggggtgctgcagcagctgtccccggcctctgagagcagctccagcgtctcttcgtgcgcctccagcgccccctacagctcgggctccctgccgtcggaccgcatggacatctgcctcgggcaggaggagcccggcagccgcggcccaggctgggggcgggcggacacagccatgcagacggagcccgatgcgggaggccgggtggagacctggtgcagcgtgcggcccacagtcatcctcagggacaccgccatccgctcggacggcccccatcccggccgccgccttgactctgcgctctctgagtctcccaagacggctttgctgctggccctcagccgaccccggccccccatcacgcgctcccagagctatctgaccttgtgggaggagaagcagcagcggaagaaggagaagtcggggtcccctggggagaagggtgccctgcagcgctccaagacgctgatgaacctcttcttcaagggagggcggcaggggaggctagcgcgggacgggcgcagagaggcctggacactggacagcgggagcctggccaaaacttaccctcgcctggacatagagaaagcagggggcgtgggcccggtacagaagtttgtcacctggagactgagacgtgaccaggagaggggccgggccctgctgtctgccaggtctgggagtccctccagccagctgcctaatgtggatgagcaggttcaggcctgggagagccggcggcccctcattcaggacctggcccagaggctgctgactgatgacgaggtgctggctgtcacccgccactgctcccggtatgtgcacgagggaggcatagaggacctggtgaggcccctgctggccatcctcgacaggccggagaagctgctactgctgcaggacatcaggagtgtggtggcccccacagacctgggccgcttcgacagcatggtgatgcttgtggagctggaggcttttgaggccctcaagagcagggcagtccggcctcctgctttgagaccagcccggcaggacacgccacccaagcgtcaccttatcacccccgtgcctgacagccgcggaggcttctacctgctgccggtgaacggcttcccggaagaggaagataatggggagctgagggagcggctgggggccctcaaggtctccccaagtgcctctgcccctcgccacccccataaagggatcccccctctacaagacgtgccagtagatgccttcacccccctccgaattgcctgcacaccccctccccagctaccccccgtggctccccggcccctgcggcctaactggctgctgacagaacccctgagccgagagcaccctccgcagagccagatccggggccgggctcagagccgtagccgcagccgtagccgcagccgcagccgcagcagccggggtcaaggcaagtctccaggtagacgctccccatccccggtgcctacccctgcccccagcatgaccaatgggcgctaccacaagcctcggaaggccagaccccctctgccacgacctctggatggggaggcagccaaggtgggggccaagcaagggccctcggagagtggaactgaggggacggccaaggaggcagccatgaagaaccccagtggcgagctgaagacagtgacactgtccaagatgaagcagtccttaggtatcagcatttctgggggcattgagtccaaggtgcagcccatggtgaagatagagaagatcttccctgggggggccgctttcctcagtggggccctgcaggctggcttcgagcttgtggcagtggacggagagaatctagagcaggtgacccaccagcgtgcagtagacaccatccgtcgggcttatcgaaacaaggcccgggagcccatggagcttgtggtcagggtccccgggcccagcccacggccctcaccctctgactcatcagcccttactgatgggggccttcctgctgaccacttgcctgcccaccaaccccttgatgctgctccagttcctgcccactggctcccagaacctcccaccaatccccagactcctcccactgatgccaggctcctccagccaactcccagcccagccccctccccagccctccagactcctgattctaagcccgcaccctccccacgcatcccatgaccctccccctaacctcagattcacccactgactccagcatcccgttatccccaggacctctcctaccaacttcttcaggactctccagctcctgcccaccctgcctcctcccagtgccacactggtggctcacatctttccactttcttccctcctcagctgtcattaaggctctgccttagtgtccaaggacaaggtgctagtgggcagcctgtgtcacctgcactcactgctccccaacctcccaagccaggatagggggtgagaaagccaaggtctggagcttgggattggtgggcactttctcacatgctgtcccttatgagtcgcccaagcctccagggacacagactctcagacagggccctgaaggggtcaatgcatccattcctcaaccccaagcagcattctgtgcaaggaaacggatgaaaggcttttctagtccctgaaatcctgagagatcatttcacgttggggtccactaagacctcagacattctactggatttgtccttcctccatcaccttttctccccaagagagctctatgagggggaggagaatagccagcaaatggtgggggggggggggtcaaacaagttcctgtactctttatccagcacattcacattatttttaaacaaaaaaattttttttaattttttctttgggtttgtacaagaaatttacagtgtgaaaaatatacaagtgaaaacgaggccataaacctgggtgaagggagaggctgcttggtcacaaacacaaataaacaagacatttctg

SEQ ID NO: 164113 - DNA, 9699 bp, Homo sapiens
  Payload ID: 12310
  Gene Symbol: PDZD8
  Gene Name: PDZ domain containing 8
  Uniprot ID: Q8NEN9
  ENST ID: ENST00000334464
  CDS Start-End: 241-3705
ggtcccggccccgctgccgccgccgccacaccggcccttcgggagcgtctgaggaggcgcgggccgctgcgggctcgggcgccgcagcgcgccggcccgagcccctggacgaggcccacggagccgctcgccccgacccagccgcccgatgtcctcaaaatggaggcagcgggggcggcggcgtgaagaaagcggcgctgtgggcgcgggagtaggggcccgggcggaggcggtggcgggatggggctgctgctcatgatcctggcgtcggccgtgctgggttccttcctcacgctcctcgcccagttcttcctgctgtaccgcagacagcccgagccgccggcggacgaggccgcccgcgcgggcgagggcttccgctacatcaagccagtgccgggcctgctcctaagggagtacctttatggcggcggccgggatgaggagccctccggagcggcccctgagggcggcgcgacccccaccgcggcccccgagacccccgccccgccgacgcgggagacttgctacttcctcaacgccaccatcctattcctgttccgggagttgcgggacaccgcgctgacccgccgctgggtcaccaagaagatcaaggtggagttcgaggagctgctgcagaccaagacggccgggcgcctgctggaggggctgagcctgcgggacgtgttcctgggcgagacggtgcccttcatcaagaccatccggctcgtgcggccagtcgtgccctcggccaccggggagcccgatggccctgaaggggaggcgctgcccgccgcctgccccgaggagctggccttcgaggcggaggtggagtacaacgggggcttccacctggccatcgacgtggacctggtcttcggcaagtccgcctacttgtttgtcaagctgtcccgcgtggtgggaaggctgcgcttggtctttacgcgcgtgcccttcacccactggttcttctccttcgtggaagacccgctgatcgacttcgaggtgcgctcccagtttgaagggcggcccatgccccagctcacctccatcatcgtcaaccagctcaagaagatcatcaagcgcaagcacaccctaccgaattacaagatcaggtttaagccgttttttccataccagaccttgcaaggatttgaagaagatgaagagcatatccatatacaacaatgggcacttactgaaggccgtcttaaagttacgttgttagaatgtagcaggttactcatttttggatcctatgacagagaggcaaatgttcattgcacacttgagttaagcagtagtgtttgggaagaaaaacagaggagttctattaagacggttgaattaataaaaggaaatttacaaagtgttggacttacacttcgtcttgtccagtcaactgatgggtatgctgggcacgtcatcattgaaactgtggctccaaactcgcctgctgcaattgcagatcttcagcggggagatcgacttatcgccattggaggtgtgaaaatcacatcaacactgcaagtgttgaagcttatcaagcaggctggtgaccgagtcctggtgtactatgaaaggcctgttggccagagtaatcaaggtgcagtgctgcaagataactttggccagttggaagaaaactttttgtcaagctcatgccaatcgggttatgaagaggaagctgccgggttgacagtagatactgaaagtagagagctggattctgaatttgaagacttggcaagtgatgtcagagcacaaaatgagttcaaagatgaggcacaatcattaagtcatagtcccaaacgtgttccaacaacactttctattaaaccccttggagctatatcaccagttttaaaccgtaaattagctgtaggaagtcacccactaccaccgaaaattcagtccaaagatggaaataaacctccacccctaaaaacttctgagataacagacccagcacaagtgtcaaaaccaacccaaggatctgctttcaaaccacctgtgccaccacgaccacaagcgaaagttcctttgccttccgccgatgctccaaatcaggcagaaccagatgttctcgttgaaaagccagagaaggtggtgccacctcctcttgtagataaatctgctgaaaagcaagcaaaaaatgtggatgccatagacgatgcagctgcacctaagcaatttttagcaaagcaagaagtggccaaagatgtcacttcagaaacttcctgccctactaaggacagttcggacgaccgtcaaacatgggaatcatcagaaattctttatcgtaataagctaggaaaatggacaagaaccagagcatcctgtttgtttgacatagaagcctgtcacaggtacttaaacattgcattgtggtgcagggatcctttcaagttgggaggtctcatctgtttggggcatgttagtttaaaacttgaagatgtggctttaggatgcctagctacatcaaacacggaatacctttccaaattgagactggaagccccctcacctaaggctatagtcactagaaccgcactacgcaatctgagtatgcaaaagggattcaatgacaaattttgctatggtgacattactattcacttcaaatatttgaaagaaggagaatcagaccaccatgtagttactaacgtagaaaaagaaaaagaaccccatttggttgaagaagtttctgttctccctaaagaggagcaatttgttggacagatgggtttaacagaaaacaaacacagttttcaggatactcagttccagaacccaacatggtgtgactactgtaagaaaaaagtttggactaaagcagcttcccagtgtatgttttgtgcttatgtttgccataaaaaatgtcaagaaaagtgtctagctgagacttctgtttgtggagcaactgataggcgaatagacaggacactgaaaaaccttaggctggaaggacaggaaaccctcttaggcctgcctcctcgtgttgatgctgaagctagcaagtcagtcaataaaacaacaggtttgacaaggcatattatcaatactagttctcgtttattaaatttgcgtcaagtctctaaaactcgcctttctgaaccaggaaccgatctcgtagaaccttcaccaaaacacacacccaacacgtcagacaacgaaggcagtgacacggaggtctgtggtccaaacagtccttctaaacggggaaacagcacaggaataaagttagtgagaaaagagggtggtctggatgacagtgttttcattgcagttaaagaaattggtcgtgatctgtacaggggcttgcctacagaggaaaggatccagaaactagagttcatgttggataagctacagaatgaaattgatcaggagttggaacacaataattcccttgttagagaagaaaaagagacaactgatacaaggaaaaaatcacttctttctgctgccttagctaaatcaggtgaaaggctacaagctctaacacttcttatgattcactacagagcaggcattgaagatatagaaactttagaaagtctgtctttagaccagcactccaaaaaaataagcaagtacacagatgatacagaagaagaccttgataatgaaataagccaactaatagactctcagccattcagcagcatatcagatgacttatttggcccatccgagtctgtgtagcagacaggtctatttaagctttcaaatgaacagggtaaagttgcatctaaagtaccacagatacaaccatgtttaaatcctcgtatgcactctggcctgcttctccagttacttgcttgtgtaagaacaaaaatgagaaaggttgttttccagtaaaaacatgaccagcttactaattggttgttttggattgcatttatagctatgcttttttgggtttatactgggaatttatttttactaaattatttaacttttctaattatgtaattatgtaagctagcttttcatgtttatgtatgtatggtgtccccttgtgttatttttcttcctcttggtttttgaattagtgttaaatagaatactgtctagattcttaaaatattttcatttccatcatggttataacaaatttgctgcatgcccaaactgacaacagcaatcactgagggaacaggttttgaatctttcttttgtgttatgaagtttatcgtctctacttgcttgagatttttgttattttgggggtttgggggtgctttttgttttgtttttgccaaatgtaacatgaaagcagatgctgcagctttagtctgttatgctgatttagtaaaaaaaaattttttacatatattgcttgctttcgatgcttctgtgaaatttttttctaaagcttttgtgcagctgtatggtaaaaatatggtgattaatttgaagagcttacattgaaagacaatgtaataggaaataaatgtagattgcagttggtcaagaattttgtagagaggataacaagacttaattactgaaaaacagtaacatagcattttgaaatataatcttttaaaatattgatgctttccttttaaatggaaatttaaattttataattaaaagtttaaacatttatgataattttcctcatcagttctcccataggaaataaagcatgtgaaagggtatttaaagttttggaggactctttttaaaatgactgtgttgataactagtttgggctggttttgttttagaaaaaacattttcatgtaggagtattctgtgaaggaaaggaatcatgcaaaatatactttttgctttggcgtcttacagttgtaaaggaatggtgatcattctgaatacttctgtagtgagtattcattaagaaaagaatgacaaaaatagtattcatacataggaattgggaccagttctctgaaaatgaagatatactcacactgggtccattttacgggtcccagtaacatttgactgagggaaaacaagtaagctcgactgttgttggggtaccttaatggtttcggtctgttatatacctataaaatagacaagtatatgtttgtccctttgtaggtaactgctatgatgattgctatatagtgaaactgacatgagtttaaaactagatggagcagcttttattgctggcaggaaaaagcatggtgtaatattaaggactggggcccaggtctagactccaggactccataaaagagtttaagttcaagcccttccattaatgaactgtgtaagcataggcagttacaaaaggacccatctctaaaatgggaataataatactttacctccctcacagtattgttgtgagggaaacaatagcataactgcaaaagtgctttgaacagtaaaaagatatacaagtaaaaggcattatttatatgagtaagaaagacatttttgaggggagaaaagttattccactttaaaaatcaatagccaagtctcatgccttttgttactttagtaagcgaaaatttcaggtactaaatacctttcttagccaagtttataacaaaaacatctcagtatacttcattacttatttaagcgtgatgtcttttttttttttttttttttttttttttttttttttttttgagacagagtctcgctgtctcccaggctggagtgcagtggcatgatctcggctcactgcaagctccgcctcccaggttcacgccattctcctgcctcagcctccggagtagctgggagtacaggcgcggctaattttttgtatttttagtagagacggggtttcaccatgttagccaggatggtctcgatctcctgacctcgtgatccacctgcctcggcctcccaaagtgctgggattacaggcgtgagccaccacgcccggccacgtgatcttattttaaaagaacactgctatagaagaatttacacaccaaattccctgaaagctaaagtattgttccataacttacacttgaggcaatctgctcagtgtgtaaccactttataaaaaataacttaccattgataacctggaaggtggactacttgtaagtagctggtgtttattgattaaaccatggaagttttcatgatacccaagcatgttgctgaaactgatgcatttgaaagagctgttgaaataatgcaaaactttggttttataagaatctactcatgttttaaaagtatttaactctgtagaccacaattatagaaagctcagtaatgctgctaatgacatttgtaaactatatctgtaatgtagtgcaatatttttatatttcactgggagaggcagtagagacatcatagttgtactttagtgcaagtgggggaacactccaaatagcctagagtatagtaaggtacaaagcttcaatgaaaaaagctgtattatattacattactgatgtaatcttgctgccatgctatgtatcaatagctaaaaaataataataaagactaccacagaaaacaagaatatcttcatttaatgaaatctttaaaaaaggtgattgctgcatctctatggaattatcttctggtataatttggccatgcagaaaagcataacaaagtccacttttcctaaacaaaattgctgttttgcagactgccccaaaacatttttttactattgtttccttatggattatcaagtttatgggtttcctttggctatgtattagtaattagactttaaaatatattttctacattagtattagctgagtgaatggcttagacaaactgagcaacattttagcattattagcaatcataataggctatacttcttcatatcaagccttatattcaatatcagaagtacttgaaataagtggctattttgtgatgctgggaggagaaaacacaacctaaaaattttgaggggtactatcaagttctaaatgtatagctgaattttttttaaagcaatttggaaatatttggctcttaaaaataagataaataataaaatgttaagtcccctaaaagtgaataaattttaaatacctacttttaaaaatactgtcttctaaattgacataattgcttttcttaccaaaagaaggagaggttcccctaattccttttgggccatagatccgcttttaggatctgattaaagatgtggactttcaccgcaggaagatacccatgggcacaccattcaaaatgtatcagatttcaacggttttacaaactcccccgggattaagtcaaatgggtggatattacagctgttttcatcagatatggttatttgttgacaaccatcaggacaacaatgtttatagatggaaggataacttcctggtttttttccacattgaatgtggctagttacatatctcaatttaaaataaattgtggaaagccaaaaaagtatggtcaagctaacctggggtggcttttacctgatgcctacaagcacagaaaaatagtttttaattaaatatccacagtcaaaatgataccttatgtattttattccaacaacatttggtttataaaggaatacaaacaggcacaaaacatggttcagaagatttattaagtaaacttgctaaaatatggacagatacacttagcagtcaaacagttgaatattcattgctacctcattaaagtttttgtatctgtattaccaggtccaaacataaaaaccacctctgttcaaaaaataaatgttcagagagctgtatgttctttgttctggtatgtacattttaaaaaaacacctctttccagtcttgctaaccaagaatattagtcatataaaagaacttagaatttttttccccaagtacaagctatcttttgctccaaaacagttctgaaggttttatttatattttatcttatcccgagggaccaacagcaggcatacctttgccaggccttcttgcagaaagacacagagccgtaaaggcaaaaataaaattgcaataaagtatatggtattgggggcagggagaaccagaaaccctcaaagagaaccaatttgtagcacgttcttttttaaggctctacccctgtagaagtaagaaactagcctgcctttttagccatatgagagtttcctccagagccatcttccaaagtggcagacttggccaagttgcccaatgccaaataagtgagttggaagttcgtttgcttcaaacacactgcacttagaaaccagacttgaaataatcgaagccccacagaaaagcttcatgaaacgaagtgttactttcctagagaataagaaagtcacaagattgaggagtctgttctaaagttctttgctccttgatgtcgaagttaacacaaacacaatcttagcttaacgaaactaagtaatttttgtttatgattatagaactgcaggattcacaagtagtattagagacattccacactgcacactccagtcatatctcttaacaaaatgacataaattgacaatgttcactaacagtatttgctgttacactgaaaaggcacatcaatgttgtcatgcttagaaaaatacacaacactgcacactggatgatatagttagcacatacatttttagatgttccatttttcttttctgcctgatcactattatttttacttcttaatatatgattcaagacataatttcattcttcattttcatttaaaatttgtcttcacattgatgtgaacaactttcaggagtctaaaaaatagtagtttcagacaacctaaaataaatatattcctagaaaacacttggatgacctgcaaacagatcaaagatatagtcagatattaaagtcagagcagctgttttcagcttcttgtttccttttctaaaacttgaagtagatggcgattaaccttatcatgtttaaacaaccttgacagtataaggtacatgtaccctcaattttcttcatccagtaagacaagtatgcatcttaaagggaaagcttttagttcataacaatatgtttggttgcttttctctgctttcggaacatttactgtttttcctttattggctttagtgtttgctgccaaccagataacatgttaacatataatttacaactctctctaggtaggtgattacatagaaaactaatgccagctaagatttatggattcaaaagataactgacacaagttcttgtcctctacacttgagagaactagctgtttaacgcataaatatattgatagtaactacaagttaaataacattcagtgtcactatataacatgctgtcttacttgattctgtttttcagacttcattctagtttctctttgttggaagagtctcagagataatgtgtgctttaattttaaacactcattaccaatatgatttttgcccaaatgtttgttaatgtaagttaaaaaattatatttggtttggattcaaatatttatagatttacacaatacctatttcatcaaaatatattgtatgatatttaataaaattaaatacataaaataaagtttcaacactatttatacaaacccctagaaaagcttctttttctttataaggctgttggcaatcgaccataaccatggaaaggaaataataacctttggttttactctttcaccagggatggatggtatgactaagacagttctggatgagttgtgtcactggaaacactgttttatacaattaaacactttgatgatttttgagga

SEQ ID NO: 164114 - DNA, 1260 bp, Homo sapiens
  Payload ID: 12311
  Gene Symbol: PDZD9
  Gene Name: PDZ domain containing 9
  Uniprot ID: Q8IXQ8
  ENST ID: ENST00000424898
  CDS Start-End: 64-858
attgggactgactccagcctctgctccgggaggccctcccgggctgcctgacctcccgggaccatgcagaaggcctcccacaaaaacaaaaaagaaagaggagtcagcaacaaggtcaaaacatctgtacacaacttgagcaaaacacagcagaccaaactcactgtgggtagcctgggattaggcctcatcatcatccagcatggaccctacctccagatcacccacctcatcaggaagggggctgcagccaacgacgggaaactccagccaggtgatgttctgattagtgttggccatgccaatgtgttaggatatactcttcgagaatttttacagcttttgcaacatatcactattggaacagtgctacaaatcaaggtttaccgagattttattaacattcctgaagaatggcaagaaatatatgatttaatccctgaggccaaattcccagtaacaagcacaccaaagaaaattgagctggcaaaagatgaatctttcacaagcagtgatgataatgaaaatgtagatttagataaaagacttcaatattatagatatccgtggtcaactgtgcatcaccctgcaaggagaccaatatccatctccagagactggcatggatataagaagaagaaccatactattagtgtaggaaaagacattaattgtgacgtgatgattcacagagacgacaagaaagaagtgagggccccttctccatactggataatggtgaagcaagacaatgaaagctcttcctcctctacctcctctacctcagatgcattttggctggaagattgtgcccaagttgaagagggtaaagcccaactggtatcaaaggttggttagcaaatctgtggtcatatgagcatttatcttgcagacacccaagttttgtgcctcaccaggcacaagtttgctgtacttatcaaggactgtctgtagactcaccaattctcttctcttatgactgcgttataaagcctttagagatgttcttcaacaggattatctaaagacttccttgggttcttgcaggcctcacaaatcttattttcagaataagaccctcctttttgagaagaatttctttcttttagaaaatgccgtagagaaatccaatatcagaatgtctgaacatagtagagaatgtcactttatgtaaacactacatttttctttaaatatttagtttctctcttttttttggtaaacttcaagtactataattaaaataactaagagacataa

SEQ ID NO: 164115 - DNA, 1331 bp, Homo sapiens
  Payload ID: 12311
  Gene Symbol: PDZD9
  Gene Name: PDZ domain containing 9
  ENST ID: ENST00000523914
  CDS Start-End: 64-357
attgggactgactccagcctctgctccgggaggccctcccgggctgcctgacctcccgggaccatgcagaaggcctcccacaaaaacaaaaaagaaagaggagtcagcaacaaggtcaaaacatctgtacacaacttgagcaaaacacagcagaccaaactcactgtgggtagcctgggattaggcctcatcatcatccagcatggaccctacctccagatcacccacctcatcaggaagggggctgcagccaacgacgggaaactccagccaggctgtacaggaagcatggctggggaggcctcaggaaacttacaatcatggcagaaggtgaagaggaaggaggtgatgttctgattagtgttggccatgccaatgtgttaggatatactcttcgagaatttttacagcttttgcaacatatcactattggaacagtgctacaaatcaaggtttaccgagattttattaacattcctgaagaatggcaagaaatatatgatttaatccctgaggccaaattcccagtaacaagcacaccaaagaaaattgagctggcaaaagatgaatctttcacaagcagtgatgataatgaaaatgtagatttagataaaagacttcaatattatagatatccgtggtcaactgtgcatcaccctgcaaggagaccaatatccatctccagagactggcatggatataagaagaagaaccatactattagtgtaggaaaagacattaattgtgacgtgatgattcacagagacgacaagaaagaagtgagggccccttctccatactggataatggtgaagcaagacaatgaaagctcttcctcctctacctcctctacctcagatgcattttggctggaagattgtgcccaagttgaagagggtaaagcccaactggtatcaaaggttggttagcaaatctgtggtcatatgagcatttatcttgcagacacccaagttttgtgcctcaccaggcacaagtttgctgtacttatcaaggactgtctgtagactcaccaattctcttctcttatgactgcgttataaagcctttagagatgttcttcaacaggattatctaaagacttccttgggttcttgcaggcctcacaaatcttattttcagaataagaccctcctttttgagaagaatttctttcttttagaaaatgccgtagagaaatccaatatcagaatgtctgaacatagtagagaatgtcactttatgtaaacactacatttttctttaaatatttagtttctctcttttttttggtaaacttcaagtactataattaaaataactaagagacataa

SEQ ID NO: 164116 - DNA, 1068 bp, Homo sapiens
  Payload ID: 12311
  Gene Symbol: PDZD9
  Gene Name: PDZ domain containing 9
  Uniprot ID: Q8IXQ8
  ENST ID: ENST00000537222
  CDS Start-End: 52-666
tccagcctctgctccgggaggccctcccgggctgcctgacctcccgggaccatgcagaaggcctcccacaaaaacaaaaaaggtgatgttctgattagtgttggccatgccaatgtgttaggatatactcttcgagaatttttacagcttttgcaacatatcactattggaacagtgctacaaatcaaggtttaccgagattttattaacattcctgaagaatggcaagaaatatatgatttaatccctgaggccaaattcccagtaacaagcacaccaaagaaaattgagctggcaaaagatgaatctttcacaagcagtgatgataatgaaaatgtagatttagataaaagacttcaatattatagatatccgtggtcaactgtgcatcaccctgcaaggagaccaatatccatctccagagactggcatggatataagaagaagaaccatactattagtgtaggaaaagacattaattgtgacgtgatgattcacagagacgacaagaaagaagtgagggccccttctccatactggataatggtgaagcaagacaatgaaagctcttcctcctctacctcctctacctcagatgcattttggctggaagattgtgcccaagttgaagagggtaaagcccaactggtatcaaaggttggttagcaaatctgtggtcatatgagcatttatcttgcagacacccaagttttgtgcctcaccaggcacaagtttgctgtacttatcaaggactgtctgtagactcaccaattctcttctcttatgactgcgttataaagcctttagagatgttcttcaacaggattatctaaagacttccttgggttcttgcaggcctcacaaatcttattttcagaataagaccctcctttttgagaagaatttctttcttttagaaaatgccgtagagaaatccaatatcagaatgtctgaacatagtagagaatgtcactttatgtaaacactacatttttctttaaatatttagtttctctcttttttttggtaaacttcaagtactataattaaaataactaagagacataa

SEQ ID NO: 164117 - DNA, 4248 bp, Homo sapiens
  Payload ID: 12312
  Gene Symbol: PDZRN3
  Gene Name: PDZ domain containing ring finger 3
  Uniprot ID: Q9UPQ7
  ENST ID: ENST00000263666
  CDS Start-End: 116-3316
gtccggggagagccagcgagcgcgcgggcggcgtagccggcctgtctgggccgcctcgtggggagggagggggcgcccggccgcccggcggcgaccccggggcctggccgccaccatgggcttcgagctggaccgcttcgacggcgacgtggacccggacctgaagtgcgcgctgtgccacaaggtcctggaggacccgctgaccacgccgtgcggccacgtcttctgcgccggctgcgtgctgccctgggtggtgcaggagggcagctgcccggcgcgctgccgcggtcgcctgtcggccaaagagctcaaccacgtcctgccgctcaagcgccttatcctcaagctggacatcaagtgcgcgtacgcgacgcgcggctgcggccgggtggtcaagctgcagcagctgccggagcacctcgagcgctgcgacttcgcgcccgcgcgctgtcgccacgcgggttgcggccaggtgctgctgcggcgcgacgtggaggcgcacatgcgcgacgcctgcgacgcgcggccagtgggccgctgccaggagggctgcgggctacccttgacgcacggcgagcagcgcgcgggcggccactgctgcgcgcgagcgctgcgggcgcacaacggcgcgctccaggcccgcctgggcgcgctgcacaaggcgctcaagaaggaggcgctgcgcgctgggaagcgcgagaagtcgctggtggcccagctggccgcggcgcagcttgagctgcagatgaccgcgctgcgctaccagaagaaattcaccgaatacagcgcgcgcctcgactcgctcagccgctgcgtggccgcgccgcccggcggcaagggcgaagaaaccaaaagtctgactcttgtcctgcatcgggactccggctccctgggattcaatattattggtggccggccgagtgtggataaccacgatggatcatccagtgaaggaatctttgtatccaagatagttgacagtgggcctgcagccaaggaaggaggcctgcaaattcatgacaggattattgaggtcaacggcagagacttatccagagcaactcatgaccaggctgtggaagctttcaagacagccaaggagcccatagtggtgcaggtgttgagaagaacaccaaggaccaaaatgttcacgcctccatcagagtctcagctggtggacacgggaacccaaaccgacatcacctttgaacatatcatggccctcactaagatgtcctctcccagcccacccgtgctggatccctatctcttgccagaggagcatccctcagcccatgaatactacgatccaaatgactacattggagacatccatcaggagatggacagggaggagctggagctggaggaagtggacctctacagaatgaacagccaggacaagctgggcctcactgtgtgctaccggacggacgatgaagacgacattgggatttatatcagtgagattgaccctaacagcattgcagccaaggatgggcgcatccgagaaggagaccgcattatccagattaatgggatagaggtgcagaaccgtgaagaggctgtggctcttctaaccagtgaagaaaataaaaacttttcattgctgattgcaaggcctgaactccagctggatgagggctggatggatgatgacaggaacgactttctggatgacctgcacatggacatgctggaggagcagcaccaccaggccatgcaattcacagctagcgtgctgcagcagaagaagcacgacgaagacggtgggaccacagatacagccaccatcttgtccaaccagcacgagaaggacagcggtgtggggcggaccgacgagagcacccgtaatgacgagagctcggagcaagagaacaatggcgacgacgccaccgcatcctccaacccgctggcggggcagaggaagctcacctgcagccaggacaccttgggcagcggcgacctgcccttcagcaacgagtctttcatttcggccgactgcacggacgccgactacctggggatcccggtggacgagtgcgagcgcttccgcgagctcctggagctcaagtgccaggtgaagagcgccaccccttacggcctgtactaccctagcggccccctggacgccggcaagagtgaccctgagagcgtggacaaggagctggagctgctgaacgaagagctgcgcagcatcgagctggagtgcctgagcatcgtgcgcgcccacaagatgcagcagctcaaggagcagtaccgcgagtcctggatgctgcacaacagcggcttccgcaactacaacaccagcatcgacgtgcgcagacacgagctctcagatatcaccgagctcccggagaaatccgacaaggacagctcgagcgcctacaacacaggcgagagctgccgcagcaccccgctcaccctggagatctcccccgacaactccttgaggagagcggcggagggcatcagctgcccgagcagcgaaggggctgtggggaccacggaagcctacgggccagcctccaagaatctgctctccatcacggaagatcccgaagtgggcacccctacctatagcccgtccctgaaggagctggaccccaaccagcccctggaaagcaaagagcggagagccagcgacgggagccggagccccacgcccagccagaagctgggcagcgcctacctgccctcctatcaccactccccatacaagcacgcgcacatcccggcgcacgcccagcactaccagagctacatgcagctgatccagcagaagtcggccgtggagtacgcgcaaagccagatgagcctggtgagcatgtgcaaggacctgagctctcccaccccgtcggagccgcgcatggagtggaaggtgaagatccgcagcgacgggacgcgctacatcaccaagaggcccgtgcgggaccgcctgctgcgggagcgcgccctgaagatccgggaagagcgcagcggcatgaccaccgacgacgacgcggtgagcgagatgaagatggggcgctactggagcaaggaggagaggaagcagcacctggtgaaggccaaggagcagcggcggcggcgcgagttcatgatgcagagcaggttggattgtctcaaggagcagcaagcagccgatgacaggaaggagatgaacattctcgaactgagccacaaaaagatgatgaagaagaggaataagaaaatcttcgataactggatgacgatccaagaactcttaacccacggcacaaaatccccggacggcactagagtatacaattccttcctatcggtgactactgtataattttcacttctgcattatgtacataaaggagaccactaccactggggtagaaattcctgcctcgttcaatgcggcaagtttttgtatataagataagtacggtcttcatgtttatagtccaaatttgcaaaccctacaactctgggtgtcataggtctattttaagggaagagagagaaaaacacccttactatcttggaaggcaatattaacaaacagagcttttttcaaatagcaattgtacttttctacctgtacccttttacataaagtgtttaaatttcagaaagatcttttattaagcatactttcacagaataacttgtttaaactatattcatataaaaaagttaaacacgctttttttcctgcctaaaacacaaatacaactgccagtatgtatttttaatggaaccctattttataatggtacgttactgaatgtgtttcatatgcgtgaccgttaagatattatcatttaggtgaaggtttcaactcaaaaccacccaacccggtggttaacgatttaatacatataaccaaaccggcagcgtttagagttgggatatacatttaaacattttcctggttaaggttcccaagagagtgtaaaggttttagcagaaagcaaaatatcttgcatctttatggaagtttaaagcatgtttgcaaatattgcagcccattgaaagaatttgcatgtacaggaaagttgtggatggagacggtttgtggaattttaagtgctcattgtagtaaacttttgctttgtagatttgaaggtacagacttatacaggcaagttcacaaaatcatgattagttacaaacagtaaaatgaagttaaaataaattattattttctatttgatatgttttgatgtgattcctcattttgcagtggtgcctataaaataaaagccttttgcagtg

SEQ ID NO: 164118 - DNA, 1136 bp, Homo sapiens
  Payload ID: 12312
  Gene Symbol: PDZRN3
  Gene Name: PDZ domain containing ring finger 3
  Uniprot ID: Q9UPQ7
  ENST ID: ENST00000308537
  CDS Start-End: 16-1098
ggcctggccgccaccatgggcttcgagctggaccgcttcgacggcgacgtggacccggacctgaagtgcgcgctgtgccacaaggtcctggaggacccgctgaccacgccgtgcggccacgtcttctgcgccggctgcgtgctgccctgggtggtgcaggagggcagctgcccggcgcgctgccgcggtcgcctgtcggccaaagagctcaaccacgtcctgccgctcaagcgccttatcctcaagctggacatcaagtgcgcgtacgcgacgcgcggctgcggccgggtggtcaagctgcagcagctgccggagcacctcgagcgctgcgacttcgcgcccgcgcgctgtcgccacgcgggttgcggccaggtgctgctgcggcgcgacgtggaggcgcacatgcgcgacgcctgcgacgcgcggccagtgggccgctgccaggagggctgcgggctacccttgacgcacggcgagcagcgcgcgggcggccactgctgcgcgcgagcgctgcgggcgcacaacggcgcgctccaggcccgcctgggcgcgctgcacaaggcgctcaagaaggaggcgctgcgcgctgggaagcgcgagaagtcgctggtggcccagctggccgcggcgcagcttgagctgcagatgaccgcgctgcgctaccagaagaaattcaccgaatacagcgcgcgcctcgactcgctcagccgctgcgtggccgcgccgcccggcggcaagggcgaagaaaccaaaagtctgactcttgtcctgcatcgggactccggctccctgggattcaatattattggtggccggccgagtgtggataaccacgatggatcatccagtgaaggaatctttgtatccaagatagttgacagtgggcctgcagccaaggaaggaggcctgcaaattcatgacaggattattgagatgagaaaactggaactgagaacagttaaattgcccaaagcccacagccaggattccaacgctggcttcatcccacaattgctgtccctgcacactccacctctgagctgtgaaaaaggaggaggtcatctggcttgtggaggggcttatttgaactgtatttgattgaaaactgcatgggctactaaaattgttttcttggg

SEQ ID NO: 164119 - DNA, 2927 bp, Homo sapiens
  Payload ID: 12312
  Gene Symbol: PDZRN3
  Gene Name: PDZ domain containing ring finger 3
  ENST ID: ENST00000462146
  CDS Start-End: 290-2461
agcatttgctcagtactctcaacataaaccaagcttagatcgcaatgaaactgcggacctgcaggctgccttgcttcactgagtcaatttttaaatgaagatggaacacaagaggatgatcttattgttcagtaaatttactctaatacataaaccccatggtggaagatggtatttggtcaacggcagagacttatccagagcaactcatgaccaggctgtggaagctttcaagacagccaaggagcccatagtggtgcaggtgttgagaagaacaccaaggaccaaaatgttcacgcctccatcagagtctcagctggtggacacgggaacccaaaccgacatcacctttgaacatatcatggccctcactaagatgtcctctcccagcccacccgtgctggatccctatctcttgccagaggagcatccctcagcccatgaatactacgatccaaatgactacattggagacatccatcaggagatggacagggaggagctggagctggaggaagtggacctctacagaatgaacagccaggacaagctgggcctcactgtgtgctaccggacggacgatgaagacgacattgggatttatatcagtgagattgaccctaacagcattgcagccaaggatgggcgcatccgagaaggagaccgcattatccagattaatgggatagaggtgcagaaccgtgaagaggctgtggctcttctaaccagtgaagaaaataaaaacttttcattgctgattgcaaggcctgaactccagctggatgagggctggatggatgatgacaggaacgactttctggatgacctgcacatggacatgctggaggagcagcaccaccaggccatgcaattcacagctagcgtgctgcagcagaagaagcacgacgaagacggtgggaccacagatacagccaccatcttgtccaaccagcacgagaaggacagcggtgtggggcggaccgacgagagcacccgtaatgacgagagctcggagcaagagaacaatggcgacgacgccaccgcatcctccaacccgctggcggggcagaggaagctcacctgcagccaggacaccttgggcagcggcgacctgcccttcagcaacgagtctttcatttcggccgactgcacggacgccgactacctggggatcccggtggacgagtgcgagcgcttccgcgagctcctggagctcaagtgccaggtgaagagcgccaccccttacggcctgtactaccctagcggccccctggacgccggcaagagtgaccctgagagcgtggacaaggagctggagctgctgaacgaagagctgcgcagcatcgagctggagtgcctgagcatcgtgcgcgcccacaagatgcagcagctcaaggagcagtaccgcgagtcctggatgctgcacaacagcggcttccgcaactacaacaccagcatcgacgtgcgcagacacgagctctcagatatcaccgagctcccggagaaatccgacaaggacagctcgagcgcctacaacacaggcgagagctgccgcagcaccccgctcaccctggagatctcccccgacaactccttgaggagagcggcggagggcatcagctgcccgagcagcgaaggggctgtggggaccacggaagcctacgggccagcctccaagaatctgctctccatcacggaagatcccgaagtgggcacccctacctatagcccgtccctgaaggagctggaccccaaccagcccctggaaagcaaagagcggagagccagcgacgggagccggagccccacgcccagccagaagctgggcagcgcctacctgccctcctatcaccactccccatacaagcacgcgcacatcccggcgcacgcccagcactaccagagctacatgcagctgatccagcagaagtcggccgtggagtacgcgcaaagccagatgagcctggtgagcatgtgcaaggacctgagctctcccaccccgtcggagccgcgcatggagtggaaggtgaagatccgcagcgacgggacgcgctacatcaccaagaggcccgtgcgggaccgcctgctgcgggagcgcgccctgaagatccgggaagagcgcagcggcatgaccaccgacgacgacgcggtgagcgagatgaagatggggcgctactggagcaaggaggagaggaagcagcacctggtgaaggccaaggagcagcggcggcggcgcgagttcatgatgcagagcaggttggattgtctcaaggagcagcaagcagccgatgacaggaaggagatgaacattctcgaactgagccacaaaaagatgatgaagaagaggaataagaaaatcttcgataactggatgacgatccaagaactcttaacccacggcacaaaatccccggacggcactagagtatacaattccttcctatcggtgactactgtataattttcacttctgcattatgtacataaaggagaccactaccactggggtagaaattcctgcctcgttcaatgcggcaagtttttgtatataagataagtacggtcttcatgtttatagtccaaatttgcaaaccctacaactctgggtgtcataggtctattttaagggaagagagagaaaaacacccttactatcttggaaggcaatattaacaaacagagcttttttcaaatagcaattgtacttttctacctgtacccttttacataaagtgtttaaatttcagaaagatcttttattaagcatactttcacagaataacttgtttaaactatattcatataaaaaagttaaacacgctttttttcctgcctaaaacacaaatacaactgccagtatgtatttttaatggaaccctattttataatggtacgttactgaatgtgtttcatatgcgtgaccgtta

SEQ ID NO: 164120 - DNA, 2737 bp, Homo sapiens
  Payload ID: 12312
  Gene Symbol: PDZRN3
  Gene Name: PDZ domain containing ring finger 3
  ENST ID: ENST00000466780
  CDS Start-End: 280-2451
tatataatagccttgcaagtgaacggataagcaaagtcagttgctgagaaataacacttccgagctgacgcatccaaatgtttaggatacacctgagatgtctctcttactgaatagaaacaacatccctggaagctctagacttctgaggcaccccagctttccctggtcaacggcagagacttatccagagcaactcatgaccaggctgtggaagctttcaagacagccaaggagcccatagtggtgcaggtgttgagaagaacaccaaggaccaaaatgttcacgcctccatcagagtctcagctggtggacacgggaacccaaaccgacatcacctttgaacatatcatggccctcactaagatgtcctctcccagcccacccgtgctggatccctatctcttgccagaggagcatccctcagcccatgaatactacgatccaaatgactacattggagacatccatcaggagatggacagggaggagctggagctggaggaagtggacctctacagaatgaacagccaggacaagctgggcctcactgtgtgctaccggacggacgatgaagacgacattgggatttatatcagtgagattgaccctaacagcattgcagccaaggatgggcgcatccgagaaggagaccgcattatccagattaatgggatagaggtgcagaaccgtgaagaggctgtggctcttctaaccagtgaagaaaataaaaacttttcattgctgattgcaaggcctgaactccagctggatgagggctggatggatgatgacaggaacgactttctggatgacctgcacatggacatgctggaggagcagcaccaccaggccatgcaattcacagctagcgtgctgcagcagaagaagcacgacgaagacggtgggaccacagatacagccaccatcttgtccaaccagcacgagaaggacagcggtgtggggcggaccgacgagagcacccgtaatgacgagagctcggagcaagagaacaatggcgacgacgccaccgcatcctccaacccgctggcggggcagaggaagctcacctgcagccaggacaccttgggcagcggcgacctgcccttcagcaacgagtctttcatttcggccgactgcacggacgccgactacctggggatcccggtggacgagtgcgagcgcttccgcgagctcctggagctcaagtgccaggtgaagagcgccaccccttacggcctgtactaccctagcggccccctggacgccggcaagagtgaccctgagagcgtggacaaggagctggagctgctgaacgaagagctgcgcagcatcgagctggagtgcctgagcatcgtgcgcgcccacaagatgcagcagctcaaggagcagtaccgcgagtcctggatgctgcacaacagcggcttccgcaactacaacaccagcatcgacgtgcgcagacacgagctctcagatatcaccgagctcccggagaaatccgacaaggacagctcgagcgcctacaacacaggcgagagctgccgcagcaccccgctcaccctggagatctcccccgacaactccttgaggagagcggcggagggcatcagctgcccgagcagcgaaggggctgtggggaccacggaagcctacgggccagcctccaagaatctgctctccatcacggaagatcccgaagtgggcacccctacctatagcccgtccctgaaggagctggaccccaaccagcccctggaaagcaaagagcggagagccagcgacgggagccggagccccacgcccagccagaagctgggcagcgcctacctgccctcctatcaccactccccatacaagcacgcgcacatcccggcgcacgcccagcactaccagagctacatgcagctgatccagcagaagtcggccgtggagtacgcgcaaagccagatgagcctggtgagcatgtgcaaggacctgagctctcccaccccgtcggagccgcgcatggagtggaaggtgaagatccgcagcgacgggacgcgctacatcaccaagaggcccgtgcgggaccgcctgctgcgggagcgcgccctgaagatccgggaagagcgcagcggcatgaccaccgacgacgacgcggtgagcgagatgaagatggggcgctactggagcaaggaggagaggaagcagcacctggtgaaggccaaggagcagcggcggcggcgcgagttcatgatgcagagcaggttggattgtctcaaggagcagcaagcagccgatgacaggaaggagatgaacattctcgaactgagccacaaaaagatgatgaagaagaggaataagaaaatcttcgataactggatgacgatccaagaactcttaacccacggcacaaaatccccggacggcactagagtatacaattccttcctatcggtgactactgtataattttcacttctgcattatgtacataaaggagaccactaccactggggtagaaattcctgcctcgttcaatgcggcaagtttttgtatataagataagtacggtcttcatgtttatagtccaaatttgcaaaccctacaactctgggtgtcataggtctattttaagggaagagagagaaaaacacccttactatcttggaaggcaatattaacaaacagagcttttttcaaatagcaattgtacttttctacctgtacccttttacataaagtgtttaaatttcag

SEQ ID NO: 164121 - DNA, 2778 bp, Homo sapiens
  Payload ID: 12312
  Gene Symbol: PDZRN3
  Gene Name: PDZ domain containing ring finger 3
  ENST ID: ENST00000479530
  CDS Start-End: 198-2549
gcgaggggaggaagggaagcgtggaaggggggagagagttgttgtctagcctctgagagcagcgccaatgtgaagcgttgcagtcgcttgactcacctgaggctctccaaggataccttcaatgcctgcactgtaagggagctgcttttcccgggtgctggcgagaacggaagccttcctttgacgtttttctaaacatgggatgcagtctgtgcagcctgcagaagcaagaggagcagtacaaattactctatgaagtttgtcaggtcaacggcagagacttatccagagcaactcatgaccaggctgtggaagctttcaagacagccaaggagcccatagtggtgcaggtgttgagaagaacaccaaggaccaaaatgttcacgcctccatcagagtctcagctggtggacacgggaacccaaaccgacatcacctttgaacatatcatggccctcactaagatgtcctctcccagcccacccgtgctggatccctatctcttgccagaggagcatccctcagcccatgaatactacgatccaaatgactacattggagacatccatcaggagatggacagggaggagctggagctggaggaagtggacctctacagaatgaacagccaggacaagctgggcctcactgtgtgctaccggacggacgatgaagacgacattgggatttatatcagtgagattgaccctaacagcattgcagccaaggatgggcgcatccgagaaggagaccgcattatccagattaatgggatagaggtgcagaaccgtgaagaggctgtggctcttctaaccagtgaagaaaataaaaacttttcattgctgattgcaaggcctgaactccagctggatgagggctggatggatgatgacaggaacgactttctggatgacctgcacatggacatgctggaggagcagcaccaccaggccatgcaattcacagctagcgtgctgcagcagaagaagcacgacgaagacggtgggaccacagatacagccaccatcttgtccaaccagcacgagaaggacagcggtgtggggcggaccgacgagagcacccgtaatgacgagagctcggagcaagagaacaatggcgacgacgccaccgcatcctccaacccgctggcggggcagaggaagctcacctgcagccaggacaccttgggcagcggcgacctgcccttcagcaacgagtctttcatttcggccgactgcacggacgccgactacctggggatcccggtggacgagtgcgagcgcttccgcgagctcctggagctcaagtgccaggtgaagagcgccaccccttacggcctgtactaccctagcggccccctggacgccggcaagagtgaccctgagagcgtggacaaggagctggagctgctgaacgaagagctgcgcagcatcgagctggagtgcctgagcatcgtgcgcgcccacaagatgcagcagctcaaggagcagtaccgcgagtcctggatgctgcacaacagcggcttccgcaactacaacaccagcatcgacgtgcgcagacacgagctctcagatatcaccgagctcccggagaaatccgacaaggacagctcgagcgcctacaacacaggcgagagctgccgcagcaccccgctcaccctggagatctcccccgacaactccttgaggagagcggcggagggcatcagctgcccgagcagcgaaggggctgtggggaccacggaagcctacgggccagcctccaagaatctgctctccatcacggaagatcccgaagtgggcacccctacctatagcccgtccctgaaggagctggaccccaaccagcccctggaaagcaaagagcggagagccagcgacgggagccggagccccacgcccagccagaagctgggcagcgcctacctgccctcctatcaccactccccatacaagcacgcgcacatcccggcgcacgcccagcactaccagagctacatgcagctgatccagcagaagtcggccgtggagtacgcgcaaagccagatgagcctggtgagcatgtgcaaggacctgagctctcccaccccgtcggagccgcgcatggagtggaaggtgaagatccgcagcgacgggacgcgctacatcaccaagaggcccgtgcgggaccgcctgctgcgggagcgcgccctgaagatccgggaagagcgcagcggcatgaccaccgacgacgacgcggtgagcgagatgaagatggggcgctactggagcaaggaggagaggaagcagcacctggtgaaggccaaggagcagcggcggcggcgcgagttcatgatgcagagcaggttggattgtctcaaggagcagcaagcagccgatgacaggaaggagatgaacattctcgaactgagccacaaaaagatgatgaagaagaggaataagaaaatcttcgataactggatgacgatccaagaactcttaacccacggcacaaaatccccggacggcactagagtatacaattccttcctatcggtgactactgtataattttcacttctgcattatgtacataaaggagaccactaccactggggtagaaattcctgcctcgttcaatgcggcaagtttttgtatataagataagtacggtcttcatgtttatagtccaaatttgcaaaccctacaactctgggtgtcataggtctattttaagggaagagagagaaaaacacccttactatcttggaaggcaatattaacaaacagagcttttttc

SEQ ID NO: 164122 - DNA, 2080 bp, Homo sapiens
  Payload ID: 12312
  Gene Symbol: PDZRN3
  Gene Name: PDZ domain containing ring finger 3
  ENST ID: ENST00000494559
  CDS Start-End: 1-1148
gagacatccatcaggagatggacagggaggagctggagctggaggaagtggacctctacagaatgaacagccaggacaagctgggcctcactgtgtgctaccggacggacgatgaagacgacattgggatttatatcagtgagattgaccctaacagcattgcagccaaggatgggcgcatccgagaaggagaccgcattatccagattaatgggatagaggtgcagaaccgtgaagaggctgtggctcttctaaccagtgaagaaaataaaaacttttcattgctgattgcaaggcctgaactccagctggatgagggctggatggatgatgacaggaacgactttctggatgacctgcacatggacatgctggaggagcagcaccaccaggccatgcaattcacagctagcgtgctgcagcagaagaagcacgacgaagacggtgggaccacagatacagccaccatcttgtccaaccagcacgagaaggacagcggtgtggggcggaccgacgagagcacccgtaatgacgagagctcggagcaagagaacaatggcgacgacgccaccgcatcctccaacccgctggcggggcagaggaagctcacctgcagccaggacaccttgggcagcggcgacctgcccttcagcaacgagtctttcatttcggccgactgcacggacgccgactacctggggatcccgtggaaggtgaagatccgcagcgacgggacgcgctacatcaccaagaggcccgtgcgggaccgcctgctgcgggagcgcgccctgaagatccgggaagagcgcagcggcatgaccaccgacgacgacgcggtgagcgagatgaagatggggcgctactggagcaaggaggagaggaagcagcacctggtgaaggccaaggagcagcggcggcggcgcgagttcatgatgcagagcaggttggattgtctcaaggagcagcaagcagccgatgacaggaaggagatgaacattctcgaactgagccacaaaaagatgatgaagaagaggaataagaaaatcttcgataactggatgacgatccaagaactcttaacccacggcacaaaatccccggacggcactagagtatacaattccttcctatcggtgactactgtataattttcacttctgcattatgtacataaaggagaccactaccactggggtagaaattcctgcctcgttcaatgcggcaagtttttgtatataagataagtacggtcttcatgtttatagtccaaatttgcaaaccctacaactctgggtgtcataggtctattttaagggaagagagagaaaaacacccttactatcttggaaggcaatattaacaaacagagcttttttcaaatagcaattgtacttttctacctgtacccttttacataaagtgtttaaatttcagaaagatcttttattaagcatactttcacagaataacttgtttaaactatattcatataaaaaagttaaacacgctttttttcctgcctaaaacacaaatacaactgccagtatgtatttttaatggaaccctattttataatggtacgttactgaatgtgtttcatatgcgtgaccgttaagatattatcatttaggtgaaggtttcaactcaaaaccacccaacccggtggttaacgatttaatacatataaccaaaccggcagcgtttagagttgggatatacatttaaacattttcctggttaaggttcccaagagagtgtaaaggttttagcagaaagcaaaatatcttgcatctttatggaagtttaaagcatgtttgcaaatattgcagcccattgaaagaatttgcatgtacaggaaagttgtggatggagacggtttgtggaattttaagtgctcattgtagtaaacttttgctttgtagatttgaaggtacagacttatacaggcaagttcacaaaatcatgattagttacaaacagtaaaatgaagttaaaataaattattattttctatttgatatgttttgatgtgattcctcattttgcagtggtgcctataaaataaaagccttttgcagtg

SEQ ID NO: 164123 - DNA, 1776 bp, Homo sapiens
  Payload ID: 12312
  Gene Symbol: PDZRN3
  Gene Name: PDZ domain containing ring finger 3
  ENST ID: ENST00000492909
  CDS Start-End: 300-1776
gtagacgcctcggggcttaagagaacgtgacatggaagagacaggaaatatgtactcttgtacaggtatgcggcacacatgtggccccctccctcccagcctcctcactaaagattattaacctgcttattctcctggttcacctgaggctgttttgagagaatctcagtatctcagtcttcatttcatacgacattcttcgggctcctcttgttcatctttgcagactgaagtatttatgaaggaccttcagaaatctgattcctcctgatgaatcaaagagtaaagaagaatcaaacatgattaaccaggtcaacggcagagacttatccagagcaactcatgaccaggctgtggaagctttcaagacagccaaggagcccatagtggtgcaggtgttgagaagaacaccaaggaccaaaatgttcacgcctccatcagagtctcagctggtggacacgggaacccaaaccgacatcacctttgaacatatcatggccctcactaagatgtcctctcccagcccacccgtgctggatccctatctcttgccagaggagcatccctcagcccatgaatactacgatccaaatgactacattggagacatccatcaggagatggacagggaggagctggagctggaggaagtggacctctacagaatgaacagccaggacaagctgggcctcactgtgtgctaccggacggacgatgaagacgacattgggatttatatcagtgagattgaccctaacagcattgcagccaaggatgggcgcatccgagaaggagaccgcattatccagattaatgggatagaggtgcagaaccgtgaagaggctgtggctcttctaaccagtgaagaaaataaaaacttttcattgctgattgcaaggcctgaactccagctggatgagggctggatggatgatgacaggaacgactttctggatgacctgcacatggacatgctggaggagcagcaccaccaggccatgcaattcacagctagcgtgctgcagcagaagaagcacgacgaagacggtgggaccacagatacagccaccatcttgtccaaccagcacgagaaggacagcggtgtggggcggaccgacgagagcacccgtaatgacgagagctcggagcaagagaacaatggcgacgacgccaccgcatcctccaacccgctggcggggcagaggaagctcacctgcagccaggacaccttgggcagcggcgacctgcccttcagcaacgagtctttcatttcggccgactgcacggacgccgactacctggggatcccggtggacgagtgcgagcgcttccgcgagctcctggagctcaagtgccaggtgaagagcgccaccccttacggcctgtactaccctagcggccccctggacgccggcaagagtgaccctgagagcgtggacaaggagctggagctgctgaacgaagagctgcgcagcatcgagctggagtgcctgagcatcgtgcgcgcccacaagatgcagcagctcaaggagcagtaccgcgagtcctggatgctgcacaacagcggcttccgcaactacaacaccagcatcgacgtgcgcagacacgagctctcagatatcaccgagctcccggagaaatccgacaaggacagctcgagcgcctacaacacaggcgagagctgccgcagcaccccgctcaccctggagatctcccccgacaactccttgaggagagcggcggagggcatcagctgcccgagcagcgaaggggctg

SEQ ID NO: 164124 - DNA, 3411 bp, Homo sapiens
  Payload ID: 12313
  Gene Symbol: PDZRN4
  Gene Name: PDZ domain containing ring finger 4
  Uniprot ID: Q6ZMN7
  ENST ID: ENST00000298919
  CDS Start-End: 389-2719
aagatacttagggaaagcgaagaagagcatgctgctacacaccactctggcttacgcttccagctaacagcggtttgtctgtgtttctggactgaagtgactgatgaaaaacagtagtcaagtctggagggtgattccctttcagttcacttgcctttcagttctggggaaattagaagatttgctctctctctctgcttcttagaatgggctgcaatttgtgcacttttcagaaaagagaggaacactacaaactgctgtatgaagtttcccaggagctgtgacttgaacaatgctattctgcatgaaattgagaaattgccagtgttcccaacctgatggagagtatgtgtgggatcttagttctgcttcattaagctccttgtgaatgagtggtaagagacaatttttccttaaacctttggcattgttgacatgttggccatccactgtcaatgggaaggatctttcaaaggccactcatgaagaggcagtggaagcttttcgcaatgccaaggagcccattgtggtgcaggtgttaaggcgaacacctcttagtagaccagcctatgggatggcttcagaagtgcagcttatgaatgccagcactcagacggacatcaccttcgaacacatcatggctctggccaagcttcgtccacctacccctccagtgccagacatctgtccattcctgctctcagacagctgccattctctacatccaatggagcatgaattttatgaggacaatgagtatatttccagcttgcctgctgatgcagacagaacagaagactttgaatatgaggaggtcgagttgtgtcgtgttagcagtcaagagaagctgggcctgacagtctgttaccgaacagatgatgaagaagacaccggcatttatgtcagcgaggttgacccaaatagcattgctgccaaagacggccggattcgagaaggggatcggattttgcaaataaatggggaagatgtccagaatcgagaagaagcagtggccttgctgtctaacgatgagtgtaagagaatcgtgctgcttgttgcaaggccagagattcagctggatgaaggctggctggaagatgaaaggaatgaattcttagaggagttaaacttggagatgttggaagaagagcataatgaagcaatgcagcccactgccaatgaggtggagcagccaaaaaagcaagaagaagaagaaggcacaacagacactgcaacatcctcatccaacaaccatgagaaggacagtggagtaggacgtacagatgaaagcttgcgaaatgatgagagctcagagcaggagaatgcagccgaggaccccaatagcacatctttgaagagcaagagagacctggggcagagccaagacactctgggaagtgttgaacttcagtacaatgagagcctcgtatctggtgaatacattgactcagactgcattggcaacccagatgaggactgtgaaagattcaggcagctcttggagctcaaatgcaagattcgaaatcatggagagtatgacctgtattactcaagcagcacaattgaatgcaatcaaggggagcaagagggagtggagcatgagctacagttgcttaatgaagaactgagaaacattgagcttgagtgtcagaatatcatgcaggctcacaggctccagaaagtgacagaccagtatggagacatctggacattgcatgatggaggattccggaattataacaccagcatagatatgcaaaggggaaagctagatgacatcatggagcatccagaaaagtctgacaaggacagttctagtgcttacaacacagctgagagctgcagaagtactccgctcactgtagaccgttcccctgacagttcccttccaagggtgatcaacctcaccaataagaaaaacctgagaagcacaatggcagccacccagtcctcttccggacagagcagtaaagagtcgacctccaccaaagccaaaaccactgagcaaggttgtagcgctgaaagcaaggagaaggttttagaaggcagcaagcttcctgatcaagagaaggcagtcagcgaacacatcccttacctctctccttaccacagctcctcatatagatatgcaaacatcccagcacacgcccggcattatcaaagctacatgcagttaattcaacagaaatctgcagtcgagtatgctcagagtcagctcagcttggtgagcatgtgcaaggagtctcagaagtgttcagagcccaagatggaatggaaggtgaaaattaggagcgacgggacacggtacatcacaaagagacccgtgcgagaccgaatcctgaaggaacgtgccttaaagatcaaggaagagcggagtggcatgaccacagacgatgacaccatgagcgagatgaaaatggggcgctactggagcaaagaggagagaaagcagcacctggttagggccaaagagcagcgccgtcgccgtgagttcatgatgcgaagcaggttagagtgtctcaaggagagccctcagagcggcagtgagggcaagaaggagatcaatatcattgaactgagtcacaaaaagatgatgaaaaagagaaacaagaaaattttggacaactggatgacaatccaagaactgatgacccatggggccaagtctccagatggcacgagagtccataatgccttcttgtcggtgaccactgtatgaccgaatgaatggaatgcatgcgactgattttaggaggatgctaccagtttcggtagagtatgattgcctcgttcaatgtggcgtttttatatatattttgtgactctttatagtttaaattttttgtaagcaaaaaatacctggtaatttttcatttgtttttcatatactggtaccttctttttggctgagatctttcttttacttgtgatatattcatattactcgtttataaaaaatcaaaaacaaaaggaaagaaaacaaaaaaaacttgcacaaaaatactgaggagccaattaatttcctacttcaatgtatctaatgtaagtgaaaatctggatttatttctctagtttacttattttctactttaataataactcaatgccaaaatatttctatgcttgtttcttggcataatacattttaaatcaaacctgttcgtaataaatcatgtgccacatcttgtcttacacataaaagccactgcttttaacatcccattgtacatttaacacataaatggtgttaacatcccattgtacatttaacacataaatggccattgtctttgtctcagtaaagtgtaggtggacaatcttcctgtgatatgtagtgacattggtcatgtagctagataattatggtaattgtgacaattaaagagaaataaattattgattatccttcag

SEQ ID NO: 164125 - DNA, 3347 bp, Homo sapiens
  Payload ID: 12313
  Gene Symbol: PDZRN4
  Gene Name: PDZ domain containing ring finger 4
  Uniprot ID: Q6ZMN7
  ENST ID: ENST00000402685
  CDS Start-End: 9-3119
tccctaacatgggctttgccctggagcgcttcgcagaagccgtggacccggctctggagtgcaaactgtgcggccaggtgcttgaagagcccctgtgcacgccgtgcgggcacgtcttctgcgccagctgcctgttgccctgggcggtgcggaggcgccggtgcccgctgcagtgccagcccttggcgcccggcgagctgtaccgggtgctgccgctgcgcagcctcatccagaagctgcgagtccagtgcgactaccgcgcccgcggctgcggccactcggtcaggctgcacgagctggaggcgcacgtcgagcactgcgacttcggccctgcccgccggctccgcagccgcgggggctgcgcttcggggctgggcggtggtgaggtgcccgcgcgggggggctgcggtccgacacccagggctggccggggcgggggcgcgcgcggggggccgccgggcggccgctggggccgcgggcggggacccgggcctcgggtcctcgcctggaggcggcgcgagaaggcgctgctggcgcagctctgggcgctgcagggcgaggtgcagctcacggcgcgcaggtaccaggagaagttcacccaatacatggctcacgtccgcaacttcgtcggcgacctcggtggcggccaccgcagggatggagagcataagccattcactattgtgttagaaagagaaaatgacactttgggattcaatattataggaggtcgaccaaatcagaataatcaggaaggaacatcgactgaaggaatttacgtttcaaaaattttagaaaatggacctgctgacagagcagatggcctggagattcatgacaaaatcatggaggtcaatgggaaggatctttcaaaggccactcatgaagaggcagtggaagcttttcgcaatgccaaggagcccattgtggtgcaggtgttaaggcgaacacctcttagtagaccagcctatgggatggcttcagaagtgcagcttatgaatgccagcactcagacggacatcaccttcgaacacatcatggctctggccaagcttcgtccacctacccctccagtgccagacatctgtccattcctgctctcagacagctgccattctctacatccaatggagcatgaattttatgaggacaatgagtatatttccagcttgcctgctgatgcagacagaacagaagactttgaatatgaggaggtcgagttgtgtcgtgttagcagtcaagagaagctgggcctgacagtctgttaccgaacagatgatgaagaagacaccggcatttatgtcagcgaggttgacccaaatagcattgctgccaaagacggccggattcgagaaggggatcggattttgcaaataaatggggaagatgtccagaatcgagaagaagcagtggccttgctgtctaacgatgagtgtaagagaatcgtgctgcttgttgcaaggccagagattcagctggatgaaggctggctggaagatgaaaggaatgaattcttagaggagttaaacttggagatgttggaagaagagcataatgaagcaatgcagcccactgccaatgaggtggagcagccaaaaaagcaagaagaagaagaaggcacaacagacactgcaacatcctcatccaacaaccatgagaaggacagtggagtaggacgtacagatgaaagcttgcgaaatgatgagagctcagagcaggagaatgcagccgaggaccccaatagcacatctttgaagagcaagagagacctggggcagagccaagacactctgggaagtgttgaacttcagtacaatgagagcctcgtatctggtgaatacattgactcagactgcattggcaacccagatgaggactgtgaaagattcaggcagctcttggagctcaaatgcaagattcgaaatcatggagagtatgacctgtattactcaagcagcacaattgaatgcaatcaaggggagcaagagggagtggagcatgagctacagttgcttaatgaagaactgagaaacattgagcttgagtgtcagaatatcatgcaggctcacaggctccagaaagtgacagaccagtatggagacatctggacattgcatgatggaggattccggaattataacaccagcatagatatgcaaaggggaaagctagatgacatcatggagcatccagaaaagtctgacaaggacagttctagtgcttacaacacagctgagagctgcagaagtactccgctcactgtagaccgttcccctgacagttcccttccaagggtgatcaacctcaccaataagaaaaacctgagaagcacaatggcagccacccagtcctcttccggacagagcagtaaagagtcgacctccaccaaagccaaaaccactgagcaaggttgtagcgctgaaagcaaggagaaggttttagaaggcagcaagcttcctgatcaagagaaggcagtcagcgaacacatcccttacctctctccttaccacagctcctcatatagatatgcaaacatcccagcacacgcccggcattatcaaagctacatgcagttaattcaacagaaatctgcagtcgagtatgctcagagtcagctcagcttggtgagcatgtgcaaggagtctcagaagtgttcagagcccaagatggaatggaaggtgaaaattaggagcgacgggacacggtacatcacaaagagacccgtgcgagaccgaatcctgaaggaacgtgccttaaagatcaaggaagagcggagtggcatgaccacagacgatgacaccatgagcgagatgaaaatggggcgctactggagcaaagaggagagaaagcagcacctggttagggccaaagagcagcgccgtcgccgtgagttcatgatgcgaagcaggttagagtgtctcaaggagagccctcagagcggcagtgagggcaagaaggagatcaatatcattgaactgagtcacaaaaagatgatgaaaaagagaaacaagaaaattttggacaactggatgacaatccaagaactgatgacccatggggccaagtctccagatggcacgagagtccataatgccttcttgtcggtgaccactgtatgaccgaatgaatggaatgcatgcgactgattttaggaggatgctaccagtttcggtagagtatgattgcctcgttcaatgtggcgtttttatatatattttgtgactctttatagtttaaattttttgtaagcaaaaaatacctggtaatttttcatttgtttttcatatactggtaccttctttttggctgagatctttcttttacttgtgatatattcatattactcg

SEQ ID NO: 164126 - DNA, 3041 bp, Homo sapiens
  Payload ID: 12313
  Gene Symbol: PDZRN4
  Gene Name: PDZ domain containing ring finger 4
  Uniprot ID: Q6ZMN7
  ENST ID: ENST00000539469
  CDS Start-End: 263-2599
acgggggagtgttgccatgaactgactggaaactctgtgtgtgtatccgtgagtgcaagatacttagggaaagcgaagaagagcatgctgctacacaccactctggcttacgcttccagctaacagcggtttgtctgtgtttctggactgaagtgactgatgaaaaacagtagtcaagtctggagggtgattccctttcagttcacttgcctttcagttctggggaaattagaagatttgctctctctctctgcttcttagaatgggctgcaatttgtgcacttttcagaaaagagaggaacactacaaactgctgtatgaagtttcccaggtcaatgggaaggatctttcaaaggccactcatgaagaggcagtggaagcttttcgcaatgccaaggagcccattgtggtgcaggtgttaaggcgaacacctcttagtagaccagcctatgggatggcttcagaagtgcagcttatgaatgccagcactcagacggacatcaccttcgaacacatcatggctctggccaagcttcgtccacctacccctccagtgccagacatctgtccattcctgctctcagacagctgccattctctacatccaatggagcatgaattttatgaggacaatgagtatatttccagcttgcctgctgatgcagacagaacagaagactttgaatatgaggaggtcgagttgtgtcgtgttagcagtcaagagaagctgggcctgacagtctgttaccgaacagatgatgaagaagacaccggcatttatgtcagcgaggttgacccaaatagcattgctgccaaagacggccggattcgagaaggggatcggattttgcaaataaatggggaagatgtccagaatcgagaagaagcagtggccttgctgtctaacgatgagtgtaagagaatcgtgctgcttgttgcaaggccagagattcagctggatgaaggctggctggaagatgaaaggaatgaattcttagaggagttaaacttggagatgttggaagaagagcataatgaagcaatgcagcccactgccaatgaggtggagcagccaaaaaagcaagaagaagaagaaggcacaacagacactgcaacatcctcatccaacaaccatgagaaggacagtggagtaggacgtacagatgaaagcttgcgaaatgatgagagctcagagcaggagaatgcagccgaggaccccaatagcacatctttgaagagcaagagagacctggggcagagccaagacactctgggaagtgttgaacttcagtacaatgagagcctcgtatctggtgaatacattgactcagactgcattggcaacccagatgaggactgtgaaagattcaggcagctcttggagctcaaatgcaagattcgaaatcatggagagtatgacctgtattactcaagcagcacaattgaatgcaatcaaggggagcaagagggagtggagcatgagctacagttgcttaatgaagaactgagaaacattgagcttgagtgtcagaatatcatgcaggctcacaggctccagaaagtgacagaccagtatggagacatctggacattgcatgatggaggattccggaattataacaccagcatagatatgcaaaggggaaagctagatgacatcatggagcatccagaaaagtctgacaaggacagttctagtgcttacaacacagctgagagctgcagaagtactccgctcactgtagaccgttcccctgacagttcccttccaagggtgatcaacctcaccaataagaaaaacctgagaagcacaatggcagccacccagtcctcttccggacagagcagtaaagagtcgacctccaccaaagccaaaaccactgagcaaggttgtagcgctgaaagcaaggagaaggttttagaaggcagcaagcttcctgatcaagagaaggcagtcagcgaacacatcccttacctctctccttaccacagctcctcatatagatatgcaaacatcccagcacacgcccggcattatcaaagctacatgcagttaattcaacagaaatctgcagtcgagtatgctcagagtcagctcagcttggtgagcatgtgcaaggagtctcagaagtgttcagagcccaagatggaatggaaggtgaaaattaggagcgacgggacacggtacatcacaaagagacccgtgcgagaccgaatcctgaaggaacgtgccttaaagatcaaggaagagcggagtggcatgaccacagacgatgacaccatgagcgagatgaaaatggggcgctactggagcaaagaggagagaaagcagcacctggttagggccaaagagcagcgccgtcgccgtgagttcatgatgcgaagcaggttagagtgtctcaaggagagccctcagagcggcagtgagggcaagaaggagatcaatatcattgaactgagtcacaaaaagatgatgaaaaagagaaacaagaaaattttggacaactggatgacaatccaagaactgatgacccatggggccaagtctccagatggcacgagagtccataatgccttcttgtcggtgaccactgtatgaccgaatgaatggaatgcatgcgactgattttaggaggatgctaccagtttcggtagagtatgattgcctcgttcaatgtggcgtttttatatatattttgtgactctttatagtttaaattttttgtaagcaaaaaatacctggtaatttttcatttgtttttcatatactggtaccttctttttggctgagatctttcttttacttgtgatatattcatattactcgtttataaaaaatcaaaaacaaaaggaaagaaaacaaaaaaaacttgcacaaaaatactgaggagccaattaatttcctacttcaatgtatctaatgtaagtgaaaatctggatttatttctctagtttacttattttctactttaataataactcaatgccaaaatatttctatgcttgtttcttggcataatacattttaaatcaaacctgtt

SEQ ID NO: 164127 - DNA, 846 bp, Homo sapiens
  Payload ID: 12314
  Gene Symbol: PDZK1IP1
  Gene Name: PDZK1 interacting protein 1
  Uniprot ID: Q13113
  ENST ID: ENST00000294338
  CDS Start-End: 124-468
gctcctctcctccagggccagactgagcccaggttgatttcaggcggacaccaatagactccacagcagctccaggagcccagacaccggcggccagaagcaaggctaggagctgctgcagccatgtcggccctcagcctcctcattctgggcctgctcacggcagtgccacctgccagctgtcagcaaggcctggggaaccttcagccctggatgcagggccttatcgcggtggccgtgttcctggtcctcgttgcaatcgcctttgcagtcaaccacttctggtgccaggaggagccggagcctgcacacatgatcctgaccgtcggaaacaaggcagatggagtcctggtgggaacagatggaaggtactcttcgatggcggccagtttcaggtccagtgagcatgagaatgcctatgagaatgtgcccgaggaggaaggcaaggtccgcagcaccccgatgtaaccttctctgtggctccaaccccaagactcccaggcacatgggatggatgtccagtgctaccacccaagccccctccttctttgtgtggaatctgcaatagtgggctgactccctccagccccatgccggccctacccgcccttgaagtatagccagccaaggttggagctcagaccgtgtctaggttggggctcggctgtggccctggggtctcctgctcagctcagaagagccttctggagaggacagtcagctgagcacctcccatcctgctcacacgtccttccccataactatggaaatggccctaatttctgtgaaataaagactttttgtatttctggggctgaggctcagcaacagcccctcaggcttcca

SEQ ID NO: 164128 - DNA, 770 bp, Homo sapiens
  Payload ID: 12314
  Gene Symbol: PDZK1IP1
  Gene Name: PDZK1 interacting protein 1
  Uniprot ID: Q13113
  ENST ID: ENST00000371885
  CDS Start-End: 426-770
gtggacaccacgtgatcctggggaggcttttgcctcttccgagggctctggctccagggcctccctgttccaggggctaggtgtgccttcctcaatgctgcttttggctatgagggtgacgggcccagggcttcagggccccagatcgcaccttgccatctggggtgtccgtcctttgtcccccacagcaggctgtgtttgcccattttctcctctgccatgggtggagatggatctgaagttgggtgttgaagcctctgaccaaggctgtatcttgttttgaggccctgcccggtttccagggaccacatctggggccaagaggaagaaccgaactgggactaggcggacaccaatagactccacagcagctccaggagcccagacaccggcggccagaagcaaggctaggagctgctgcagccatgtcggccctcagcctcctcattctgggcctgctcacggcagtgccacctgccagctgtcagcaaggcctggggaaccttcagccctggatgcagggccttatcgcggtggccgtgttcctggtcctcgttgcaatcgcctttgcagtcaaccacttctggtgccaggaggagccggagcctgcacacatgatcctgaccgtcggaaacaaggcagatggagtcctggtgggaacagatggaaggtactcttcgatggcggccagtttcaggtccagtgagcatgagaatgcctatgagaatgtgcccgaggaggaaggcaaggtccgcagcaccccgatgtaa
